United States Patent 11,913,074 (METHODS FOR ASSESSING RISK OF DEVELOPING A VIRAL DISEASE USING A GENETIC TEST) - sequence listing, part 23

SEQ ID NO: 2347 - DNA, 33416 bp, Homo sapiens
  source 1..33416: mol_type = genomic DNA
ttacatgaagatggcctcaagtacggtgtgatctttattccatgacaatcttcaactcaacacaaatttcatctttacataggatggtaattgtacaaagaaataaaatgttttttaaaaatccgattaaaacactgattccacccaccccccagccccactccagtgaaggaggtaatggagggtaaggtcagggcagaggagaggagtccccatctgcactgagcggccgcctcccgcccctcctcaggacccacagccagctggtgcgtcgaggcccggctggcacttcctgcacaggaggctgccaacaagaagtgagtgggcactgtcctctctggctgttcctggggcaccaagcacaggtgacagcttaagtctaatgagctttcaagttcaacaagccctgaacgttctctgccagatggaagccccacgggcaagaaggacagggtccctggacagcgaggttgaaaggaccctggaggagagctggcttgtggctatggcccatgtgcacacgtgtgtgcgcgtgcgtgcgtgtgtcgggggcagcatgcaggcccgacactggtaatcaggctgccatttggtccaagaaagcagaatcttcccagaaagacaatgccagcagctccccaattgtcctgtgggaatctgggcatgaaggctctcctgcctgctcctgtctcaggcaggcgggactgcaacaggaacacatcaggcgcaggccaaagggcagctgagaatagtttgtttggcaaacagagcttaactggaagctggatgcccagaaaggatcaagagcagcccaggaactcctgagcatcaatgcagggccccgggaggccctggtgaggccagggctagcccctgcttccacagcaaatctggggcagttgcagctgctcaagcccaaggagctgaggagagctgccagagttcccaggcaggtggggagcctgcacccaagggcttgcccatggtgatagcccacttccagttccagaagaaggcaggcctctaggaagcacccacaatctacactttaaaaaaggagaaaaaatgaaaagcccctgaaacgcagatgcagttcctcaggggacttttcatgtcaggcagttttctgctgagatgctggatttgtgaccaaaaaagggctggtatttatttttagagcaaaaaagcctatttgtgtctctgggagggcttggatgatgtggccacactcgcctgccccaaccccaggggctgtcgtcattctaagggactgaagacggggaaaatgttcacactgttaacaccagtcagaggtgtccatggggcagtccctgagggtctgtgacaccctctctggtccaccagcccagactcaccccactagaggaggcgggtggggtgaggtggggttggggggatgataggcccaaggcccttcaccagtgcctgcctggcaggtcctgcatactgcagcctggttccaggaggtactttccctatgtgacttgagaagacggaggccaaagaaactggggaaatgcccaccaggcaacttaagcttttggaaatgcacgggaacaatggagacgaaggaggaaagactccaaaaggctcagagtcagcggtggctcgagccttacagggcaccagtgagaagcatgctgtgggaagagcctcactgagccttccagggtctagaggccttgcctctaaagctcccactccttatctaggacagctctagaggtcagagtgttcttccgcacactgaacgagagctctcctggactgatgtcactgcaaggttcaggagggaagtagttagggtccaaagtcccagaaaaagagggatgggacaaagagagaaaacatacttggggtctggctttgcacacagagtagcaccacatgaatgcatgtgttggggattgtcatcaccctccaggagatgccacccacccagaggaccccagagaaccaggaaggctgggcaggacagccaggcagtctttacacagagaggcctgggcggctggccaggcaggcagccttcccgaaggcgggactaggcgtgtgctgctggacatgactaatccaccccgggggacaggcccagggctctgaggaattccataacttgatggagtcctgtccctttcacggaagaaaatggacttaagctatagcttgctgggaaggaatctggaactgaagaccgttttattaagagtccgtgtccaatgattaggcaggacctacgtagagggagagagaaaccagtgtgagagaaatggtgtggaatgtaccatttaagtcacaagaacagaagaaccgcagactgagccaacctcctgcgccctggtggctgatgggcacaagaacggcactggagactggagccctgccccgtgcctggctaaccctgggtagggacagacccaccgcccgcttagaaaggtcacagaggcagaatgcatggatgccttggaaaccgcccccagcctgctcagcttctagagagtggccctggttcccactagcaagctccacgtgtgccctgcctgagcgcacgccggcatttcctttactgccctcaagtggcttcttttgaatttgagtgatgcccctgccctgtcccaccagccaggtgtggcaagcccaccaggcccctgctgactctgagctcatctcacccaggggctgtgcactgtctagtctcaggaaggcgatgccagcccttcctcctgggtctacaagaaaggaggtaccagaatgcaggacccccagtggaggggaaagagcaaacagcctcatctctgcattcctccagatcccccaaacaaaaagctcaaactctaaaaagcagaacctattatatacactgttgaggaggagaaaaaaaagaaaaagaaacaggctaaggaataaagtcttgtcctttctttccttttttggggtatccaacatggctccctggaccagggaggggcactgggcttgttcccacccacgtagcagagcggatgcctctgctggagtcacggatgcaaccgacgtgctactccctggcccctgagtgcgggcatgggaaaaacccgcccactggcggcctctcactctgggccacattccacaaggctcgccctcacccgcccatgaagccccagaatccctccagctgcaaatgctggctgtttgtggggggagtcacctggctgtgcagacagaaaggctactgccctatcttcaagtctcttcctactcccccacctccagggtcctcaccattcccctaggtaagcgccacactctggagcaggcaagcagcaggcctggagatggactaagtccctcaaagaccctgggggtcaggaagctgaggctggttgtgtggtaagaacgccccatggcctctgtctgcacttcccagctcaaatctttccaaaacatcaagcattcctttttcccctggagctattaagaaacacccacatgctccaatcctgggaaaaggaagccaggaaactaaaatagctggactgcgctcccgttccaactagacgaccagaccaaagcccaggaggatctctcacacctccctgagaccctgtcccagcccaggtagctgaggttaaacgggtattcctaagagggacataagctgtggggacacttctgctcacaaagacctgtgcatgacacttgggaagaaccagatgtcagctatgtgacaagtgaaagctagaagattcctaggacatgccctgccccatgtgcttggcagacctaaccccagtgctaatgacagcaaagccacagtactgtccacagcccacctgggacagtgtcttcctccagcctgctccacccaggtctgcagatgccctaggggtggtgggagagtggcatttgtgccctacccctgcctgtctcaatacagaatcctcaagcagctccaggctttagctggaatcacagctcaatggaagaccacagcccaagcaatagctggaatcagaggaagtggtagggctggcccactgcactgcatgctgctggggcagagggtggggaatacatggtggcctgggacacagctgggaaagcagcacccacccccgccatcctcctcctgcctgtgttccgttgctccctgaactagagcctggccccagaggaccaccccacgcctgcatcagtccacagcatcccggtctatggatagctaccaagaggggtgttcatgtatcacaccccccagcctcaatctagtgactccattcgttttcttctggtgattcatgtctcagggccgttgtcagcggaactaaccccgtagtataagtgacaaaaataggccctttcaggaatttcggctccaatccaaatggaaacacaagaacgggggggggggggggggcgggggcgcgggcctgcaaatcaactaggcaccaaaagaccaaagggaaataatgttcccccaccctgacccactcccgttaaggcagagctgcctgtaacgggccatggacatcagggctgccgggattcctggacccaggagagcagctgctgaaggagctacgccccctctgccccccgccctgagagtgcagagtcctgtgcgggacagggcagcagaaggctgtatttactggtgccagggtgtgggttcccatttcgggatctgccgtacgaaaccctcgcagcggcccctcctgagaggagaagcaccctgccggcccacgacagagctcactcagtgcacacagaaggcaaaggaaagcccctgctggccaggattgggaagacaaaagggagccaggcaaaacccaaggtggggagggcgcctgggaagaggggaaggccagagcccagatagctgcatgagcggccagggctggaccgccagagcctgggagcctgggagccagcggctctgagactgtaaatctcgccctccttcccgccaggacagctgttcccaggactctcagattacttgttgcacaatctttccacttttttttaaagtgggggagtgaaaaaataataaaatctcggcagcggcaggaggggtgtggggcactcgttcaggaaaccaggagcattcccactcctctcccaaagcagaggagcccagaagagggacgcagaggccaagggcaaaggccatgatcacacactggaaatcaggatgtgatggccacagccctctaaggtgtcttgtcttgtgagggctaaagcagcacactgccacgaccacgtcatgtcattttagttaatcaggtcccctgacaatttcagcatctggggtttccacttggtcactcagatcctcagatgagaagactacaaaacccctggtaggagaagtcaactagaaaacaggaggtgcaaaaacccagaggaaggcaagctggaggcttggctggcatggaaagtgaaaagtcagcggccaccaggaatgctaattggatccaagaatacagccattcaccccagtcactctgctgcgagtgggggccctagcttcgggtggcaaagccagcccttcctgggcagccatggggtgcagtgcctcctgctggctgatggattacaaaagcagtgtggggagagtaacggttagagatgaaagggtgaaggatggcgacagggaaggccaggaggccagtgagctgcccacggcattctgcatgcagttgtggtagagaatgtgggcatctggagtcctggagggtccttcagcccacttcaaggcaagtctcctcactcacctgggaagcagagggcaccaggctgtccaagggaagaggaatactgacaaggcccgaggtgccacctacccccaccccatctgtgcacacacacctcagagcaacatggctctccccagctgccgtgaagggtcctcaatcttccttggcacgatcaagttatttacatgcactgattattgagggttagcatttatttctagttagaataaaatcccagggatgggacaggcccgtgggagaacatgcaggagtctactgccaaaacacaggtttcccactgtggatccccactccccagtctgcctgagaccctagggccagctctcaggtggtctgcagcacgccagctcactgacagctgcaccagcctagcggcaaccccgttggccgtaaacacaggatgttagctccatctctcagcaggggctggtcgccaggccttctgggcaccatggctccctccctagcctctcccctgcgccagcctgagcatctgcgcccctgagaataatgaggaaagtgcacacttggaggagagcagtcccctctccactcccacctggcacccagcatcactacctgcctccacctcccactgaggctgctgctcagaaggtgggctctaatggggaacccagggtccaacgtgcagacccacggggcttgaaaagaagggactgttagttagaactgcaggagggacacgcaagtccaggtgcgtgtggagttagggcagattcaggagcagccaacacagcaacgagcacactctggggaggggtaggcaatggctggggcccaggtgatggcagggccagcagcagactggcgatgcggctggccagctgcagtctgctccacatccaccagaaaccagcgaagcatctccctgaagcggccgcactgcacgtgactgtgatacggggaaggccctggggacacgaagtctccactggtgcagaaagctgggtgtggtcacatcaaggtcaacagcacagcctggacccccacgcccacagtcctcatggcccagcttccccgcccaccatccagggctccgcagtgtcaacgcccttggccattcatcctccatgaccagaccctggcagggagagcataacggccaggccgagagaatggacactactgcacagagtgcagggctattcatggccccagggagacagttaacaaagagacagacagacagaggaacccagcaagttctgggagtgccgtctctgggctctagcatcctggacacaggaccgagctagtgccaggcacaggtgggaagagtttggtaagacacgtagaacacaagtcacctaacctgtttcggagtcttcgctgtcagaggagctggactcactggagctctccgactctgaggacgagaagcccttcatcttggaggagccggcaatcacatcaactttctcagctgcaatccaagcaatgggagctggtcaggcagggctgtggcccaggaagccgctctaagccatgggcacaccccatccatctggaggaaggaccagtgaggagcctgtgcacggtgggcccaggggctgctcccaactgccagctgccactcccagaacccacgtggtcccacagttcccatgggtagactgcttacaatggaatttcaaggttccttcaatctctcaaaaagtctcctttggggggtttatcaaggattcaagagaccaggcagaaggataatttcctaacacaaggtaccgctgggcataaggcttggattctcccagttactcttctagcaggggaagaagaagatccaaaaggaacatgctgccaaaaggtaacgcaaggcagggagagacccccgggggtctctcagcacagctgttcagacgcacgctggaatcatcatgtggtgtgccccaggtaggggcccaaggaccccaggagctagtcagggctggggacaaagactgtgtgcaatgccctgacaccgatcctcagaggaaagccgtaggccaggatgagctgtgtgacacaaaagagctgcctggaagagtccagaaaggatgccacaccgaactgtccctgctagagagggacagaggctggctcagtgctgcataacgtatcggtacacaggtcctgggaccctgcagacccgcctttcctccttccccaaagaggccggaggaagactcagcagcaggtagcctgggttgaaagcagctccggcttagaacacagctgcaggcaacaaggtgcagagaggccccagacaccaccagtcagatatgtagaaaggcactgacagcctaggggtgagtgcaatgtcacaacctttcggaggtttctgtgtcaagaacacagatattataattggaaaaaaaaaagggggggggcgcagaaagagtggactgagcaaggagggaaaagttactctgagggtgcccacagaaggaaccccatgcccagggggcccaagcacaccttgaggtttccttttcttccgcaaacaggaggtgacatagcgctccagctcacgcagtgtggacggcttcagggtctcaaagtcgatttcaatctcgtcggggttggaattcttcagggagggctcccgtgactggatgatgtgcaccacgcggcccagcttctcgccggggagcttgttgatgtccaagctgagctgccgcttctcctcataggacataggcttgcacttgtcctcttcctccgactcatacgtgggagggggcttgctcttcatgggcgctggctccttcttgctacgaagggacgatgcagacaccatcaagaacgggccccctgaggaagccaggcactcattcctccacatgtatgttggggggaaggggtgcccttcccataccccccacccaccagccttcacaggaaacggggcatgggcaactcaatctctgggagcacccagtggagaccgaagcaaactgtgactggaggctgcccaagtgggggatgcactacagccccatccttgccgcctatcctccccaaccaaacatggtgagctccgaaggctcatcctacagaaagaggcagagacagtgcagctaagtcctgtgtgcaagtggccaccagcctggcctgtgaagccacggctgcagaggggcagcctccgcacccaatgaggacagggaggggcagtggcccacacagtctcagagcaagccctggaaggagggtccccacccaggacaaattcaggggacacagacctcacattgctgttgctgctattatttttcttcgtctttttaggaggaggttccttggctttgctttttttattctcttccacttcctctttccttttgtgcttttcttttttcttttccttcttgtctttctcctttttctttggtttgttctgctggggctgagagagggctgcaagctgctcgtgcacggctttgagctgtagaccagacaggcaagacacacactcagggctgaaaccaccttcctgtcacccaagacccaggcgtctgctccaaaaaacatgcgacagcatgcacctggggcatcagggtgtgggcataggggaggcaggggaagggaaggcccccagctttgcgcctgtcatgttaaccagattcctaacaagactatctccacccattcactcaactccaaagactgccagtgtcttcctcaccagaggagctgatcaagccgacagacaccaagtctcacggccatcctgatcgcagaaggagggcccctaagaatctaagtaagagcacacggacacgtcaggcacgaagggcctgatgactggctatagggagaggagcaaacaggtagccccaggagagacgaacatcctggctcaacctcctccttccagatactgaaaggatcaagccacctcctctctgcccagaaaatggccatgtccctccccatccccaaccgcaagctcaacacatatatcatacatacgtgtatgatcaacatgcatttgacctagcaaaggggaaaaggccacaggtggtccagtgggaattatgctcccttgggaactcagaaccaagaacatctcttagaaacttctggggaggccaccctggtccacggactctggggattaagaatggagccaccaatgccctcacctgctcctggagctcagccagccgctgggctcgctcctcctcagagtcatcagtcgaactgtcactgtccgaggagctatcgctgctgctgtcgctggatgagggcggggccacaaccttggtgggagggggcactgccggggaggacacggccaccactggctcctcaggctcgtccggcatcttggcaaagcgcatttcgaacacatcctggtgagggaaagacatgctgtgacggctgctgggtacccaggccgcggcctagcatcacctgccctcattggctgctggggccaactcaacagaaagcaaccgagggcgaaagaggatggtgatcctgtctctttgctgccgagacaggggcaagggccagccaagggcctctgacaactcttgcaacactcttctctcaaatctcactttgaagaacaaggtggtccagagatagcggggcactcactccctggaggacaccgcccaggcaaggacatgagacccaggccactaagacagccagctcactgaagtctgagatggtactggaccaagggcatcctcaaaccccaaaacagttagccgaggctcccaccagatgcgtgcgggggagcaggagttgtctgtggtttgagagggcattccaggcagaggacacagcacacgcagaggtccccggtgggaatgtacctgccacaagcgcacctcctctaggggactaggctctgctgtagcagacacggttctaagtcggtctcctcattcctcagatagcccctgcagcacttaaccaagcagggctgcaccactggaggaggcatctccagcacacacaggacaaggtaagagaggtttaggcagcaggtgtggggcactgaggacaggctacaggagggagccactgtgcgcaggagaccctaagacctttcaaccctaagatccagcaatcagatggaaccacgtggggtcatggagctcagggaacagcagccatgcatggacactggggtctggccacacatactgccagccagctgtcaagtccctgccctaccccgggggcgctgtgctcaatccagtgatggctcaagacagaggcagaagcacaggcctggcttcccagcaggattctgggacccgcttcaaaccaggaataaactgatcatcgtggaaacacaccatggcaaagaccttcccccaaatgtgtgtcagtgcttcagagaggaccacggccctggaatcccctcctgatggctcaggaaacactccttgaggcttcctctcccacgctgctggagcaggcatcccatataactgtggtgttgattccctcccctccaggacacccggagtatgacttcttttagccaataactttttttttggagacagtcttcacccaggctggagtgcagtggcgcaatctcagctcactgtaacctctgtctcccaagtagctggaattacaggtgcacaccaccatgcccaactaatttttgtatttttagcagaggcagcgttctaccatgttggccaggctggtcttaaactcctgacctcaacagatccacttgccacagcctcccaaagggttgggatgaccagcgtgagccactgcgcctggcccaataacttttttctttctttcttcttcttcttctttttggagatagggccttgctctgttgcccagggtggaatgcaatcaatggctcaatcatggctcactacagcctcatcctcctaggctcaagagatcctcctgcctcagcctccttgagaactgagaccaccatgcccagctaaatttttgtgcagacagggttttgacatgttgcccaggctggtctccaactcctgggatcaagggatcctcccacaaggtggtctacaatgaaaagtgccaggattacaggcatgagccactgcacccagcaaatacctttattcagaaataactccttgagcaggtctgagacaaggaagaagatacacaacaagggacgaccagaggccatcaccagttagcctcccaggagtggggcccagggaggaaaaggtggggggcttcacatcagagtggaggccccagtgagagagtaagacagatccctagccctgcagcacccggctacgtggcaggtgggtagtgccctggatgtgggtgggctcaggtcccaaaatgactccaagaggcagctggggccacatgagcttctggaagagccaggcctgctgccaagcagcaggaagcaggttagagaagtgggcctcagaagtgccaggacatcatgaagggagataatcagctatgcctcccaggacaaagggagtgccctctactgagtggtagctacctcagcgaactggtctgtaagcctgggccagcttcaagacttgaggatgtccttgttcctccccaccaggtgatgactgttgggtaaatgctggggtgggggtgtgtggcattcactctgaggcctccttccattccctgggtgctcatggccctggctctccaaaggccccaacaacaaagagcaaaaaatacaagacacaaagtcagctaagatgagaaactaacattggtgggactgggaactgccagcttcctggcgtgtccagttgtgtgaccctgtcatccttccctgtctcttggatgtgagaactcttgttgtagcctgagtggggggcatcctgggaaacccacaagccagtgggcccagggctgctgtaggaaaaccttgctgtgtggcttcaacagtcacaagtctccaagtaccagcttgatggtagacaggaatgacgagctccctgttcaaggagctcagtctagctggaaacagaaaggtgaatgaacacatgggcagcaaggggttgccatgaactggaagtgtgctgagacctaagagtgaaaagaacacagtcaggggtgctatggggccagcaagaggacagtaaagcccaattcaagatgcaccgaggcaagcctctcacaagggaggatggtgatggtgaggggtagcaggcaccagcacccgccagggaacaccgagtgcaggcattctgttgggctgacagtctcttgagacccagctgaggcccagccccctgcccggcatcccacagacctacacctcactcctctggaggtctgggtctgaggtcatgcttctcagtttcagcacacctcactggtttcagacaagtatctcagctgtcaggctgtggaacacaggttttctcaatgacccgagaatttagaggctcagagagaaaaataaagtggctccttttccaagtaactttccagataatcccacttcttgggcccagccaaattaagagacccaattaagcaggtcccaatagctcctgaagaagtgagcaagggctggaagctttgtccctccccttccctgatggagaatttgctctctacctgctgatgcagagaaagtagagagaagtaagaaaaacaaagcctgaaatgccacaaacacaactgcccactgaagagaagcctgctctggaaccctccaccatcaactctgttgctcaaacagaaacacctctaccaagcactggcagagaggtgtccctcccaagggcaggcgaaacaggctgggccagaggcagcccacctacagcaccccccaccccttgcctgcactaggcccccttgagattgaggcctgtgtccactccagtccggcacctggagcccgtgtgtaggaagaaactctactgctgcagtgtctgtggtgtgacagacatccagtggccttggtaaactctacattcaggcaggcttactcccctctcagaaggagaaaaatgcaaaaaaaaaaaaaaaaaccacttaaaacccaaaaatctttgttggagaaaatctgcgaaaaggaggtggctccagggtgtcaggagaggacagaaaaaatgagacaaaaatgaggaaggaagggctagaacacatcagagggtgctttttcttttctttctcttagtaaagtagctcaaaacagtcacctttggtgctggaagagaatttgtttctgctgagttcttcctatgagagtagatgaagggcatgggtatcaatgtgagcagtgtgggcaaaagctgcgcccctgtcttctcaagagagtgggagagagggagcggtggaggagttgaaggcaccaatctgagggcgccactgccaccgggtggccctgaacaaaaactgcattgaaattaaaaagtctggccgggcacggtggctcacgcctgtaattccagcactttgggaggcccaggcaggcagatcatgaggtcagaagttcaagaccagcctgaccaatcggcaaaaccccctctctactaaaaaacaaaaattagctgggcgtggtggcgtgcgcctgtaatcccagctactcaggaggctgaggcaggagaactgcttgaaccaggaggcggaggttgcagtgagctgaggtcgtgccactgcactccagcctgggcgacagaaagagactccatctcaaaaaaaaaagaaagaaagaaagaaagaaattaaaaagcctgaactccttcaaggatgggaaatgcaaacatgaatgatgaaggggcaatgttgtttgtgaagaaggcacacagacaacaccaaagtgaagagagggcaacaattccccaagtcacagaaaataaaactaagaaacaggccaggtgccgtggctcatgcctgtaatcctggtagtatgggaggctgaagcaggtggatcacctaagcccaggagtttgagaccagcctgggcaatacagtgacatgccatctctaccaaaatacaaaaattagccaggcatggtggcacacgcttgctgtcctacctgagaggctcaattgagcacagcaggttgaggctacagtaagcagaatgacaccccgtttccaaaaataaataaataaaaaaaagtagaaataaaaagctccaagcctgagcatgcatttaaataacaagagccacatccacactagtaagaaagagaccaacaaacttcacaagggaagtgtttatcctacctcaagagtttgagcacatgtcctctgaacccaaggcagcccctgatccacagagaataggagagacagtgccttaggtccagtgggagcaggtacgggctgctatgctggggagtctaggacaacatgagaactagtgcagctgggaggcaggcaggcagtggggctctgcctggcaccgatccacaggtcaccaaaggctttccaagtcctcacttctgccctggaagcagatggctgcgacagccaggtgtgcagaagcccgctgaggcctacaatgagcacatcagcacctcatgatggctctgaccctgagaacagaagcaacccatggccttggggagaagatgctgggaatttttatgatcatttatctacagtcttaaagaatttaaaaaagaagatgagtctctaatcccagcactctgagagtccgaggcaggtggatcacttaagcccaggggttccagaccagcctgtgcaacatggcaaaacccatctctttaaaaaaaaaaaaaaaaaagaaaaaaaaaaagaaaataaacgaggcaaaattagctgggcatggtggtgcaagcctgtagtcctagatactcgggaggctgaggtgggaggatcgcttgaacctggaaggcagaggctgccgtgagctatgactgtgccactacactccagcctgggtgacagaacgagaccctgtctccaataattaaaacaaaaaaaatagaaaagatgatgatgatagtactaaatattgactttattctccaaaatttttaacccaatcttattattcaaagaaagtcattttttaaacttaggtatttttccttttttaaaaaaattaagtttacacatctatgctgtaacctcccctccccgcccacacgtgtacttcacactgtgcaccacccaggctctcaacttgaaggaagtgacccaggacccccaatcagaattgtggccatgtggaaacaaccactctgcagctagaaggctcttacggctctggtggagggatgtccacagtgcagatgtcctcagctcacgactgtgacagcgacttctcggcaagagtgccccccacccccaacccacttgagacaggtgtgttttgtagaagagactgggccatgcacagcacacacccggtcttccagccaaaagcaaatgagtgctggtggagggggcttgcagtggaacacccactctgctttaattgaataaccccaacttaaaatgtatgcactaggctgactttaggcacttttctaaagcaacatggcattatcccaaggaaagtgacagaaaaaaaaactctgccaaggcccacagaagtctgctcccacgaggacctcagcctgctctgctgagggtggctgcgccctcccaagcctcacctggagcttgcgggccatggccaccacctcatggtcaggagggttgtacttatagcagttggagaacatcaatcggacgtcagcaccaaactcctgagcatcacggtactcacgggcctccagtttagactggaaaacaagacaagtccctgttagctgtgtctgcccatgtgaccatggagaagtggctggcagcagacgaaagggatgcctagaagagcaagttggtttcttggctctcagtttggtcaagactctagtggggggacaggccatcaccccagttctcagcctcagggctgggactggccctgccaacatcccagctcacctgcctggctcgcaggcaggtggactcagaacccacaggaggcggagcctgagccagaaatgacggggagaactgatggagagggctgggcccagctcatcgtgatgacacagtacaggagctggtcaaagggacacagcactgttccctgctctgcctgccccatgcttgggactccactcccagaagaagaaacacgtaacaagtcttaaaactaaaaaagcctcaaaacactatggtgaaaatgtcggcacttacagcgtgcctccaacacagaggagacagcaaggccttctccaccacaaagaggctggcaaggccgccaagccccaactcccatggagcatctactgtgtgggcaaggtacctggggcactgggcccccaaggccagagggcttgtcttgcttttcctcagactaggggaaggggcagcacaggcatctgtagccacaatggccaagcaccaggtctcagagcacgtcccacagcagacagcagggggcgctgagtttcttcgagttggcgggaaaaatccacgcagccaccgttccagggcctgggcttcctcttggactaaaaggtctaggaaggttctgatgtggagggacagcctgcccaccttgtcccttccctcaggcacatcccgctaaccttgattgtgctcatgtccatggggtgcttgatgatgtcacagtagtcgtgtaggcccagtgcctccacgtccacaggcttgtagaagggccaggcgtaggcggcgtgcttcttggcaaacatctccttgaggatgccgctgcagcacttgagctgctccgagaccttgctgctcttctctggtgctgggtgctgctgagagtcgggcacgtccttctttggaggtttcacaggccggctgctctcccgccgctggcccagcttggtggtcttgggctccgggggcagcgagggtggctcgtgaatggggtcaatggtggtgggggtggtggtgtctgctttcctcttcactcccttctttgtctgccaagaacacggacgccaacaggcacagtcagaagtggcagccggcacagctgccctcagggtcacccccaaagccaggccctgtcttggggcccatcgctcacacagaatggacccaaagataattgcacaggcaaagggccaaggacaggcagatcgtgtcccaccactctgctctgcagctgggacaggacctgcctgtggcaggagaaagcataaaactgtgtgctcacttggaagccaagggacctctggaggctgcttagtacctaacaccagggcctctccccaagtgcccaggggaggcacaattcagagactatttagatggcccatctgcaaatatgcacagtctaaataaaagaggtgcagggggcaggaacccactaggaggtgtgacacaattatgggacctttgagtcagtggggcggctgtttctgggctgcaatttcaacacagcaagatctccccagaaacacccaccagtgcccgggacccaggacaggctctgtgtaaagcacgggcaaggacagggccgctctcctccctggtgaagcagccctccagagtccaggagactcaccttcacaggctgtggggtggccgcgatgatgggtgggtggctctgtacgggctggggagctggagcgggtgggggttgtggctgggggggcactggcgggggcgtctgcagtggctggggaggcaccactgtcatgacaggggtctggacgatgaggtccggggtgacggcagggaaggggtgaggcgtggcctgcacaggaggaggattcggctgaggggtctgggtctgcggaggagtcgatgcttgagttgtgtttggtaccgtggaaacgccaggttttgctgtccctacaaatcataataagacggcgagttagagaccatgctgacatccacatgctggctgacctcgtggggacatacaccacacacagtgaacgcacattcgcgtgttgcatttgcctgagagacgaacatcccagactccactctgccaaacccttccacctgtccctggggctcaaagaacagcagaaaaccgcacttcccatttcctagggcgtcctggctgcaactcccaactcaggcacaaagaccccttcatgaagcctggaggcccaggctcaaggagcaggaagcacatgctgacaggggacagagagcgggaaaacactcctcagagcttccaggcacagctgcccttgttcccagaagcactgccttctgagtaagagcttctggcagggagccggcagtagccgcccttgccaaggtttctggaaactggcaggcccccacctcctggaaccacagggggcagctggactgctgcccttcatgactggctcgagcgctgcctcccagcagctgtgcaggcagtccgaacacacaatggtcacgtggcacacccaaccagctgcaaaaagtgaggggttatggccagagctctaacaaaactgggtggaccagggtgagaatgtctaggagcataacctgggtcaccacatccttcgtgtgcatgctggctgccatgaaaatggacaaagacacccagtgccttcatctatcagctcaagcagcacccatgttccctgtgcatctcaaggagcaagggtgagattctgctgagtttcccaattctccttcctcaggcacaactcctgggcttctcccagactggaataggagatgccaccacgtctgtctgcccagcgtgcagcccaaacccctggtcccagggagtgaggaccaatatcctcatgtaaggataagggatgtgacttacatgaggatcaggaatgtgatctgataggtacaagagccacagggtgacacgtgagactagttctccttggttacctttgggtgcagcaggggatgtagcaaccccctttctgccaccacttcagaacagcatgggaggccaggtgaaaggctgctgctcagagaagcaaacaactcacactcagggaccacctcgcaaatgtcacccttctgcagcatggagttgcaaaggacaagatgtagccagtagctgctggagagtttcctagacagaatcatttcctagagtgggcagctctgccagctggcccctggaaccctgtgtcagttgggggtggtgacaggcagagatggatgaggagggctttcacttcagatgactgagcatcagaagcagggataactctgacaccagtgcattaaggtaattccaatcacaaacctcaaagtttagaactgagatgttagttaaaatgatttctggtcatgttaatgtccttaaaatggaaaagtaaaaaccacctatgatactggcagggtgaagtgttcaacaaacgtcaaagtgctttgagaagttacactttccttttaccctaagtccatcacctaccctcagaaaaggcagggcccaattatttctgcttagaagaggccacagggccacatgaccctatgggatggatccaacaccaaacccaatctcacatgtccaaacaccaacacggcatgcagtatataatgtcacatcctcctgccactcccagccccccaccaaacttggaaaagggacaaaggtcggggagaaagccaatttacttgctatttcagtactctacctgtttctttcctcccacgtcctcttccttttgcctggactatcatgatctcggtttcttctgtgggtagctcatttattttttgcaagaagagcttttccagagcttctgccattaagactatgtcatctccaggctggataaggagacacaggggtagagtcagagggccctcccctccccacctctgtagacagggcaccccatgccacccaccccctgcccccaaaacatgaagcgtcgtattccgggtccttccccgatctgcacccaaaggagccacaatggctacactaccaggtatcacagaggcttgtgttcccacaggtgtgctgagcctacacttgtctacctgcacctccctcatcttttaagctctggcctatctgagaagccatcctaatgccttaagcatctaccaagctcagccaatcactgaaaggggccctcctttgacacaattcaatttcaccagaaatacgtgaatgacacaggatttcttgccatgatacattagcagggccccagcaatgctccccaacgtacccccatggcagctcaccaggactctgggcactgcacatctcacactagttgaggggtcccactctgtcacctcatctataacatgctgttcccactcagttctaaactgagagcctggtctgcacattttgctcaaacctaagtggtgagagctgagactttaaaaaacacagtaaacttcaagaaactcacctacccatctcttctgggcatttttacccactacaccagcagaggtcaaaagctgagttctgtatagtgtctccctccagagtcgttctatttgaaagggttgattttaatcacatctgtggtctgaactgtaaacaaatgatctggcttcatggcacagccgagccgaaaggtttggctacggggttaggaagtgaccttcaggtctacatgtaggatcggggggacacttcatctatggccaagagttattgacagtcatgtccacagttccagcagaccatcacccacagagcaactgagctctgcgccggccccatcacaccctctctcacgtggaggtctctgtttgggcacacctctgcacaactacattttagcaggctctttcctaacaatttacatcacccaaatggactttgtcatgagtcgccactattctcctcacaccttctctactagacatgctcaggaaccaaaatcccaagggcaccagaagcacatgcttcaggctaacaaggacagcttgcaagttcaacatggccagcaccctcctcccagcaaaaaagcccacacccagtcacaggaacaaccacaggtctcattacctctacctccaagggtctcctcttgccagactccaagcccagccacacccaacacccctgcccacgggctcctgacatgcccactgccgtcgcctcccctcctctctccccagggcagctggacacccacccctacatctcaccttgttgtagatgtaacaatttgtaaacatagtgttgaagtcctggatacattcctgagcattccagtaatagttgttttccaagcgcttctttattgttcccatatccataggcgttttaatgatcttatagtaatcctggagagcagagagcaaaagtccagtgtcacctaggcagccaggcagcacaaacgctgggctggccaggctggcctggggacctcacccctggctgctccacaggtaaatccacgggagccacagctcctactggcatcagcaagtgatcttgagggggaacaccaaaataaagtggagcggggaagggttcctggatgctggggagtaattcagagggaaacgtacaagtttccaaccactctatcttgaaataggctgccttcattgaaatgcacattttttctttttatggatactaaaatattctttcacttttaataaataagggggaaaccaggcagccttttaaaaagcaatcctcacctagtaagacaacccatggcaggtcctacttgtcccatttgaaattttacatgtccataaaatgcaaattcccctggcgccaatgctggagtccacttgtaacccttgaccctggcactcctgcctccttgtcaccatgaagagctgcggagcataagtttccacccctagtcaaattcactggacttaacgtttctttcatttgcacacagtctaccactaaggattctttagtatccagatactgctgactgaccaggttaactgccaaatgacaaatctggacagccttcacaatccttagtttaaaaaaataaaaataaaaaatccaccatcccaaccctcaaactttcagatcttactaagtgccaaacagaaggagccagataacagatgtaaacgtcttaaagtgcccgaaatcaaaccacgttattctcacaacttcttctctaaatctaaacctattctaaaactaagttcatttttaaaaacaaccacagaaggaatgtgcggacagatcaagcagtgcctgggtttccaggtgtgaggatcacagagggccaggcagggggctgcacccagacagcaagtccccaatgactagaccagctcaggctgttggcctgacccaccgatagccaaactttctgagtcatcactctgactgaggacaggtgctcctgtaattaagttcaagtggtgtatcagaaccaaatccaagtggagtcccacggtagaggcacaggctgcaggtggagaggctgttgcagggagaagagagcaggtatactaacagcaagcactgaggccctgctcgggatggtagtggacagcgttggaaaggccagcacagggtatgggtgtggggtttttgagatgttctgacatccacgagaaagagtcaagggccacctgcttacatgtaaggttttggcacagctcatggaactgccctgggggtgagggctacaagtgcacacccaggcaccttaggcaagtggtcaagaggggagactggaagcagactatcggtgccactttctatgctctgacctcctttcccaagagaaccaagtctgaatagatctatcccagtggaaatttaaattttattctatggccaaaggccactgaattggccacagtgtgtcacatgtctcaatggccaacagaatagtgaagaggaattggggtgaaggcagagagaacggtgggggaagaggaactgccagcctggatagtacggtttggggccatgataggagatcaaaatgcgggtgaagacctagaaggcatcagaaaacagacaaggaatactttttagggtggccttattaacatctcctgaagaaggaagtccccagaatacagatttagcatgatgatgctcctgatcaagcatcccctttggctcagcccccaccaaatgccctgagaccactctcactcagcaagctccttcctcagctcctcactctcccatctctgaagacatcagatcagggccaccatggatcagtcccttcttcttatgtcagagctaatgagggcgacgtcaacagtcatagggacaggtagattcacactctgcctggaccaagaacgtcctggccactctccagcctgcacttcagagactgaccttgaactcccaaaccccatggcctaaccaatcacccatacttgtctgtcccgctggccagcactgttccctcaacctcaactgggatgctgctgcttctcggcaatctcaagtcccccagcccttccttctcctgtcttcaccttctcagccctccctgcttcagttcccactgcgttttcttgtaacaagctgacccctctgctattctggcactgatgcgtttcccttcaaagccaagcttcttgaaatggtggcttcacatcctcaccttctcattcacaccgtcgcaatctggtttctacttctgtgtcacgtcttcctaaggtcaccaatgccctcctaaaggtcaacaggatgatcaggtcggaatcctcatctctttgacctccctgtagcttctgatgttggaatctggggaaatgctctcttctgtaggccttctgccttccctccaacccctaagggcctcacaacgctctgggttccactccagtccccagttccttctctcctggttctgtgcatctgctctgagaatttcactctcaactatggaccctgtccagcccagctagagattggtgcagtgagctcccccaacagtctccctcccgcaggccaacacagctgactgcctccactcctcatcttggtcaatggagagcgtggcgcctcttctgcctccatacctttcctgagccatttcaagacccagacacgtactgccctgttctgattatcttcccccgagtgcttgacacgtattcagtgaagcaatagcaccagacagttcttacagacacaatgactttaaacttgggagtaaggatgcctggcagaggctaaggccgctcctacacaccagtggctctggtgtgcacacaccagtggctctggtgtgcacacaccagtctgggtcagtggctgcaaccacctaatgcacttgccagggggtgtacaggacttggcaaacagcaaaggacaatttaaagacaattagtctttggtgctttaaagaaaaaaaaactgaagcatttattccatctgctccctgaggttcagctggagatacaggtttgcttgcagaacagtttgctagggacatgggcatatggaaaactctccagggaaagagaagaggggcgggctcacaaaagcacaagagcaagtgtgctgtagccagagggagggagggcaacaccacctgtgcagctgcagccacagccacctttctccaactggggacgcctccatgtacttgcactccctgcgaggtaatcccactatctttccccaccgtgtgctccgggtgacagtgacgatgatgctaggtgaccactactgcagcaagccaattcccctctagcatagtttgatcaactacgtctacttatccttgatcaactatgtccacacctgagaaatgaaggggctaggatggccaagtgctctgacttcaactcaccatggaactggaagtagatctgtgggccttcctttctcccactgcttcaacctctacacaattttccccaggattccaatatctaagaaaccagttattgttaagccaattagctcattctttctccctgatttcaactgatcagaactgctgaaaccactcactcaagggccctgcagctctcaccatgattccaaatgcatctcctaccctccccccaggaactgccctgaccaggagacatgcaggagacgacctccaggacggccaccctgggccctgcccacactactcacagggaggttcagcttgacggcatccacaggctgctggaaaggccatgcaaactggtgtttccatagtgtcttgagcaccactctgagcaggtattgcagttggttggtctgcctcttgggcttgttagggttggaggtctctgggggcggggggttggtgctggctgcgttggctggctggggttgggcctgggcctgtgttgtagacatttgggaagtttctagtccatcccccattactggcagatttctcaatctcgtcccagggccgctctccgcagacatgctagtgatcccatcacattcttcaccaggcactctacaaaggaagagaagagcccccgtgagatatcagtcagcagatgggcaccgctcagaatgacaagtccctctggctgtggtctccaaggactgagttccctggcggtagctagccaagttggccagagggaccaccccatgctttgactgaaagggttccaatgtctcctctccccaaagacttaccctccagcagggaggagaccacaaaccaacagaggaggcagagtgaggtggtgagagcccactaggagccagcaaaggctctgggaactatgaaggtcatggggaaggatgtacaatgaagccacgtctcacaaacctgcacatcccttttcccacctgtgagtttttaggagatgctgcctgtgtgtggaaggggatgatgtgcaggctcccacatatgacatttacattaaaactccttgcatttatcacacacaaagcatcgagcaaagtcaatcatttcatttggtgggccaggcaaggagaagcaggaaggctgggtctgcccacccatggatggcccacccagtccactgccaagtgctcagggcaaagccacaaacctactaagaatattttcttggtaacttaaataatgcaggtctgctgaggaaagaatctgcatgtttactgccgataaaataaaaatgaatccatactagacctaccattttcttttttttttttttttttcatctctagtaataaacctaagaactcagtggagatatcattctgggatgaacttttagtgggttcagaagcagctttatgcctagcacacactaggcaccctagctgccagtgaattactttgtgtaatttatttaaaccaggattacacaaactttttttgtaaatgcagttctggcaaataatcctattttaaaagctccaaacggagaatttgctacataaagcaactccatggactaggctgtggagataggaggccagtgagataggagaagacacagggacaaatgacacaagccacatatcagcttgctgggaaccttgggtccagtgtaccagtcttggtccagacacagatagattacaggacacaccaagtgactggacacaagtattggtagaaggacagcatcacagacaaggaaacaagtcagtggggtttaaaccccactcacatgtggagtaggctggagagggcttccatgcagcaggaccagcaagtccaaagtgaccaatggggacaagtgtgatggggtcaaggggaggggaggcctaaaggcactgtggaagcctggatcccaagatggagggtacaaagagtgaggccaaggaatgccattcagtttggtttctatgattagatttctcctagaaagcagctccagaaacatatagctgatgctgcgcaccaagcacacgccaggtaagtgatggcaggcaggggcaggagcagcccagccacaaggacacaggcggccagggtgcagagccaagctgtcccaaaaggaagcagaccctataaattttccattaagtaatgacattctggaaatctctaagcaatgcccttgaggcaagatgaggccaaggacttctagaacttctgggctgggccatgcttgtctctttccaaaaagacttgcagcaaagccaagggacaaaaactcatgtgtgctctaggccagtgaccactcttcttcaccttctcaccaggcctagataggcccttgagccgaggaagctgaattttcctttttttttttttttggagacagggtctgtcgcccaggcagtgcagtggtgcaatcttggctcactgcaacctctgccttccagggtcaagtgattctcccacctcagcctccccagtagctaggattacaggcgtgtgccaccatggctggctaatatttgtatttttagtggagatggggtttcaccatgttggccaggctggtctcaaactcctgacctcaggtgatccacctgcctcggcctcccaaattgctggggttacaggcgtgagccaccatgcccggacagaagctgaattttctgttcacaagaggaaaaaaacagttttctacagaaaacctgactcttgaaccttgcctcatttggtgttttaagccattgcaaaagccaaaacacccctccctagccagccagctcacaagtgatgcacagtaacagttaaatcctcaaaaatgctaacattgcttctggcctcatccccactttacagatagggaaaccaaggcagagagaagtacctgacccaggagtggaaacaccaggtctaagcagatagagtggcccaaaacctggcatctgattcctgggcagttaagttggcctttgaattaaggaagtcctcattagtgagctgcacacacacacatcagaagtgtccaacacagatggtcgtgacacagtggccatccttaacacacacacacccaggcccctgaggaaagaaactgctggaggttgtctgttcaaatgtgaaggtatgacatgttcgacacataagacaaacctggtagctaccagtaccccaaagtttctttaaggaggctctgaagataaccaatgaaagtgacatctggccgggcacggtggctcacgtctgtaatcccagcacttcgggaggccaagaagggtgggtcacttgaggtcaggaattggagatgagcctggacaacatgatggaaccccatctctactaaaaagacaaaaaattagccgggcatggtggccagctactcgggaggccgaggccggagaactgccttgaacctgggaggcggaaactgcagtgagccatgattgtgccactgtactccagcctgggcaacaagagtaaaactccatctcaaaaaaagaaaaagaaaagaaaagaaagtgatatccatggccccacaagggagatcaccataagatacctgggactcctgcacccactctgggcctgtgcagcacctgcacctcaagggaccacactgacctactgctatgcccacagccttcccatgactacaggaaagtaagacccttgggaaacttcaagagcccactcttactgcaatgacaagaaacatgaggaaaaccaaccacttctagtctgttatggggcaagaaagagaggtacagtgagaagtcctatgtgagacccagatgacttttctaaggcccagatttgatatgaggtcagcctccttgggcgaattcttcccacagcggttccccccaaccccacactgccccaggcccctagcatctaggctctaacaacaagtcagccaaccctgtcaccttcagcctttgatctgctagccctactgccagacagatggatggatgcagacataggctcacagactctctctctctctctctctggcccatagcatctggtgcttccctcatctccatctactgagttccatggtcagccccctaggaacctgaaggcaggctcatctttatttcacttttatcttcccagcacacaggaggtgaacccttagtgaccatacccacattgtcatcctggggcttccagctcaatctcaaagctctggaaaagcaaaacagttcacactctcacatggataatgtggagaccaccagactcagtcactcgctcaggcaacaggtcctaacatgccttgccctaggactcagcggttgacatggcattctcccgagtgattaggcaatacatggggtgaatactgtggaggagaagggcagggctgctctggccatggacggggagagggatctgcactgacccgagggacaggcggcatctctgaagaagggacagagaatgagaccagaggcgggggaagagtgtgtgcgcttctgtggtgggggtcaggcaggcagtggcaagagaaggcatgcctggcatagataacaggagacaacatcttcaaagttttccgttgaaaagattaaaaactgctgctccctctccattttcatactgacctgtggccaaaaagcaggagccaccattcaccacgttaagagttagctgaaggtcaaggaaaaggaaaagaatttcgcttattgtttccaatccaaaggcggctacataatcgaacttgatgtcctacttttgtatctacttccaacagaaaccctatatcatgttcccagtgtagaagaaaaggatgaagcaaggttagacaatgctgtagttcccaaactgagtgcccaggtgccttggggatgtcatggtaaactcagatggcattgcaggaactatcagcacaaggcaattgatcatttcaacaccagattgcactatattcaacagtgtcacagcctgcaacacttgatcagcaagttgctgtaataaaacaaagattgtccaggcacagtggctcacgcctgtaatcccagcactttgggaggccatggcaggtggatcaccttaagtctggaatttgagaccagcctggccaacacagtgcaaccctatctctaccaaaaaaaaaaaaaaaaaaaaagtacccaggcatggtggtgtacacctgtggtcccagctactcaggaggctgaggcaggagaattacttaaacccaggaggtggaggttgcagtgagcagagatggcgccactatactccagcctgggcaacacagcaagactccgtctccaaaacaaaacaaaacaaaacaaaaagcaaaggtcatataaaaatcaacatgaacacctgtaatcccagcactttgggaggccgaggcaggcggatcacgaggtcaggagaccgagaccatcctggctaacacagtgaaaccccatctctactaaaaatacaaaaaattagccaggcatggcagcgggcgcctgtagtcccagctacttgggaggctgaggcaggagcatggtgtgaacctgggaggtggagcctgcagtgagccaagatagcacaactgcattccagcctgggagacagagcaagactccgtctcaaaaaaaaaaaaaaaaaaaaaaaaaaaaaaaaaaatcaaaatcaacatcaacaggagatgcaggtagtgacatccaacctggttctaaggtttgaggatttgtgcagcatccaacaggcagacacatcctattagaaagtaactatgggccaggcatggcgggccacacctgtaatcccagcactctgggaaaacgaggtaggcagatcacttgaggtcaggagttgcagaccagcctgccaatctggtgaaaccccatctctactaaaaatacagaaaaatcagccaggtatggtggcgcatgcttgtaatccagctactccagaggctgagacaggagaatcacttgaacccgggaggtggaggttgcagtgagcagagattgtgccactgtactccagcctgggcaacaaagcaagactctgcccaacccccgccaaaaaaaaaaaaaaaaaaaaagaaataactatggttatgtaagaataaaatatatattcctgtttttttttttcagacagctacacagttgttgagacattggtacttattctgctgcttgtgcttaaccacctaataaacaatattgttggctacttcctctggcctgaggcatcacagaaaaaactgagacgtttaaggatgttgtgaaccaagaaaatttgggaacttctgggttaatgaaaataaaaatgtaaattttccctctaaattcatagacctctgattaagcatgcctgttttcttttcttttttgagacggagttttgctcttgttgcccaggctggagtgcaatagcgtgatctcgactcactgtaacctccgcctcccaggttccagcaattctccggcctcagcctcctgagtagctggtattacaagcatgcgcctgcacgcctggctaattttgtatttttagtagagatggggtttctccatgttggtcaggctggtctcaaactcccaacatcagatgatccgcccacttcggccgcccaaagtgctgggattacaggcgtgagccaccgcacccggctaagcatgcctgttttcaaagatgttctttgcaatcataatatttaagtgaattttgggaaaatattagggatagacagtacttaacagagaacacaactgtaatgttttataactctgaacaggaaacaaactgtttccttggactaactttatttacaatctagtcaatagttcagacaaattagaaatctaacaaaagatatagaaaacaaaaaatccaaaaccagctcagaaagtttgaacactttctgcaatgatggagtccctacttgcaaagtggatggcagcaagccctcttcactggtatcctccatcaagtcatagttctctccatcgcccgtcccaattagctcctatccttcaaaggggctttcagggtctccagacaggctttgttctgaacccactcatcacaaagcagtctggccccaagcaacctgttcccagaccaggaaaggagattagaaagcaggatatagatagatacagacatgcagggcaggcttagttctgggactctaaaggcaagccagagaggaaaagagaaagaccacaaacaactgcccagaatctgctgattgctggagattcagttcccagttccgtccatcacaagtcactgagaaaaccaatgggttgggaccagctatactttgtatttgcagttctacctgaagtcctggcctcccagcggacctcttgaaacccagtaatcctgccttcattctgtctggtctgttcagactcacccctctcctaaagtgatggagcacacaggtagaaagacgccagggaaggcagaagcagtcgccaagacgatggctggttaaaccacacttagcagagctttatgcaagccatcatcacacagacctgcaccagggcctagaagagctccacaggaggtacctgccacttcttgagctgatgctgttatcgagcacttcatctgtattggcttagttatccacacaacaaccctaaaaagcaggctgcgactttatcatcttcatcatcatccccatggggacagaggcagagtggatggtggcctggttggctggacgtcatttggaacagtgtgtgcttcaagtcctctgctccacagctgtctccactcaccaagcacagtggcaacacccacaaggggcagaggcccagtcatcctacacgggtctttggcttggccagcagcaccacactttgctgtacccatcagtggcctgccttctctgcagaagcagctgggtgccatgtggcccataagctgggtcttaagtcagacttctagcagtagtattccaaagaat

SEQ ID NO: 2348 - DNA, 42962 bp, Homo sapiens
  source 1..42962: mol_type = genomic DNA
tacccacagcgcggtggcagccgctgctcaatgaggagacgatcacaccatttcggagataagcagtgccattgtgtctggaggagaagagagaattaaaaataaaatagaattcaacaaaaaatatatatagaaaaaaaagaaaaaaaaaaacgaaacagaaacacaggtgggaaggaactgactttggttggtggcctcactccccggccgagggctacccacgcaggacagtcgcctcgctccggatgccatggacacacacacctccacggcactattcccttttgcacaagcaaacacttacagagagcggctctcaattaaaggcttgtgggggagggtcggggggtctgttcaaggcaaagtcagtgccagcgagggggtgggccggcctcgcccgcctccagcccacgcaggcctgccctggcctcctgggagcgggcggcgatggctggggtgtggggaaagactcccggcgggcaggacatcacgaacgtcacgttcttggggacagaaaaccagtcacggcggcagcaacgatgtcctgtgtatactgtgtagacatttggcggagagaagggcctctgccccgcatgtggggatgcagggcttgggtccagccggcacttgctcgtaacaaggcgtgtgctgagcggacgtcctgtgaggggtggtgggtggcgggacgtctgtccgactggccgtaaggcagacaggctctgcaatcctcagctgcccgtcaggcctgccccgggcatagcatgcaggagggccaggccctgaggcatcccctggccgctgatcccacctccaccaccgcccctaacactatggaaagtcaatgttttgccagaaaatcaaagtcagaagccacctaggtgcgctcagaaaagattttcttcaaatattgacaatagatcactctggaaattcatgtcaatggtagctgccatctggaggagaaaggaaggagggagtcaggaggatgacctagccaccctgcagctacaagccctcatacccgctaccagcagtcagccccgtagccctccccgtggctgacccctcatagcgctcaccccgtccacacagcactcagggccctacagctgagtccagaggaccacatgccgaccagcagggacggggctcccccgctgcccctccctgtccaggctccagtccccctttcccagctccctcaggagctaatccttagaccagggtccccaccaggcctccagactcacggcttcccggcgtcttcgctcctgctcccgcttccgggccaactccctctgctggtccagcatggactggggctgggagctctgggcctgtggggtggcggcggcagccaccgcagctgcttgctgttgctgctgctgctgttgctcctggcgctgctgctgctgctgctcctggcgccgacgtgcctcctcatgggcccgccgggcctgctccagcgcatcctcgtcctctcggctcctgggcagagggtcccagtcagcctggggactggtgtggccccaagagtccccatgccccacccagacacccgcccacctcatgcgctcctgccgcagccgctccttctccttctcagcgtgctcggcctgagccttcagggccttctcacgctcctctttctcccgagcggcgcggcggaactgctcgaagctgtcgctggatgacttggctgtggaggagggggtggtcggatgcttctgcactaggctggcccaggagcccatgttcttgattttcaggtcctgcagaacagagaggttggggtgggtgaggggtctgctgtgcctaaagggcatagctgggggtgtgcccagcatggcaccttccagggccaaggggcaagcgacacccatggacctccatcccaacctttttgggcgcaactggagtcttcggctcctgtttctgtttgtccttgtcaggggcccctggtggcggtgcgttctgctctgggggccggatcacaggcctcccgacatccacaggcttcatttccggccctggaacataaacagccggtgggccctggcccacctcaccccagtggggcatggtccaccagccccacagcaagcttatgtccaacacgggcctcggggggcctgagccctggctgtgggcagggagagcactcacgctggggcaggtggacgggggccttgatgctctccgggtgcttggggggctccggccgcagcgaggggctgaagggctcgctgcggatgatgggtgagtggatcttctcctccttcaccaccacgaggggctggggctggaccacggaggcagcacgcagctcctgggatggcacaggcacagcggccggtgaggtgggcaggcacccccggccctagcccacaggactatggcccagccctgccagttacctgtttcttaggctggacgttttgctggggtggagactggtgggtcaggctctggaactgtgacatctggggggaatgtatcataagcggggagggggcttcgcggaggtgacctaggagaagggacaaggaatgtgtcaaggggctggcttagaactgctggccctgagagaattgtcgggaaggaaaacgtgggctgtatggagaaactgcatgtgccgcccaggccctgggacaagggtccattagcccagctcaaaaagggtgaagacccacacaagtgactgggcctggtgaggacatgacccctccccgaaagggctgagtgccctgtgtccccctgcatgtggggcataactcagtgtgcagcagagctttctagggccctgtggcaccagtcctggtgtttgaccctcctgtgtgcatcagaatcatctgggatactgtggaaaacacagatcctgacacatgtgggcttggcagggcctgggccctaatactttttaaacccacaaagctcagcctgggttcctgccaactagcctggcccacctggatgattgcagggggtgcaagacccagtcctgggggtggggatgctcaggaccctccccacagtcctattccccactcagcctgcacgcccccacggaagagagaagcctggaattggcctccacctgcgccgagtggggagcaggcggaaaagggcctggagctgtctcttaggaaacaggccagcctgacacctgcatccaacccaaggctgggaaggatccagcagccacagggactactgggccctcaatcacagtgagccagcacctcgggactgtgcagctggagcagctgagtcctacccatccaacatgtggcctctctctgctggaatccctgcaggcaaggggcctcaccgctctttggctagctgcagctcgggacaagccacactgtccacagaggaggctgcccctctgcaacgcttttgctcccagcctagcctcatgcccatctccttccactgtctgtcagcacaggcacccttgggttctccaggagccctgctggctggaggcatctattttcataggcctggagcaaaccacaatgccccaggtgtggtagatcctctctagagccaggacccactcctaacgccagaagacactgcagctgcttggagcccacatggtggccaggcccatcctgtccccgcagcccactgctgtgtgtggctggttttcctggcgttgacatctcctccaattctagcacatcgggaccactttgggcactgccaattccattcagtgctggagggccccaggtctggcctgccagggatccacaggcacatgactgcaacagcctcccacccaactagggcagtgccttcagcacctgctgaggctgacctgggcaacggtaggctccaggggctgtggtttatagaaaccacctgcctgctggtgggttcagaggatggctcacggatgactcctgaaagctggctgggggcccagggatgcctgttaagtctctttgggagtctaacaacttggcttttggcctacaaagcccctagcaggatcccaatccacactgctcttgatgccccatcctagcctgctggggcttgggtcacggccagggacctgaagtagagctggctggagaagacctgcctcagccccgataggtgcctggtgcacccgagtgctggctcttctaaatgccttgcatcccctgtctatcacccccaacaggagtccagccctgcttcgcatgagaacaggcacagccgcacagctgccaggcccaacaccagtatttcccagggaggacaggcagcttgttcttggctcagggcatgcagagatccacttggcacctgactttttttttttttttttttttttttgagatagagtctccatctgttgcccagactggagtgcagtggcacgatctcagctcactgcaacctccgcctcccagactcaagcgattctcccgcctcagcctcccaagtggctgggattacaggtgcctgccaccatgcctggataatttttgtatttttagtacagatagggtttcaccatcttggtcaggctggtcttgaaactcctgacatcaggtgatccacctgccttggcctcccaaagtgctgggattacaggcgtgagccaccgcgcccggcctgcatccagcagcttttgctgggttaggagtaatcacagccctgcctcgttgcttgatttgcaggcagcacccggtacacacccaagacaggcagcaccatctacactgctgaggccaggaccctccaccctaaccctgcagcaccacatcaggaggcactgaccagaacatcccctgccggagccagccaggacattctggttactgacacttaagcgcccaggaaaagtgaaagggtgtggcctgaccaatgctgtcaatgggaaaagggtggcgtggactgggctggaggctggtaacaggcgatgaggacaggtcctgggcgggctctgagctgccttttgagcttccagctcagtgctccccacaccatggttctggctctccctgaacttcattcttcactctgctaagttagctgctacctgtctgcgatcactgcctcttggaagcatatcctgaccccctgaggtgcatcaggtacctcccctgggctcctagcttccccacctagcaagaagtcacctagcattgtcgtgctcctgactcaagagagggaccagaggggccttattctgagtgatctcacctcacaagcaagagagacacctgataaacacacactgtaggaagcaccaatgacccttccaggtccccctccaagctgaggctcagctctgaacccactgcagcctgaagcatgagttaacccttctggcttcctgaggacaaaactataggcccagcaccagcctccccagagtctacgggtgaggaccacttaccggttgagtaggggtccgacttgtggtgccggggtgaatggtggtgctggatgacttgctgaggcttggcaggctgcggcgggggtggctgctggcctgggggcggatgggggggctgctggccctggggtggcgggggctgttggatgtgggtggaaaactgcatgggctgcaagtgcacgggccgtggagggggctgatgctgctgctggggtggaggctggggctggggtggtgggggtggtggcggctgctgctgcagctgctgctgcacagaggggtggggtgggggcggcagggggggtgggggctgggactgcaccttcacggaagggagtagcggcgtagggggctgcaccttctgcagctgctgcaggtacagctgcatctgcatggaggtgaggggtggggcaggtggctcttcatcctccagcagcacttgggggggttgggccatggggggctgtgggagcaggggtgtttgggtcaaggctggtgacacggctgggggccgggcgggcttgggaggcagggcagcggctcggttgctgggccgtgatggctgctggggtagtgcgttgtgcaaagctggaagaacacaacaccgaggcggtgaggcctgagcacctgtggccccagcctggcctttctgctccatcctgacctcatctggactccagtgctctcctactggcctccctcaaactggcactccctccccacctaccgtggcctcccacaaactccagagcagtaaacagcttccagagagagctttagggcggtgtcatcctgccctatgctctgtgtccccagctcctgctccccatgctcacaatggcccttcacgcctcagtgcagaactcggtctctcacttgcccggccattccccaggcccccaggaaggtggccctgtccccatatcccccaggtgagtgctgtccaggttccatgggaggaatcccatctcatgagtgcatcccccaacccctgatgagaaaagctgcagaggggtcccagcttttcccatctaacatgacgcctggcccagcagcagaaataagtcaaaatcatctagattgttactcaaatgatgtcagtgttttagaaacaaaaatcttctgaatcaacgtgttaataactccatgcatgacctgtcttgaggcatctcctttaacttccaagatggcctcgagaagccacagatcttccctctagagaccagagcagctgaggctaagaagctgcccagccagagtgctcggacaccacatgggtaaaccgaggcaggaaggggtctcaacccacactggggcaggccacggctcacctggaggagagaccactgcgtgctggttgagatggggtggagtgctgtgctcaggcggctggggcaggtgagggggcagctcaggctgcggcaggtgcaggatgggctgggtgaagtggccgatggggtcaaagacgctgcctgggagctggggctccaggacgggcacctgggtggcaatgaagggtgggggcgaggacttcatcgccggggctgcctgctgcggcatggagggtgggggaggcgggggtggcggctgctgttgctgctgcggaggtggaggcggtgggggctgctggggaggcgggggcggctgctggggcacaggagccggggcctgctgcatctgctgatggtggtgatgatggtgctgcagacagagagacagacagacagacaggctgatgtcaggcaggcagaactggcccgggccagacccaacgtcccacctaatgaaggatgcccctgagcccatgtaccttcttctgctccctcccggggtgccccttcttttttgacttcggagccatctctgcagaggaaaagagaaggtagtgaggctctgggggagaaggtgagtgagctggccttggatgaagaaagacgagaaaacagggcactttcaggagaaggaccagtgaccctgagaaagggcagccgagttcaatgagggatgagttggtcatcacgggagagggagagacatgcgaggcatcacctacccacttgcctgctgcttttcctagcagggactgtgcctgaaaaagcctcccctgccaagcttcagatcaccacggttgcaccggaagctgagagcttgcccaacgcctcccactactcaagggtcagtcactcactatagtgactgagtgcatggcctggacagcaacctgctcagttttccaacaacctgtgatggttgcaatggtcacattcatcttacagctgagaaaagtggggcttcagaagggaggggacttgtccagggtcacatggctaaaaagcagcttctcgggggcctccaactgcatggccctctaaggcccactcctttccatcctccaaagggaagcagagaggctcagctggggctgagagccacaggacggtgaggaacatatcggcaagggaaaacacagagagcccactccgggagaaaaaaaaggagcaggctggcctcctgggaatgaccagctactaaagaggtagatggacctcagaagtccctgctttgggacacagtcaccatgctgcagacagaaggcagcatacgcccccactcgtgtgggccgacggcttggcaccacagtagggtggatgggtccagggtgtgtctgcccctgagaggtgtactcgagagccagcgtgcccacctctgtcctcaccccagagatttacactaagggacttttgccagttggatgtcccctcaccaaacatggatggtgtacaagccccacagggggacatgagccctggccagtgctcatgggctggcaggtcacagtcgcctgccaccagatgggaggccgggcccatggtatggcgccttttggattcctgtcactgagaagcacctcatggcactgcctggcttcgcctgagctccttgtcagggtgctgcctcttgctgctggtgttggaggacacatgctttgcccaaatccaggctccttccacttggatctgcttcgtggagggccacgctaagcttctgtgaggcacgtggccctcagtgcagcatgccaccaaaagggatggggaaggaccttgtgccctgtaagagctcaccactccacgccagacaagacacagacacagacctcagcagctacagacacacgtcctcgtacaaatgaccaggggctgcaactggggacacgggggaacctggggccccgcctaaaacctgcatacagggctcaggacgctctgggtcagagtatgacatctgatgagagagatactgttgtgggtgagacatgccagaagggaaagcttgagtagatttgcagtgtcagggcaacagggagtctgactgctgtggtggtggggggaggagcgctggctgcagaggttggcagccacaggaccagggggaccctgcacactagggaactgggaagaaaaggccagggcttctctcctggcacaaggaggtgatggagccgcgctgtctgggggcatgctgggcacaccttggaggggacccggggcagaaggcggaaggtagggggaagcagcagggccaccgtgtgaagtccgactaggagaagcctcagggatgtgtccagatatagagttgagggaaaaagtgtgtgtgcaagggaaggatatgctggggctcgcctgttgtctcgtggccttggaagaaaccttgtttttttggttgtaaaagagggatggtcactctaacccctcacagcctgcaggctgtgagcagaggcccataggagaagatgtagggacaaagcgcagcagggcctgtggggggttccagggggcatgtctcagctgccttggaaaggccacagggaatatcctgaggacttgtctccagggccccttgcaagtgctggggcccccaggcaaggcaggcctaaaaagtgggggagagaaggcggcatgtgcacggcagacccccaggaccagatgcctaaaggggctggtggtagaggtacccccttctggcccatgtggtctgagccttgtgtcagagttaccagtaaaagacaagacaggaagtgcacagcttcacaacacaccagccccaagacacccccacacaaaactctctagaaagggttacatgaagatggcctcaagtacggtgtgatctttattccatgacaatcttcaactcaacacaaatttcatctttacataggatggtaattgtacaaagaaataaaatgttttttaaaaatccgattaaaacactgattccacccaccccccagccccactccagtgaaggaggtaatggagggtaaggtcagggcagaggagaggagtccccatctgcactgagcggccgcctcccgcccctcctcaggacccacagccagctggtgcgtcgaggcccggctggcacttcctgcacaggaggctgccaacaagaagtgagtgggcactgtcctctctggctgttcctggggcaccaagcacaggtgacagcttaagtctaatgagctttcaagttcaacaagccctgaacgttctctgccagatggaagccccacgggcaagaaggacagggtccctggacagcgaggttgaaaggaccctggaggagagctggcttgtggctatggcccatgtgcacacgtgtgtgcgcgtgcgtgcgtgtgtcgggggcagcatgcaggcccgacactggtaatcaggctgccatttggtccaagaaagcagaatcttcccagaaagacaatgccagcagctccccaattgtcctgtgggaatctgggcatgaaggctctcctgcctgctcctgtctcaggcaggcgggactgcaacaggaacacatcaggcgcaggccaaagggcagctgagaatagtttgtttggcaaacagagcttaactggaagctggatgcccagaaaggatcaagagcagcccaggaactcctgagcatcaatgcagggccccgggaggccctggtgaggccagggctagcccctgcttccacagcaaatctggggcagttgcagctgctcaagcccaaggagctgaggagagctgccagagttcccaggcaggtggggagcctgcacccaagggcttgcccatggtgatagcccacttccagttccagaagaaggcaggcctctaggaagcacccacaatctacactttaaaaaaggagaaaaaatgaaaagcccctgaaacgcagatgcagttcctcaggggacttttcatgtcaggcagttttctgctgagatgctggatttgtgaccaaaaaagggctggtatttatttttagagcaaaaaagcctatttgtgtctctgggagggcttggatgatgtggccacactcgcctgccccaaccccaggggctgtcgtcattctaagggactgaagacggggaaaatgttcacactgttaacaccagtcagaggtgtccatggggcagtccctgagggtctgtgacaccctctctggtccaccagcccagactcaccccactagaggaggcgggtggggtgaggtggggttggggggatgataggcccaaggcccttcaccagtgcctgcctggcaggtcctgcatactgcagcctggttccaggaggtactttccctatgtgacttgagaagacggaggccaaagaaactggggaaatgcccaccaggcaacttaagcttttggaaatgcacgggaacaatggagacgaaggaggaaagactccaaaaggctcagagtcagcggtggctcgagccttacagggcaccagtgagaagcatgctgtgggaagagcctcactgagccttccagggtctagaggccttgcctctaaagctcccactccttatctaggacagctctagaggtcagagtgttcttccgcacactgaacgagagctctcctggactgatgtcactgcaaggttcaggagggaagtagttagggtccaaagtcccagaaaaagagggatgggacaaagagagaaaacatacttggggtctggctttgcacacagagtagcaccacatgaatgcatgtgttggggattgtcatcaccctccaggagatgccacccacccagaggaccccagagaaccaggaaggctgggcaggacagccaggcagtctttacacagagaggcctgggcggctggccaggcaggcagccttcccgaaggcgggactaggcgtgtgctgctggacatgactaatccaccccgggggacaggcccagggctctgaggaattccataacttgatggagtcctgtccctttcacggaagaaaatggacttaagctatagcttgctgggaaggaatctggaactgaagaccgttttattaagagtccgtgtccaatgattaggcaggacctacgtagagggagagagaaaccagtgtgagagaaatggtgtggaatgtaccatttaagtcacaagaacagaagaaccgcagactgagccaacctcctgcgccctggtggctgatgggcacaagaacggcactggagactggagccctgccccgtgcctggctaaccctgggtagggacagacccaccgcccgcttagaaaggtcacagaggcagaatgcatggatgccttggaaaccgcccccagcctgctcagcttctagagagtggccctggttcccactagcaagctccacgtgtgccctgcctgagcgcacgccggcatttcctttactgccctcaagtggcttcttttgaatttgagtgatgcccctgccctgtcccaccagccaggtgtggcaagcccaccaggcccctgctgactctgagctcatctcacccaggggctgtgcactgtctagtctcaggaaggcgatgccagcccttcctcctgggtctacaagaaaggaggtaccagaatgcaggacccccagtggaggggaaagagcaaacagcctcatctctgcattcctccagatcccccaaacaaaaagctcaaactctaaaaagcagaacctattatatacactgttgaggaggagaaaaaaaagaaaaagaaacaggctaaggaataaagtcttgtcctttctttccttttttggggtatccaacatggctccctggaccagggaggggcactgggcttgttcccacccacgtagcagagcggatgcctctgctggagtcacggatgcaaccgacgtgctactccctggcccctgagtgcgggcatgggaaaaacccgcccactggcggcctctcactctgggccacattccacaaggctcgccctcacccgcccatgaagccccagaatccctccagctgcaaatgctggctgtttgtggggggagtcacctggctgtgcagacagaaaggctactgccctatcttcaagtctcttcctactcccccacctccagggtcctcaccattcccctaggtaagcgccacactctggagcaggcaagcagcaggcctggagatggactaagtccctcaaagaccctgggggtcaggaagctgaggctggttgtgtggtaagaacgccccatggcctctgtctgcacttcccagctcaaatctttccaaaacatcaagcattcctttttcccctggagctattaagaaacacccacatgctccaatcctgggaaaaggaagccaggaaactaaaatagctggactgcgctcccgttccaactagacgaccagaccaaagcccaggaggatctctcacacctccctgagaccctgtcccagcccaggtagctgaggttaaacgggtattcctaagagggacataagctgtggggacacttctgctcacaaagacctgtgcatgacacttgggaagaaccagatgtcagctatgtgacaagtgaaagctagaagattcctaggacatgccctgccccatgtgcttggcagacctaaccccagtgctaatgacagcaaagccacagtactgtccacagcccacctgggacagtgtcttcctccagcctgctccacccaggtctgcagatgccctaggggtggtgggagagtggcatttgtgccctacccctgcctgtctcaatacagaatcctcaagcagctccaggctttagctggaatcacagctcaatggaagaccacagcccaagcaatagctggaatcagaggaagtggtagggctggcccactgcactgcatgctgctggggcagagggtggggaatacatggtggcctgggacacagctgggaaagcagcacccacccccgccatcctcctcctgcctgtgttccgttgctccctgaactagagcctggccccagaggaccaccccacgcctgcatcagtccacagcatcccggtctatggatagctaccaagaggggtgttcatgtatcacaccccccagcctcaatctagtgactccattcgttttcttctggtgattcatgtctcagggccgttgtcagcggaactaaccccgtagtataagtgacaaaaataggccctttcaggaatttcggctccaatccaaatggaaacacaagaacgggggggggggggggggcgggggcgcgggcctgcaaatcaactaggcaccaaaagaccaaagggaaataatgttcccccaccctgacccactcccgttaaggcagagctgcctgtaacgggccatggacatcagggctgccgggattcctggacccaggagagcagctgctgaaggagctacgccccctctgccccccgccctgagagtgcagagtcctgtgcgggacagggcagcagaaggctgtatttactggtgccagggtgtgggttcccatttcgggatctgccgtacgaaaccctcgcagcggcccctcctgagaggagaagcaccctgccggcccacgacagagctcactcagtgcacacagaaggcaaaggaaagcccctgctggccaggattgggaagacaaaagggagccaggcaaaacccaaggtggggagggcgcctgggaagaggggaaggccagagcccagatagctgcatgagcggccagggctggaccgccagagcctgggagcctgggagccagcggctctgagactgtaaatctcgccctccttcccgccaggacagctgttcccaggactctcagattacttgttgcacaatctttccacttttttttaaagtgggggagtgaaaaaataataaaatctcggcagcggcaggaggggtgtggggcactcgttcaggaaaccaggagcattcccactcctctcccaaagcagaggagcccagaagagggacgcagaggccaagggcaaaggccatgatcacacactggaaatcaggatgtgatggccacagccctctaaggtgtcttgtcttgtgagggctaaagcagcacactgccacgaccacgtcatgtcattttagttaatcaggtcccctgacaatttcagcatctggggtttccacttggtcactcagatcctcagatgagaagactacaaaacccctggtaggagaagtcaactagaaaacaggaggtgcaaaaacccagaggaaggcaagctggaggcttggctggcatggaaagtgaaaagtcagcggccaccaggaatgctaattggatccaagaatacagccattcaccccagtcactctgctgcgagtgggggccctagcttcgggtggcaaagccagcccttcctgggcagccatggggtgcagtgcctcctgctggctgatggattacaaaagcagtgtggggagagtaacggttagagatgaaagggtgaaggatggcgacagggaaggccaggaggccagtgagctgcccacggcattctgcatgcagttgtggtagagaatgtgggcatctggagtcctggagggtccttcagcccacttcaaggcaagtctcctcactcacctgggaagcagagggcaccaggctgtccaagggaagaggaatactgacaaggcccgaggtgccacctacccccaccccatctgtgcacacacacctcagagcaacatggctctccccagctgccgtgaagggtcctcaatcttccttggcacgatcaagttatttacatgcactgattattgagggttagcatttatttctagttagaataaaatcccagggatgggacaggcccgtgggagaacatgcaggagtctactgccaaaacacaggtttcccactgtggatccccactccccagtctgcctgagaccctagggccagctctcaggtggtctgcagcacgccagctcactgacagctgcaccagcctagcggcaaccccgttggccgtaaacacaggatgttagctccatctctcagcaggggctggtcgccaggccttctgggcaccatggctccctccctagcctctcccctgcgccagcctgagcatctgcgcccctgagaataatgaggaaagtgcacacttggaggagagcagtcccctctccactcccacctggcacccagcatcactacctgcctccacctcccactgaggctgctgctcagaaggtgggctctaatggggaacccagggtccaacgtgcagacccacggggcttgaaaagaagggactgttagttagaactgcaggagggacacgcaagtccaggtgcgtgtggagttagggcagattcaggagcagccaacacagcaacgagcacactctggggaggggtaggcaatggctggggcccaggtgatggcagggccagcagcagactggcgatgcggctggccagctgcagtctgctccacatccaccagaaaccagcgaagcatctccctgaagcggccgcactgcacgtgactgtgatacggggaaggccctggggacacgaagtctccactggtgcagaaagctgggtgtggtcacatcaaggtcaacagcacagcctggacccccacgcccacagtcctcatggcccagcttccccgcccaccatccagggctccgcagtgtcaacgcccttggccattcatcctccatgaccagaccctggcagggagagcataacggccaggccgagagaatggacactactgcacagagtgcagggctattcatggccccagggagacagttaacaaagagacagacagacagaggaacccagcaagttctgggagtgccgtctctgggctctagcatcctggacacaggaccgagctagtgccaggcacaggtgggaagagtttggtaagacacgtagaacacaagtcacctaacctgtttcggagtcttcgctgtcagaggagctggactcactggagctctccgactctgaggacgagaagcccttcatcttggaggagccggcaatcacatcaactttctcagctgcaatccaagcaatgggagctggtcaggcagggctgtggcccaggaagccgctctaagccatgggcacaccccatccatctggaggaaggaccagtgaggagcctgtgcacggtgggcccaggggctgctcccaactgccagctgccactcccagaacccacgtggtcccacagttcccatgggtagactgcttacaatggaatttcaaggttccttcaatctctcaaaaagtctcctttggggggtttatcaaggattcaagagaccaggcagaaggataatttcctaacacaaggtaccgctgggcataaggcttggattctcccagttactcttctagcaggggaagaagaagatccaaaaggaacatgctgccaaaaggtaacgcaaggcagggagagacccccgggggtctctcagcacagctgttcagacgcacgctggaatcatcatgtggtgtgccccaggtaggggcccaaggaccccaggagctagtcagggctggggacaaagactgtgtgcaatgccctgacaccgatcctcagaggaaagccgtaggccaggatgagctgtgtgacacaaaagagctgcctggaagagtccagaaaggatgccacaccgaactgtccctgctagagagggacagaggctggctcagtgctgcataacgtatcggtacacaggtcctgggaccctgcagacccgcctttcctccttccccaaagaggccggaggaagactcagcagcaggtagcctgggttgaaagcagctccggcttagaacacagctgcaggcaacaaggtgcagagaggccccagacaccaccagtcagatatgtagaaaggcactgacagcctaggggtgagtgcaatgtcacaacctttcggaggtttctgtgtcaagaacacagatattataattggaaaaaaaaaagggggggggcgcagaaagagtggactgagcaaggagggaaaagttactctgagggtgcccacagaaggaaccccatgcccagggggcccaagcacaccttgaggtttccttttcttccgcaaacaggaggtgacatagcgctccagctcacgcagtgtggacggcttcagggtctcaaagtcgatttcaatctcgtcggggttggaattcttcagggagggctcccgtgactggatgatgtgcaccacgcggcccagcttctcgccggggagcttgttgatgtccaagctgagctgccgcttctcctcataggacataggcttgcacttgtcctcttcctccgactcatacgtgggagggggcttgctcttcatgggcgctggctccttcttgctacgaagggacgatgcagacaccatcaagaacgggccccctgaggaagccaggcactcattcctccacatgtatgttggggggaaggggtgcccttcccataccccccacccaccagccttcacaggaaacggggcatgggcaactcaatctctgggagcacccagtggagaccgaagcaaactgtgactggaggctgcccaagtgggggatgcactacagccccatccttgccgcctatcctccccaaccaaacatggtgagctccgaaggctcatcctacagaaagaggcagagacagtgcagctaagtcctgtgtgcaagtggccaccagcctggcctgtgaagccacggctgcagaggggcagcctccgcacccaatgaggacagggaggggcagtggcccacacagtctcagagcaagccctggaaggagggtccccacccaggacaaattcaggggacacagacctcacattgctgttgctgctattatttttcttcgtctttttaggaggaggttccttggctttgctttttttattctcttccacttcctctttccttttgtgcttttcttttttcttttccttcttgtctttctcctttttctttggtttgttctgctggggctgagagagggctgcaagctgctcgtgcacggctttgagctgtagaccagacaggcaagacacacactcagggctgaaaccaccttcctgtcacccaagacccaggcgtctgctccaaaaaacatgcgacagcatgcacctggggcatcagggtgtgggcataggggaggcaggggaagggaaggcccccagctttgcgcctgtcatgttaaccagattcctaacaagactatctccacccattcactcaactccaaagactgccagtgtcttcctcaccagaggagctgatcaagccgacagacaccaagtctcacggccatcctgatcgcagaaggagggcccctaagaatctaagtaagagcacacggacacgtcaggcacgaagggcctgatgactggctatagggagaggagcaaacaggtagccccaggagagacgaacatcctggctcaacctcctccttccagatactgaaaggatcaagccacctcctctctgcccagaaaatggccatgtccctccccatccccaaccgcaagctcaacacatatatcatacatacgtgtatgatcaacatgcatttgacctagcaaaggggaaaaggccacaggtggtccagtgggaattatgctcccttgggaactcagaaccaagaacatctcttagaaacttctggggaggccaccctggtccacggactctggggattaagaatggagccaccaatgccctcacctgctcctggagctcagccagccgctgggctcgctcctcctcagagtcatcagtcgaactgtcactgtccgaggagctatcgctgctgctgtcgctggatgagggcggggccacaaccttggtgggagggggcactgccggggaggacacggccaccactggctcctcaggctcgtccggcatcttggcaaagcgcatttcgaacacatcctggtgagggaaagacatgctgtgacggctgctgggtacccaggccgcggcctagcatcacctgccctcattggctgctggggccaactcaacagaaagcaaccgagggcgaaagaggatggtgatcctgtctctttgctgccgagacaggggcaagggccagccaagggcctctgacaactcttgcaacactcttctctcaaatctcactttgaagaacaaggtggtccagagatagcggggcactcactccctggaggacaccgcccaggcaaggacatgagacccaggccactaagacagccagctcactgaagtctgagatggtactggaccaagggcatcctcaaaccccaaaacagttagccgaggctcccaccagatgcgtgcgggggagcaggagttgtctgtggtttgagagggcattccaggcagaggacacagcacacgcagaggtccccggtgggaatgtacctgccacaagcgcacctcctctaggggactaggctctgctgtagcagacacggttctaagtcggtctcctcattcctcagatagcccctgcagcacttaaccaagcagggctgcaccactggaggaggcatctccagcacacacaggacaaggtaagagaggtttaggcagcaggtgtggggcactgaggacaggctacaggagggagccactgtgcgcaggagaccctaagacctttcaaccctaagatccagcaatcagatggaaccacgtggggtcatggagctcagggaacagcagccatgcatggacactggggtctggccacacatactgccagccagctgtcaagtccctgccctaccccgggggcgctgtgctcaatccagtgatggctcaagacagaggcagaagcacaggcctggcttcccagcaggattctgggacccgcttcaaaccaggaataaactgatcatcgtggaaacacaccatggcaaagaccttcccccaaatgtgtgtcagtgcttcagagaggaccacggccctggaatcccctcctgatggctcaggaaacactccttgaggcttcctctcccacgctgctggagcaggcatcccatataactgtggtgttgattccctcccctccaggacacccggagtatgacttcttttagccaataactttttttttggagacagtcttcacccaggctggagtgcagtggcgcaatctcagctcactgtaacctctgtctcccaagtagctggaattacaggtgcacaccaccatgcccaactaatttttgtatttttagcagaggcagcgttctaccatgttggccaggctggtcttaaactcctgacctcaacagatccacttgccacagcctcccaaagggttgggatgaccagcgtgagccactgcgcctggcccaataacttttttctttctttcttcttcttcttctttttggagatagggccttgctctgttgcccagggtggaatgcaatcaatggctcaatcatggctcactacagcctcatcctcctaggctcaagagatcctcctgcctcagcctccttgagaactgagaccaccatgcccagctaaatttttgtgcagacagggttttgacatgttgcccaggctggtctccaactcctgggatcaagggatcctcccacaaggtggtctacaatgaaaagtgccaggattacaggcatgagccactgcacccagcaaatacctttattcagaaataactccttgagcaggtctgagacaaggaagaagatacacaacaagggacgaccagaggccatcaccagttagcctcccaggagtggggcccagggaggaaaaggtggggggcttcacatcagagtggaggccccagtgagagagtaagacagatccctagccctgcagcacccggctacgtggcaggtgggtagtgccctggatgtgggtgggctcaggtcccaaaatgactccaagaggcagctggggccacatgagcttctggaagagccaggcctgctgccaagcagcaggaagcaggttagagaagtgggcctcagaagtgccaggacatcatgaagggagataatcagctatgcctcccaggacaaagggagtgccctctactgagtggtagctacctcagcgaactggtctgtaagcctgggccagcttcaagacttgaggatgtccttgttcctccccaccaggtgatgactgttgggtaaatgctggggtgggggtgtgtggcattcactctgaggcctccttccattccctgggtgctcatggccctggctctccaaaggccccaacaacaaagagcaaaaaatacaagacacaaagtcagctaagatgagaaactaacattggtgggactgggaactgccagcttcctggcgtgtccagttgtgtgaccctgtcatccttccctgtctcttggatgtgagaactcttgttgtagcctgagtggggggcatcctgggaaacccacaagccagtgggcccagggctgctgtaggaaaaccttgctgtgtggcttcaacagtcacaagtctccaagtaccagcttgatggtagacaggaatgacgagctccctgttcaaggagctcagtctagctggaaacagaaaggtgaatgaacacatgggcagcaaggggttgccatgaactggaagtgtgctgagacctaagagtgaaaagaacacagtcaggggtgctatggggccagcaagaggacagtaaagcccaattcaagatgcaccgaggcaagcctctcacaagggaggatggtgatggtgaggggtagcaggcaccagcacccgccagggaacaccgagtgcaggcattctgttgggctgacagtctcttgagacccagctgaggcccagccccctgcccggcatcccacagacctacacctcactcctctggaggtctgggtctgaggtcatgcttctcagtttcagcacacctcactggtttcagacaagtatctcagctgtcaggctgtggaacacaggttttctcaatgacccgagaatttagaggctcagagagaaaaataaagtggctccttttccaagtaactttccagataatcccacttcttgggcccagccaaattaagagacccaattaagcaggtcccaatagctcctgaagaagtgagcaagggctggaagctttgtccctccccttccctgatggagaatttgctctctacctgctgatgcagagaaagtagagagaagtaagaaaaacaaagcctgaaatgccacaaacacaactgcccactgaagagaagcctgctctggaaccctccaccatcaactctgttgctcaaacagaaacacctctaccaagcactggcagagaggtgtccctcccaagggcaggcgaaacaggctgggccagaggcagcccacctacagcaccccccaccccttgcctgcactaggcccccttgagattgaggcctgtgtccactccagtccggcacctggagcccgtgtgtaggaagaaactctactgctgcagtgtctgtggtgtgacagacatccagtggccttggtaaactctacattcaggcaggcttactcccctctcagaaggagaaaaatgcaaaaaaaaaaaaaaaaaccacttaaaacccaaaaatctttgttggagaaaatctgcgaaaaggaggtggctccagggtgtcaggagaggacagaaaaaatgagacaaaaatgaggaaggaagggctagaacacatcagagggtgctttttcttttctttctcttagtaaagtagctcaaaacagtcacctttggtgctggaagagaatttgtttctgctgagttcttcctatgagagtagatgaagggcatgggtatcaatgtgagcagtgtgggcaaaagctgcgcccctgtcttctcaagagagtgggagagagggagcggtggaggagttgaaggcaccaatctgagggcgccactgccaccgggtggccctgaacaaaaactgcattgaaattaaaaagtctggccgggcacggtggctcacgcctgtaattccagcactttgggaggcccaggcaggcagatcatgaggtcagaagttcaagaccagcctgaccaatcggcaaaaccccctctctactaaaaaacaaaaattagctgggcgtggtggcgtgcgcctgtaatcccagctactcaggaggctgaggcaggagaactgcttgaaccaggaggcggaggttgcagtgagctgaggtcgtgccactgcactccagcctgggcgacagaaagagactccatctcaaaaaaaaaagaaagaaagaaagaaagaaattaaaaagcctgaactccttcaaggatgggaaatgcaaacatgaatgatgaaggggcaatgttgtttgtgaagaaggcacacagacaacaccaaagtgaagagagggcaacaattccccaagtcacagaaaataaaactaagaaacaggccaggtgccgtggctcatgcctgtaatcctggtagtatgggaggctgaagcaggtggatcacctaagcccaggagtttgagaccagcctgggcaatacagtgacatgccatctctaccaaaatacaaaaattagccaggcatggtggcacacgcttgctgtcctacctgagaggctcaattgagcacagcaggttgaggctacagtaagcagaatgacaccccgtttccaaaaataaataaataaaaaaaagtagaaataaaaagctccaagcctgagcatgcatttaaataacaagagccacatccacactagtaagaaagagaccaacaaacttcacaagggaagtgtttatcctacctcaagagtttgagcacatgtcctctgaacccaaggcagcccctgatccacagagaataggagagacagtgccttaggtccagtgggagcaggtacgggctgctatgctggggagtctaggacaacatgagaactagtgcagctgggaggcaggcaggcagtggggctctgcctggcaccgatccacaggtcaccaaaggctttccaagtcctcacttctgccctggaagcagatggctgcgacagccaggtgtgcagaagcccgctgaggcctacaatgagcacatcagcacctcatgatggctctgaccctgagaacagaagcaacccatggccttggggagaagatgctgggaatttttatgatcatttatctacagtcttaaagaatttaaaaaagaagatgagtctctaatcccagcactctgagagtccgaggcaggtggatcacttaagcccaggggttccagaccagcctgtgcaacatggcaaaacccatctctttaaaaaaaaaaaaaaaaaagaaaaaaaaaaagaaaataaacgaggcaaaattagctgggcatggtggtgcaagcctgtagtcctagatactcgggaggctgaggtgggaggatcgcttgaacctggaaggcagaggctgccgtgagctatgactgtgccactacactccagcctgggtgacagaacgagaccctgtctccaataattaaaacaaaaaaaatagaaaagatgatgatgatagtactaaatattgactttattctccaaaatttttaacccaatcttattattcaaagaaagtcattttttaaacttaggtatttttccttttttaaaaaaattaagtttacacatctatgctgtaacctcccctccccgcccacacgtgtacttcacactgtgcaccacccaggctctcaacttgaaggaagtgacccaggacccccaatcagaattgtggccatgtggaaacaaccactctgcagctagaaggctcttacggctctggtggagggatgtccacagtgcagatgtcctcagctcacgactgtgacagcgacttctcggcaagagtgccccccacccccaacccacttgagacaggtgtgttttgtagaagagactgggccatgcacagcacacacccggtcttccagccaaaagcaaatgagtgctggtggagggggcttgcagtggaacacccactctgctttaattgaataaccccaacttaaaatgtatgcactaggctgactttaggcacttttctaaagcaacatggcattatcccaaggaaagtgacagaaaaaaaaactctgccaaggcccacagaagtctgctcccacgaggacctcagcctgctctgctgagggtggctgcgccctcccaagcctcacctggagcttgcgggccatggccaccacctcatggtcaggagggttgtacttatagcagttggagaacatcaatcggacgtcagcaccaaactcctgagcatcacggtactcacgggcctccagtttagactggaaaacaagacaagtccctgttagctgtgtctgcccatgtgaccatggagaagtggctggcagcagacgaaagggatgcctagaagagcaagttggtttcttggctctcagtttggtcaagactctagtggggggacaggccatcaccccagttctcagcctcagggctgggactggccctgccaacatcccagctcacctgcctggctcgcaggcaggtggactcagaacccacaggaggcggagcctgagccagaaatgacggggagaactgatggagagggctgggcccagctcatcgtgatgacacagtacaggagctggtcaaagggacacagcactgttccctgctctgcctgccccatgcttgggactccactcccagaagaagaaacacgtaacaagtcttaaaactaaaaaagcctcaaaacactatggtgaaaatgtcggcacttacagcgtgcctccaacacagaggagacagcaaggccttctccaccacaaagaggctggcaaggccgccaagccccaactcccatggagcatctactgtgtgggcaaggtacctggggcactgggcccccaaggccagagggcttgtcttgcttttcctcagactaggggaaggggcagcacaggcatctgtagccacaatggccaagcaccaggtctcagagcacgtcccacagcagacagcagggggcgctgagtttcttcgagttggcgggaaaaatccacgcagccaccgttccagggcctgggcttcctcttggactaaaaggtctaggaaggttctgatgtggagggacagcctgcccaccttgtcccttccctcaggcacatcccgctaaccttgattgtgctcatgtccatggggtgcttgatgatgtcacagtagtcgtgtaggcccagtgcctccacgtccacaggcttgtagaagggccaggcgtaggcggcgtgcttcttggcaaacatctccttgaggatgccgctgcagcacttgagctgctccgagaccttgctgctcttctctggtgctgggtgctgctgagagtcgggcacgtccttctttggaggtttcacaggccggctgctctcccgccgctggcccagcttggtggtcttgggctccgggggcagcgagggtggctcgtgaatggggtcaatggtggtgggggtggtggtgtctgctttcctcttcactcccttctttgtctgccaagaacacggacgccaacaggcacagtcagaagtggcagccggcacagctgccctcagggtcacccccaaagccaggccctgtcttggggcccatcgctcacacagaatggacccaaagataattgcacaggcaaagggccaaggacaggcagatcgtgtcccaccactctgctctgcagctgggacaggacctgcctgtggcaggagaaagcataaaactgtgtgctcacttggaagccaagggacctctggaggctgcttagtacctaacaccagggcctctccccaagtgcccaggggaggcacaattcagagactatttagatggcccatctgcaaatatgcacagtctaaataaaagaggtgcagggggcaggaacccactaggaggtgtgacacaattatgggacctttgagtcagtggggcggctgtttctgggctgcaatttcaacacagcaagatctccccagaaacacccaccagtgcccgggacccaggacaggctctgtgtaaagcacgggcaaggacagggccgctctcctccctggtgaagcagccctccagagtccaggagactcaccttcacaggctgtggggtggccgcgatgatgggtgggtggctctgtacgggctggggagctggagcgggtgggggttgtggctgggggggcactggcgggggcgtctgcagtggctggggaggcaccactgtcatgacaggggtctggacgatgaggtccggggtgacggcagggaaggggtgaggcgtggcctgcacaggaggaggattcggctgaggggtctgggtctgcggaggagtcgatgcttgagttgtgtttggtaccgtggaaacgccaggttttgctgtccctacaaatcataataagacggcgagttagagaccatgctgacatccacatgctggctgacctcgtggggacatacaccacacacagtgaacgcacattcgcgtgttgcatttgcctgagagacgaacatcccagactccactctgccaaacccttccacctgtccctggggctcaaagaacagcagaaaaccgcacttcccatttcctagggcgtcctggctgcaactcccaactcaggcacaaagaccccttcatgaagcctggaggcccaggctcaaggagcaggaagcacatgctgacaggggacagagagcgggaaaacactcctcagagcttccaggcacagctgcccttgttcccagaagcactgccttctgagtaagagcttctggcagggagccggcagtagccgcccttgccaaggtttctggaaactggcaggcccccacctcctggaaccacagggggcagctggactgctgcccttcatgactggctcgagcgctgcctcccagcagctgtgcaggcagtccgaacacacaatggtcacgtggcacacccaaccagctgcaaaaagtgaggggttatggccagagctctaacaaaactgggtggaccagggtgagaatgtctaggagcataacctgggtcaccacatccttcgtgtgcatgctggctgccatgaaaatggacaaagacacccagtgccttcatctatcagctcaagcagcacccatgttccctgtgcatctcaaggagcaagggtgagattctgctgagtttcccaattctccttcctcaggcacaactcctgggcttctcccagactggaataggagatgccaccacgtctgtctgcccagcgtgcagcccaaacccctggtcccagggagtgaggaccaatatcctcatgtaaggataagggatgtgacttacatgaggatcaggaatgtgatctgataggtacaagagccacagggtgacacgtgagactagttctccttggttacctttgggtgcagcaggggatgtagcaaccccctttctgccaccacttcagaacagcatgggaggccaggtgaaaggctgctgctcagagaagcaaacaactcacactcagggaccacctcgcaaatgtcacccttctgcagcatggagttgcaaaggacaagatgtagccagtagctgctggagagtttcctagacagaatcatttcctagagtgggcagctctgccagctggcccctggaaccctgtgtcagttgggggtggtgacaggcagagatggatgaggagggctttcacttcagatgactgagcatcagaagcagggataactctgacaccagtgcattaaggtaattccaatcacaaacctcaaagtttagaactgagatgttagttaaaatgatttctggtcatgttaatgtccttaaaatggaaaagtaaaaaccacctatgatactggcagggtgaagtgttcaacaaacgtcaaagtgctttgagaagttacactttccttttaccctaagtccatcacctaccctcagaaaaggcagggcccaattatttctgcttagaagaggccacagggccacatgaccctatgggatggatccaacaccaaacccaatctcacatgtccaaacaccaacacggcatgcagtatataatgtcacatcctcctgccactcccagccccccaccaaacttggaaaagggacaaaggtcggggagaaagccaatttacttgctatttcagtactctacctgtttctttcctcccacgtcctcttccttttgcctggactatcatgatctcggtttcttctgtgggtagctcatttattttttgcaagaagagcttttccagagcttctgccattaagactatgtcatctccaggctggataaggagacacaggggtagagtcagagggccctcccctccccacctctgtagacagggcaccccatgccacccaccccctgcccccaaaacatgaagcgtcgtattccgggtccttccccgatctgcacccaaaggagccacaatggctacactaccaggtatcacagaggcttgtgttcccacaggtgtgctgagcctacacttgtctacctgcacctccctcatcttttaagctctggcctatctgagaagccatcctaatgccttaagcatctaccaagctcagccaatcactgaaaggggccctcctttgacacaattcaatttcaccagaaatacgtgaatgacacaggatttcttgccatgatacattagcagggccccagcaatgctccccaacgtacccccatggcagctcaccaggactctgggcactgcacatctcacactagttgaggggtcccactctgtcacctcatctataacatgctgttcccactcagttctaaactgagagcctggtctgcacattttgctcaaacctaagtggtgagagctgagactttaaaaaacacagtaaacttcaagaaactcacctacccatctcttctgggcatttttacccactacaccagcagaggtcaaaagctgagttctgtatagtgtctccctccagagtcgttctatttgaaagggttgattttaatcacatctgtggtctgaactgtaaacaaatgatctggcttcatggcacagccgagccgaaaggtttggctacggggttaggaagtgaccttcaggtctacatgtaggatcggggggacacttcatctatggccaagagttattgacagtcatgtccacagttccagcagaccatcacccacagagcaactgagctctgcgccggccccatcacaccctctctcacgtggaggtctctgtttgggcacacctctgcacaactacattttagcaggctctttcctaacaatttacatcacccaaatggactttgtcatgagtcgccactattctcctcacaccttctctactagacatgctcaggaaccaaaatcccaagggcaccagaagcacatgcttcaggctaacaaggacagcttgcaagttcaacatggccagcaccctcctcccagcaaaaaagcccacacccagtcacaggaacaaccacaggtctcattacctctacctccaagggtctcctcttgccagactccaagcccagccacacccaacacccctgcccacgggctcctgacatgcccactgccgtcgcctcccctcctctctccccagggcagctggacacccacccctacatctcaccttgttgtagatgtaacaatttgtaaacatagtgttgaagtcctggatacattcctgagcattccagtaatagttgttttccaagcgcttctttattgttcccatatccataggcgttttaatgatcttatagtaatcctggagagcagagagcaaaagtccagtgtcacctaggcagccaggcagcacaaacgctgggctggccaggctggcctggggacctcacccctggctgctccacaggtaaatccacgggagccacagctcctactggcatcagcaagtgatcttgagggggaacaccaaaataaagtggagcggggaagggttcctggatgctggggagtaattcagagggaaacgtacaagtttccaaccactctatcttgaaataggctgccttcattgaaatgcacattttttctttttatggatactaaaatattctttcacttttaataaataagggggaaaccaggcagccttttaaaaagcaatcctcacctagtaagacaacccatggcaggtcctacttgtcccatttgaaattttacatgtccataaaatgcaaattcccctggcgccaatgctggagtccacttgtaacccttgaccctggcactcctgcctccttgtcaccatgaagagctgcggagcataagtttccacccctagtcaaattcactggacttaacgtttctttcatttgcacacagtctaccactaaggattctttagtatccagatactgctgactgaccaggttaactgccaaatgacaaatctggacagccttcacaatccttagtttaaaaaaataaaaataaaaaatccaccatcccaaccctcaaactttcagatcttactaagtgccaaacagaaggagccagataacagatgtaaacgtcttaaagtgcccgaaatcaaaccacgttattctcacaacttcttctctaaatctaaacctattctaaaactaagttcatttttaaaaacaaccacagaaggaatgtgcggacagatcaagcagtgcctgggtttccaggtgtgaggatcacagagggccaggcagggggctgcacccagacagcaagtccccaatgactagaccagctcaggctgttggcctgacccaccgatagccaaactttctgagtcatcactctgactgaggacaggtgctcctgtaattaagttcaagtggtgtatcagaaccaaatccaagtggagtcccacggtagaggcacaggctgcaggtggagaggctgttgcagggagaagagagcaggtatactaacagcaagcactgaggccctgctcgggatggtagtggacagcgttggaaaggccagcacagggtatgggtgtggggtttttgagatgttctgacatccacgagaaagagtcaagggccacctgcttacatgtaaggttttggcacagctcatggaactgccctgggggtgagggctacaagtgcacacccaggcaccttaggcaagtggtcaagaggggagactggaagcagactatcggtgccactttctatgctctgacctcctttcccaagagaaccaagtctgaatagatctatcccagtggaaatttaaattttattctatggccaaaggccactgaattggccacagtgtgtcacatgtctcaatggccaacagaatagtgaagaggaattggggtgaaggcagagagaacggtgggggaagaggaactgccagcctggatagtacggtttggggccatgataggagatcaaaatgcgggtgaagacctagaaggcatcagaaaacagacaaggaatactttttagggtggccttattaacatctcctgaagaaggaagtccccagaatacagatttagcatgatgatgctcctgatcaagcatcccctttggctcagcccccaccaaatgccctgagaccactctcactcagcaagctccttcctcagctcctcactctcccatctctgaagacatcagatcagggccaccatggatcagtcccttcttcttatgtcagagctaatgagggcgacgtcaacagtcatagggacaggtagattcacactctgcctggaccaagaacgtcctggccactctccagcctgcacttcagagactgaccttgaactcccaaaccccatggcctaaccaatcacccatacttgtctgtcccgctggccagcactgttccctcaacctcaactgggatgctgctgcttctcggcaatctcaagtcccccagcccttccttctcctgtcttcaccttctcagccctccctgcttcagttcccactgcgttttcttgtaacaagctgacccctctgctattctggcactgatgcgtttcccttcaaagccaagcttcttgaaatggtggcttcacatcctcaccttctcattcacaccgtcgcaatctggtttctacttctgtgtcacgtcttcctaaggtcaccaatgccctcctaaaggtcaacaggatgatcaggtcggaatcctcatctctttgacctccctgtagcttctgatgttggaatctggggaaatgctctcttctgtaggccttctgccttccctccaacccctaagggcctcacaacgctctgggttccactccagtccccagttccttctctcctggttctgtgcatctgctctgagaatttcactctcaactatggaccctgtccagcccagctagagattggtgcagtgagctcccccaacagtctccctcccgcaggccaacacagctgactgcctccactcctcatcttggtcaatggagagcgtggcgcctcttctgcctccatacctttcctgagccatttcaagacccagacacgtactgccctgttctgattatcttcccccgagtgcttgacacgtattcagtgaagcaatagcaccagacagttcttacagacacaatgactttaaacttgggagtaaggatgcctggcagaggctaaggccgctcctacacaccagtggctctggtgtgcacacaccagtggctctggtgtgcacacaccagtctgggtcagtggctgcaaccacctaatgcacttgccagggggtgtacaggacttggcaaacagcaaaggacaatttaaagacaattagtctttggtgctttaaagaaaaaaaaactgaagcatttattccatctgctccctgaggttcagctggagatacaggtttgcttgcagaacagtttgctagggacatgggcatatggaaaactctccagggaaagagaagaggggcgggctcacaaaagcacaagagcaagtgtgctgtagccagagggagggagggcaacaccacctgtgcagctgcagccacagccacctttctccaactggggacgcctccatgtacttgcactccctgcgaggtaatcccactatctttccccaccgtgtgctccgggtgacagtgacgatgatgctaggtgaccactactgcagcaagccaattcccctctagcatagtttgatcaactacgtctacttatccttgatcaactatgtccacacctgagaaatgaaggggctaggatggccaagtgctctgacttcaactcaccatggaactggaagtagatctgtgggccttcctttctcccactgcttcaacctctacacaattttccccaggattccaatatctaagaaaccagttattgttaagccaattagctcattctttctccctgatttcaactgatcagaactgctgaaaccactcactcaagggccctgcagctctcaccatgattccaaatgcatctcctaccctccccccaggaactgccctgaccaggagacatgcaggagacgacctccaggacggccaccctgggccctgcccacactactcacagggaggttcagcttgacggcatccacaggctgctggaaaggccatgcaaactggtgtttccatagtgtcttgagcaccactctgagcaggtattgcagttggttggtctgcctcttgggcttgttagggttggaggtctctgggggcggggggttggtgctggctgcgttggctggctggggttgggcctgggcctgtgttgtagacatttgggaagtttctagtccatcccccattactggcagatttctcaatctcgtcccagggccgctctccgcagacatgctagtgatcccatcacattcttcaccaggcactctacaaaggaagagaagagcccccgtgagatatcagtcagcagatgggcaccgctcagaatgacaagtccctctggctgtggtctccaaggactgagttccctggcggtagctagccaagttggccagagggaccaccccatgctttgactgaaagggttccaatgtctcctctccccaaagacttaccctccagcagggaggagaccacaaaccaacagaggaggcagagtgaggtggtgagagcccactaggagccagcaaaggctctgggaactatgaaggtcatggggaaggatgtacaatgaagccacgtctcacaaacctgcacatcccttttcccacctgtgagtttttaggagatgctgcctgtgtgtggaaggggatgatgtgcaggctcccacatatgacatttacattaaaactccttgcatttatcacacacaaagcatcgagcaaagtcaatcatttcatttggtgggccaggcaaggagaagcaggaaggctgggtctgcccacccatggatggcccacccagtccactgccaagtgctcagggcaaagccacaaacctactaagaatattttcttggtaacttaaataatgcaggtctgctgaggaaagaatctgcatgtttactgccgataaaataaaaatgaatccatactagacctaccattttcttttttttttttttttttcatctctagtaataaacctaagaactcagtggagatatcattctgggatgaacttttagtgggttcagaagcagctttatgcctagcacacactaggcaccctagctgccagtgaattactttgtgtaatttatttaaaccaggattacacaaactttttttgtaaatgcagttctggcaaataatcctattttaaaagctccaaacggagaatttgctacataaagcaactccatggactaggctgtggagataggaggccagtgagataggagaagacacagggacaaatgacacaagccacatatcagcttgctgggaaccttgggtccagtgtaccagtcttggtccagacacagatagattacaggacacaccaagtgactggacacaagtattggtagaaggacagcatcacagacaaggaaacaagtcagtggggtttaaaccccactcacatgtggagtaggctggagagggcttccatgcagcaggaccagcaagtccaaagtgaccaatggggacaagtgtgatggggtcaaggggaggggaggcctaaaggcactgtggaagcctggatcccaagatggagggtacaaagagtgaggccaaggaatgccattcagtttggtttctatgattagatttctcctagaaagcagctccagaaacatatagctgatgctgcgcaccaagcacacgccaggtaagtgatggcaggcaggggcaggagcagcccagccacaaggacacaggcggccagggtgcagagccaagctgtcccaaaaggaagcagaccctataaattttccattaagtaatgacattctggaaatctctaagcaatgcccttgaggcaagatgaggccaaggacttctagaacttctgggctgggccatgcttgtctctttccaaaaagacttgcagcaaagccaagggacaaaaactcatgtgtgctctaggccagtgaccactcttcttcaccttctcaccaggcctagataggcccttgagccgaggaagctgaattttcctttttttttttttttggagacagggtctgtcgcccaggcagtgcagtggtgcaatcttggctcactgcaacctctgccttccagggtcaagtgattctcccacctcagcctccccagtagctaggattacaggcgtgtgccaccatggctggctaatatttgtatttttagtggagatggggtttcaccatgttggccaggctggtctcaaactcctgacctcaggtgatccacctgcctcggcctcccaaattgctggggttacaggcgtgagccaccatgcccggacagaagctgaattttctgttcacaagaggaaaaaaacagttttctacagaaaacctgactcttgaaccttgcctcatttggtgttttaagccattgcaaaagccaaaacacccctccctagccagccagctcacaagtgatgcacagtaacagttaaatcctcaaaaatgctaacattgcttctggcctcatccccactttacagatagggaaaccaaggcagagagaagtacctgacccaggagtggaaacaccaggtctaagcagatagagtggcccaaaacctggcatctgattcctgggcagttaagttggcctttgaattaaggaagtcctcattagtgagctgcacacacacacatcagaagtgtccaacacagatggtcgtgacacagtggccatccttaacacacacacacccaggcccctgaggaaagaaactgctggaggttgtctgttcaaatgtgaaggtatgacatgttcgacacataagacaaacctggtagctaccagtaccccaaagtttctttaaggaggctctgaagataaccaatgaaagtgacatctggccgggcacggtggctcacgtctgtaatcccagcacttcgggaggccaagaagggtgggtcacttgaggtcaggaattggagatgagcctggacaacatgatggaaccccatctctactaaaaagacaaaaaattagccgggcatggtggccagctactcgggaggccgaggccggagaactgccttgaacctgggaggcggaaactgcagtgagccatgattgtgccactgtactccagcctgggcaacaagagtaaaactccatctcaaaaaaagaaaaagaaaagaaaagaaagtgatatccatggccccacaagggagatcaccataagatacctgggactcctgcacccactctgggcctgtgcagcacctgcacctcaagggaccacactgacctactgctatgcccacagccttcccatgactacaggaaagtaagacccttgggaaacttcaagagcccactcttactgcaatgacaagaaacatgaggaaaaccaaccacttctagtctgttatggggcaagaaagagaggtacagtgagaagtcctatgtgagacccagatgacttttctaaggcccagatttgatatgaggtcagcctccttgggcgaattcttcccacagcggttccccccaaccccacactgccccaggcccctagcatctaggctctaacaacaagtcagccaaccctgtcaccttcagcctttgatctgctagccctactgccagacagatggatggatgcagacataggctcacagactctctctctctctctctctggcccatagcatctggtgcttccctcatctccatctactgagttccatggtcagccccctaggaacctgaaggcaggctcatctttatttcacttttatcttcccagcacacaggaggtgaacccttagtgaccatacccacattgtcatcctggggcttccagctcaatctcaaagctctggaaaagcaaaacagttcacactctcacatggataatgtggagaccaccagactcagtcactcgctcaggcaacaggtcctaacatgccttgccctaggactcagcggttgacatggcattctcccgagtgattaggcaatacatggggtgaatactgtggaggagaagggcagggctgctctggccatggacggggagagggatctgcactgacccgagggacaggcggcatctctgaagaagggacagagaatgagaccagaggcgggggaagagtgtgtgcgcttctgtggtgggggtcaggcaggcagtggcaagagaaggcatgcctggcatagataacaggagacaacatcttcaaagttttccgttgaaaagattaaaaactgctgctccctctccattttcatactgacctgtggccaaaaagcaggagccaccattcaccacgttaagagttagctgaaggtcaaggaaaaggaaaagaatttcgcttattgtttccaatccaaaggcggctacataatcgaacttgatgtcctacttttgtatctacttccaacagaaaccctatatcatgttcccagtgtagaagaaaaggatgaagcaaggttagacaatgctgtagttcccaaactgagtgcccaggtgccttggggatgtcatggtaaactcagatggcattgcaggaactatcagcacaaggcaattgatcatttcaacaccagattgcactatattcaacagtgtcacagcctgcaacacttgatcagcaagttgctgtaataaaacaaagattgtccaggcacagtggctcacgcctgtaatcccagcactttgggaggccatggcaggtggatcaccttaagtctggaatttgagaccagcctggccaacacagtgcaaccctatctctaccaaaaaaaaaaaaaaaaaaaaagtacccaggcatggtggtgtacacctgtggtcccagctactcaggaggctgaggcaggagaattacttaaacccaggaggtggaggttgcagtgagcagagatggcgccactatactccagcctgggcaacacagcaagactccgtctccaaaacaaaacaaaacaaaacaaaaagcaaaggtcatataaaaatcaacatgaacacctgtaatcccagcactttgggaggccgaggcaggcggatcacgaggtcaggagaccgagaccatcctggctaacacagtgaaaccccatctctactaaaaatacaaaaaattagccaggcatggcagcgggcgcctgtagtcccagctacttgggaggctgaggcaggagcatggtgtgaacctgggaggtggagcctgcagtgagccaagatagcacaactgcattccagcctgggagacagagcaagactccgtctcaaaaaaaaaaaaaaaaaaaaaaaaaaaaaaaaaaatcaaaatcaacatcaacaggagatgcaggtagtgacatccaacctggttctaaggtttgaggatttgtgcagcatccaacaggcagacacatcctattagaaagtaactatgggccaggcatggcgggccacacctgtaatcccagcactctgggaaaacgaggtaggcagatcacttgaggtcaggagttgcagaccagcctgccaatctggtgaaaccccatctctactaaaaatacagaaaaatcagccaggtatggtggcgcatgcttgtaatccagctactccagaggctgagacaggagaatcacttgaacccgggaggtggaggttgcagtgagcagagattgtgccactgtactccagcctgggcaacaaagcaagactctgcccaacccccgccaaaaaaaaaaaaaaaaaaaaagaaataactatggttatgtaagaataaaatatatattcctgtttttttttttcagacagctacacagttgttgagacattggtacttattctgctgcttgtgcttaaccacctaataaacaatattgttggctacttcctctggcctgaggcatcacagaaaaaactgagacgtttaaggatgttgtgaaccaagaaaatttgggaacttctgggttaatgaaaataaaaatgtaaattttccctctaaattcatagacctctgattaagcatgcctgttttcttttcttttttgagacggagttttgctcttgttgcccaggctggagtgcaatagcgtgatctcgactcactgtaacctccgcctcccaggttccagcaattctccggcctcagcctcctgagtagctggtattacaagcatgcgcctgcacgcctggctaattttgtatttttagtagagatggggtttctccatgttggtcaggctggtctcaaactcccaacatcagatgatccgcccacttcggccgcccaaagtgctgggattacaggcgtgagccaccgcacccggctaagcatgcctgttttcaaagatgttctttgcaatcataatatttaagtgaattttgggaaaatattagggatagacagtacttaacagagaacacaactgtaatgttttataactctgaacaggaaacaaactgtttccttggactaactttatttacaatctagtcaatagttcagacaaattagaaatctaacaaaagatatagaaaacaaaaaatccaaaaccagctcagaaagtttgaacactttctgcaatgatggagtccctacttgcaaagtggatggcagcaagccctcttcactggtatcctccatcaagtcatagttctctccatcgcccgtcccaattagctcctatccttcaaaggggctttcagggtctccagacaggctttgttctgaacccactcatcacaaagcagtctggccccaagcaacctgttcccagaccaggaaaggagattagaaagcaggatatagatagatacagacatgcagggcaggcttagttctgggactctaaaggcaagccagagaggaaaagagaaagaccacaaacaactgcccagaatctgctgattgctggagattcagttcccagttccgtccatcacaagtcactgagaaaaccaatgggttgggaccagctatactttgtatttgcagttctacctgaagtcctggcctcccagcggacctcttgaaacccagtaatcctgccttcattctgtctggtctgttcagactcacccctctcctaaagtgatggagcacacaggtagaaagacgccagggaaggcagaagcagtcgccaagacgatggctggttaaaccacacttagcagagctttatgcaagccatcatcacacagacctgcaccagggcctagaagagctccacaggaggtacctgccacttcttgagctgatgctgttatcgagcacttcatctgtattggcttagttatccacacaacaaccctaaaaagcaggctgcgactttatcatcttcatcatcatccccatggggacagaggcagagtggatggtggcctggttggctggacgtcatttggaacagtgtgtgcttcaagtcctctgctccacagctgtctccactcaccaagcacagtggcaacacccacaaggggcagaggcccagtcatcctacacgggtctttggcttggccagcagcaccacactttgctgtacccatcagtggcctgccttctctgcagaagcagctgggtgccatgtggcccataagctgggtcttaagtcagacttctagcagtagtattccaaagaat

SEQ ID NO: 2349 - DNA, 35596 bp, Homo sapiens
  source 1..35596: mol_type = genomic DNA
ttgatttcaaataagttttaataactttaccttctcattgagcacaatcacaagcttaaaatttgtgaaaaaccattaaattatctacatattctttttctcaaaccctctataaactaatgaaataagccatgtaaataatagtgaagtagagtcatttgggaaaatgcatgtatgtctctgacaccattttgaaaaggaataaaaacataaatgatttgtgattttggcaaacagtacaaatatattaatacatcttagagatgaaatcattatcagcattatctttactataagacatactaaggatattttaaataagacagaaatattttgcttttaagtttgagagaatcatgaaggaactgttcaatttcgtgtgttcatctgataagaggacagctaaatgtatcctccccatatttcctgtttctatttttaagaataccacaagcagctattctaacatgtctttcttacataagttgtccacaaatgcagcctggctaaaacagcctatctcgaattggttgcttgaaattctaggtgtaattggcaaaataacagtgactcaaaagaatatttgcacccccaaatctaaggagctaaaacttaatgccagtgttacttaagaaaatctctccaccacaaaacctcagttttgtctttttgtatatataccccacttgtattctaaactccataatttcacatattattttctttaatgacccatttactctagtattttgagcttcataagcaaactgaaaatataatgtcaatttgatcagtttctcgtgcaccatttctgttgtcacccaccccacctaacacacacacacacacacacacacacacacatcacattcctttgtgcagcagctcagctcacatatttgttgaaatggattttaacctttgctatccactttgtatgaagactattacattattcagtagcagcacctgagaattcgaatagcctcaaactgttgaataaaattataggctatttttgaaatagtttaactcaagtactttggaaagtccaaaaatctgaatccatcttttgctatactcttaagtggctgcaacctcagtattttaaaataaatgattagcaaactaaaatatgtcactacagatgatttgccctgattccttagtaagaagaacagcaagatgcagatgtggtgaatgaaagcaaattgacccctacagaccaattaaatattctgggttttcctccattccattaattgcactttaacttgctatcaagtcaagcatgaagcagtttaagctatcttcacttgcccagtgatacctattctgactaacttttaaactattcagatgcccataagtatattaattcagcagcattatgtcacattcctatccattagtctatgtgacccagtgagtctctactttcctcataaatgtgctatacgttgactgctccattaatacctatatttgcttatcaatctaacagagtagatataagcatttgtttgccaggtatgtggaacatctaccctatatccaattggtatattctatatttttattgcaccatttattattttcattttcttacatcaagcctaaaatgatttctcctttgcatttaagaaacaccattcttagactgacacagcaaaaatttcttattttggaagactgacttgaaatatacaatcattactgtatttatggttggttagtcaaattgggacattttgttttcaagagtgtgtagtgaactgatgcaggtaacacaaacctcttttccctacaagtctttccaatagcttcaaaggcaagatcgagtttgtatattgggtaaaatgtagctaagtttaaacgttctactattctgctactcatgatgtcaaccagttttggagagattttgttattcaaggctataatataaaaagctcccaaataagtttctgagagaaattttaatcatttatcctatggacccttaagacccaagcactaacatgaacatttctaaagtaaaaattctcaaattgagaaatattatttgacatcctgttgagcccagacaatgatgtcaacatgctgatcattcaatggtccctgttggagtcagaaacagacttaactcctcacacatatggatgcatattctgttggtgcttcttttacatttcttgccagtcttgagttcggtccaatgacagaatggttcagggaagcataaacaatgcctggtttgttttcttccaggcatggattagaataaacttcagacccttcctgcatcctgaaacaaaggtcagggtcattatcataaattccagtttctgatagcagtacttgggaattttgcctggtgcttgcttctgtttgctcactcttaaggtgagcatcaacctacaatagaaaaaaagatggttttaagtgacacttacggccatggtagtgcatattcattagcaaactatgaatgaaaagcttaaatggagtcatgtccattgtgagaaataatctactgttcctcacatactctgctgacatctacactttcagctaaatttcaattattaaaggatgaaaggcttgagaatcactatgtcacccctaaatagttattttgtgctttattactggtcacttttgaggtcacagaacattttttaatcccccttcaagataaaaagcatagcccaaattgatggaaaaagcaaaaaatatcctatgaaaacttcaggcagtttataacatgatgaatagtatttaatgcagtttagaataaaaagattaaggataaagcagaacaaataccccctaagagggcagaaacaataaatattatgagttagccaagatatattattataatttgagaccttaaattaaaaaattgatgtcagttttggaaagataaagcttagaaaaagttccaaaacagtattccagttgttattcctatcaaaagaaaattcttcttttttttttttttttttgagacggagtcttgcctatagcccaggctggagtgcagtggtgcgatctcggctcaccgcaagctccgcctcccggcttcacgccattctcctgcctcagcctcccgagtagctgggactacaggcgcccgccacctcgcccggctaatttttttttgtatttttagtagagacggggtttcaccattttagccaggatggtctcgatctcctgacctcgtgatccgcccgcctcggcctcccaaagtgcgaggattatagacgtgagccaccactcccggcaagaaaattcttaccgtttcaaatatagccaaatatcttagagcttctaagaaagaggtgaatttgtaaaaacaaaaagtaaaattagtcctgatgttttctcactcttcagttatttattagccgctcctacctatacaaaggttcacctgacaaagaagatgtgttcattctaggggctatttcagttttttaaattcaagttttgcccatcgatttccgttcttgacatctggcctaactcctttaaggtatcaagtccactgtctttgaaagtcaacatactttgtctggtcctttgtcatcctcattgtgatgtgtgcagtaggatgtctatggcagatttccttggcagagctctatcatgcaagcatgtctggctttaccctgagaagctatgtaagaattcctgatacagtgccaccctctgatgtggtggctgcccaaaaataacagtaaggctgagcgactgaaagaggcagaggctgcttggctaagataaaaagtactcccaactccactgaaaagagcctggttgaggtcagtaggtggcacactaaagaagactgtcaagtgaactgaaaaatagcctttagtcctcaatatatcaacaaagatcctgtgatacttttcaatctgtttaagcctgtcaattgggttccctgtctctcatcccaagaaatggctcatttccatgaaaaattttgttaaaatgaatggagcaaaagaaaatatagtgctctgcagcacccctgctgtggcaccccgtcaaagtggctgggtgccacaaggccaatgcaccacaatgtggtggatagagatgataaagccagaaacagcaatcccaccttacattcctatggcaggttacagtatacaaagcattttaaaatttgtatttatagtatatgtttagatgtaattcacatgccataaaattcacccttttaagtgtacaattcagtggtttttattaggcaagcactttataccctcaaaggaccgttttggattaagatcagagctttggcttttatatgtacctgttacatttgtaccagttcctttcctgtcatgtttataccagttcctttctgtactttgatttctccacagttcccaaactagttttatgttaagaaatatttagccccaagggtataatatggtatccttttgattattttctgaaatgctagacaactgaaatggggcaaaaatcttcaaattcctgttaatagcaaaaacgctttaaaacaaacttcccagacaattgcacatacagaaaatacccttttgaattaagcttcaaatcataatttatccagcctacccaggaagaacaatgtccacagcttaaccaacctgggttttacttgcacagtaaattatttagatttttatcttaaataatttcatagctccctggccttattgtaatcaagtgaaatttttattattatttactatagaaagaaaataatatttaagaaaatttccctatttgagggaacaaagccttagcaccctacacagtgcctactgatgctaatgaaaacttaatagaagtttgtcaagttgagtgtatttggtctggtttaaaattaagcagcttggtggggaatgttgaatgccatttaatattatatatagaattattggctgtatcgattttgtcttttgtggaatttttaagagggttactacttctttatcactattcctccttattgaaacacacacacacatcaagttcctttgcagtatctcatttatgactgtttagttttaattagagagcttcagaatgcttttccacaaatatattgcctcatcttgcattcttttttagttctaatatctccacaacattcaactcaaaagaaaagcctacatttacattccaaaccttataggaaagattgactccaaaattcccttcctttagtctgagtggtcccttccttgatgagcccatacacattgccagggacctctgtgtaataactaagccaaagatcatgtctctattttgctggtgctatttatgaagatatctaatcattttatgaggttatttgtgggttcattctttcatcagctccctactctcttccagaaagaccttaaggtgtttacataaaaaataaatgaatagcctgaagccacataacaggcaagagcagagtcaagtttgtatggttcagtctctgacttttctgtcttggatctagactgccttccatgaacttccaaagaaccacttattacgagacttgttaaccctaaagagtctttgctgcatagagagcagaatgcaaaattcacatttttaaaaatgggtctatgtatatatatatatatatatatatatatatatatatatatatagtacatagaataatgcctggcacatggtgttatataaattcattgaataaataaataaacacagtataacacaaattgcatttgtttcaacagctacatcaagcttaccaggttaatttcccttcctgctgtgtcagagagttcattttgctttcctggaagacaaaaagaaaaagaagtaatcaaaaggagtaaagaaagcagaagtaaaccaccttgccacccatgcttatcctgttgaatgccagggatagtgttgttagttttggcttgttaatttgctttgcctagcacacacttgtttgtgataattcacactgaccagctctctctctggttcatcacttttcagtccacatagccccatggcatatctaaaaggaaggggagggatctagtatatcacttggaagagactggaagtccttgctctggggacattccatactcaatgccagaaatgctgctgtcctgtcacctatgtagccaagatctcctactacctagttcactttggatgtggtaaatcaaaagatttatccctgactccttttctgaagttctgagagaggttccagcagtctcaagaaagatgatgaaagatacagagaggccatagaaagagccatggagttgcagatgaagaattggggtaagagagaattcttcagaatccagagaaggttctgaactccagaagttctcactccaaaataccagaagcacttttgcccagtcaaaggttattcctgtgtcacacagaataagtgttgctctatctagctcagtttctatagctacactgtagctggtgttgtgaaaacaggaatgtgagaggatggaggagaagaaaaaggaaagagaaaactgaagtagttcaggccaaagctagatcagaattctctatgctttcctctcttacttaacatatttggtcatgacattgagagagttcttgcaaaagtagaaaggaattattttcaaaatatcacaccattcccatcatagccaaacccacatttttcatatgcattattgttgggtaagaattcaggtcaagcatatgtttataatggcaatagaaaatacagacatattaattttctctggggacattggttcttcagttacataagggtgtgtgtgggattggcatgatgtggtgtggctgtgaaaagaggataatacaaaataaagcagatatcttgatctgagagattgtttcaacttccaatcctgttaaggtttagaagagctctttctcacacaaacctaagattgatgcaaagagaatgatgaagtctcagcaatgtgctatgctcgccacaactctagctggaatactgtgcgtggtgagcatgcctctcccgtgactcaagggagccccaaccaacctatttagctttttagcgcaaatatgagttgtcttctaggaaatcattatccatggtttacaggattgggaaagaaaacaacaggaagaaactaaaaatcctttagccccagaaataagaatggccccaaatgtgtggtactgggggcagagggaaaatagaacccaccttggtgccttctcaggcagcagaacaggcagaaacaggtagtgatgagtagaggcaatccccccaaaggaagtaaacgatacaggagccagggtctgcttgccatttcgtccttggagggtcgttctgaggcactttttacatctggaatgttagtaaatgctaaagagagttaggaaatctgagatatattgggatcagcggcacccctctgcattgtcagaacttgagtgaaggagatttcaggccaatgcctccatttccccttcagaggcattcctcaagaatcccagtgccctcagccacctcttgctttcttgctgagcagacgtggctctgcgataatttatcttttgcagaaattctttattctgatagagttaatcttccacagaacaatcttcatgataactgtcagaaggtacttcattaagcctttctatttacagtatctaactctcatattcatcacttaagtaggaaaaccattgtctttattttgtcccaagagttgctccaagtcagatagctagtgagtggcaatgggaactcaagccaacatgtttgtaacaggaaattcaagtttcttcaacacaatgtcctttccttgtctcgtaacttatcagaatctccaaatatcaaatacttttgatagccttaaaagtgctctgcatggcacacagctaatgcgcattactattgatcaatgttaatacgcattgaggccctgtttgtctgcagttgttcacagctcattagcaggttgtgaaacaatttagtatgtcacaaatagcattttaaaaaatgaaacagaagaggatagaaatcatcagaatgcatcacacacactagagcagtggttctcaagcagggaacatgtgtggcaatgtctggagacatttttggctgtaacaaggtagggggagggaggctggcaaccagtgagtagaagccggggattctgctaaacaccctacactatacaggatgcaacccccacttagtgcaacaaaacattatccagaccaaagtgtcaatggagaaactctgtcttatggttaagtatgaccttatgaaacttttttatatttgtgtgcattatgggttgtgatgtaagatctggttgttgttgttgttgttgttttttttaattttgggttacagttaacacagtatgaaaaatactggagtaagatattctaaggtctggcctggtggctcacacctgtaatctcagcactttgggaggccgaggtaggcggatcacttgagatcaggagttcgagaccagcatggccaaaatggtgaaaccccgtctctactaaaaatacaaaaattagctgggcgtggtatgcacctgtaatcccaggtacatgggaggctgagacaggagaatcgcttgaactcggtaggtggagacttcggtgaaccgagatggtaccactgcactcagcctgggtgacagagtaagactccatctcaaacaaaaaaaaaattctattaattatattataatgttattttgtttggctagatgcttaggtttggggtaaaaatgattagaggcaactgaagttgcacaaaaagtggtttggttattcagagtggtaacaaatgttgtctattgatgttgcagctgctgtttaggttagcgagcagccaaaccactgccaggagtgccagaaacagctgcctgggggagggtcttggatagcaatggggactaaggtttctacaacagataccctaatacaaacagatctgctggatcaagaagatccaacttctgttatttctttaaccaccaaaaaaacctaatttccttaattttacttgattagtttgatcaaataaaactaattcagaacaaactgtttctctatttcagaacaaactcaaaactccccctaacttattttgagtttgttctgaaatagagaaacaaggtaaataactgaaattgattgagaaaatgatgagggtgtactctcacgtgtccaaaaccagagctagccttggggaggattccagtgtttgcacactaccagagaatccaacaatctatctcaagatcagtaagcacaatttgtggaacatcaaccccacgatcattgacacaaagtaaatatctgggcttattttgaagctcactgaaagactgtaaatacaacgcaatctttgtctgtctgctttgatcacctcttccccattccttaagcataaggacacagtatagtctgcacaatgatatctctggcacctggaataagaagaggcacattcagcaggtgctccaaatcagggtggaagcccacaaggacttcctgccctctcactccacacccactttcctgccacagataatgatcacattttggggaagttctttttttcttcttctttttttttttttttttttttgagatggagtctcgctctatcacccaggctggagtgcagtggtgcaatctcggttcactgcagcctccacctcctgggttcaagtgattctcctgcttcagcctcctgagtagttgggattacaggcgcctcccaccgtgcccagtttattttttgtatttttagtagagatagggtttcaccatgttgaccaggctgatctcaaactcctgacctcaagtgatttgttcgtcttggcctcccaaagtgctaggattacagatgtgagccaccacgcccagccttggggaagttcttaatctgaaactgaccaagggaagtttgggaagggtgaagtggcaggccaatggatgtttcaagggctgttccccagctctgtcaacttttcccctaggactttggcttgttgtgcaaggtgcttttcttcattctgggagaatagtgctttcccaagagcatccaagccccaactctgtcacagtcctgttcttacatgaacttttaacttgaacataaacagcaaaagaaagtcacttataaaaacaagaaaatgtccaaaatcacttcggaaatatatttcacaggaaaaaataaaatattttttatcagacctccaaaatttctttatgaaaagcatggtccttaaacatatttccaaaatatatttttctcctcaccttatacttagttcactgagcactttcaggttcagaaggaaaaggaatttttctttgaccctccctgttatttttgttttcaccacttcactaaagaaaaatgcacacctagattaaattagttttaaatccacacagagtttaaattaaagttaattcctaaacaatttaccttttgtgaaggaagttaaaagaaaaaaaaaaaagaaatattacacaaattccagccttccaggacattataatctttcatgggacctaaaagacatttccacacattactacagtgaaaggaaatgataaatgagaggcacagacttaaatggcataaaaattggtaaaaaggagtgatcccttcccctcaggtgatcatgaaaagcttccttaagaacttggaaaattagctgagattgaaaggaggggtagaatttccataggtggagacagatgaatgggtgctctacaagtggcaagagcagcatacacagggcaatgatggagatgtggttatggcaagtaaggccgtcaggctgcaattgagaggctgtatatggaatccagaaacaatctagaaaggtggtgggatcaaactgtggaagactttgaatgctggttaacaaagatgagcccaatattgtgaccactggggatgctatgcaagagagtgttgttatgaaggaagtgtatgaggtaatttaagtgtatttggctgaaattgaccaaaatggggaaatactaaagacaaagagtccaatcatagaattaattggaattatttagaaggaagataatgatggtgcgagatgcttatagaagcaattggaggaaacacatcacagagtggaatgttgtggagagacaagagtaggaagccaaagaaaattctctgggattttccatgaggatcaagagcattaattaacaaactgataaggaagggagtgataggaaggataggtgagtaggaaactaagagagtagaaatgttcaaaaagaaactgacaaggcccttcatgtctcctatttagctcttagactttctctttcaccacttcatacttcacatactttgttccataaaaccccccaaggcacaggatttaggagggaatgttattccctttcccctaaagttgggttctttcctccacaaaatagatagattgttgatcctaatctcagccccaacttgatccctagaacaggcacctttatgcactttacaaactacagattatctttagtcatcatgaatgacccaaatatgggatagagcagaaattgcaatgctacttttgtgtaacagacttttgtatcacaattaattattaacttctgacctttcatctgaccttggctaaattcatgtctcgtatagaagtagattagttcccataaagaaagactgaattacacaaggcttctcttccaaggaaggtggactcaatgcctcaaaatttaattttattatacattatgttaatatattatataaattagttaatagcacttatttattcaatagtatatatcattctagaattaatattttgcagattttccttatttttgtaatttattttacctgtttaaaaaatagtatttgttaaaaattcaatattttgtctcattaatgtgaattaataatgcaattctttccagaaagtgttcattccatacatccttaatatagccttctccaggttgatgaagacaatttttgtgctttgcatatactatgttctttaattcatttacaaagaaatatttagtgagcccctaccatgtgccaggtaccctgccatccatcatacagagcaaagatgtttaagacacagcttccatcctgaagaggtttataagccagtgcatggatggtcacaagtaactagcaccgagcttcacgctatatttgcaaaagcagagtccctaactctgccatcgatttcttctatatttcataattgagggttgtagctactgctaaactgctatgcattttttcatggtgctgctgtaagaaattttaaactaacctaaagcattttaaaagaatttcaatggattccttcactgggctactttaagggagttgaaagacactcaaaagtaagcatataaagtaacaaattaattttaaaaagatcagttgtaaaatgtatgcattcaagtgaatgatgtccataaaggaactaaactgtacgaggttgcatccagagttcagccatgctgctattgcaataaccctcttttgaaatttctccttcccagtaactttaagggtcaatttatgagcaacaaaagaaactccacattatttcttataattaaagggcactcttctttgatccaaatatatttttattgtggtaaaatacatataacataaaagttaccaatttaatcatttaaaatgtacaattaaatggcatgtaagatactcacaatgttttgcaaacgtgactacgatctagattcagaacatatttatcaccccaaaaggaagccctctacctatttagtagtcatgtcacattctttatttcctcagcccctggcaaccaccaagctactttctgtctctatggatttgcctattttggatatttcatataatcagaatcacattgtatgtaacctttttcttcttttacttagcgtaatgcttctgaggttcatcaatgttgtagcatacattagtacttcattccttttcatgactgaataatattccgtgtgtggataaactacatttcctttatccattcatcagctgaacatttaggttgtttctaccttttggctattgtgaatagtgctgtgataaacattcaggaacaaggttttgtgtgaacatatattttaatttcatttgagtatttacctaggaatagaattactgggtactgtgacaagtaggttttatcttttgattttgaggaactgttagaccactttctaaagtgactgcaccattttacattctcctcagcaatggatagggtttctatttcttcacatccttgctaacacttattattttctgtgttttttttttttattctagtcattcgatgggtgtgaagtgggttttcactgtgactttgatttgcatttctccagtaactaatgacattgagcatttttttcatatgtttattggccatttgtatattttctttgatgaaatgtctattcaagtcctttgctcattttaaaattaggttgccagtctatttgttgttgaattttagtatcttttgatgcacagaagtgtttaatttttatgaagtccaatttatctatttttggtgttattgttgattatgcttttgtaatcatagctaagaaaacactgctaaatccaagatcagaaacatttatccctatgttttctcctaagaaatcagagttttattgttttatataatgcagtttttatagttttagctcttctacttaaatgtctgacttattttgattgcttaaaatatggagtgagatgagggttcaaattaattcttttacatatgaatatccaattatcctggcaccatttattgagactattctttccccactgaataatcttggtacccttatcaaaaatcaattgactacggatgtatggagtttattctggactctcaattctatttacattgatctctttgtctatccatgacaatactattctttttttttttttttaactgtcattttgtagtaagttttgaaatagggaagtcttagcttcagttttgttctttttcaagattgttttggcaattctgggtctgttgcaactcaatgtgaattttaggatcagcttttttatttctgcaatagcaacaaaaagctgttaggattttagtggaactgcattgaatctgtagatcaccttggggaatattgctatctttacaatattacatctttcagtccatgaatacagaatgtctttgcatttatttacatattcttgaatttctttcagccatgctttctttgttcagtgtacaactcttatacctctttggttaaatttgtacttaaatattttattcattttgatgctattgtaaatggaactgtttccttaattttctttgtggattgtttattgctagtgtatagaaatatcactgatttttgtgtgttgatcctgtatcatgtggaattgctaaattcatgtattagctttaatagttttaaacaaatttttaagaatttttctacacataagttcatgccatctgtgaataaagttttacttctttttttctaagttagatatcttttatttcttgttcttgcctgtttgctctggctagaattttcagtttaatgttaaatggaaatggcaaaagcaaggatccatgtcttgttcctgttcttagggggaaagctctaagcctttcaccattgaatatgatgttggctataaaatttttataaaccaagtattttttactcttacctactccccccctatgtattttttcatgttttattcagcttggtttccccaagcttaacttctatctgtccttcctcagttgtcaaagcatattaaaggcctctttcggggaacagggaagagagatgaagctctgaatattcccagaaaatcactaggaagtcagttagttgtttgctgtttttcctctaaacaaactgtgaactattaagaagtgtttaattgcctaagcaccacaaacataacttcaagaaattgtaatgaacaaaagtaaagaagagaaaaatgggaaaaagagaaaaaaaaaacaacaaagaaggacaagcaatcacagagctattcgcaactataggtattcactttataattttttcaatatttcagtggtctacttttggacttatcaaataaattttataatccctaaagtcaaaaacaataacttttactatctatttctctactctcctctatctcactcacctcaaacgcacacatacacacacatatgtacacactggcacataacaatctgtgaggtgtagcagatttcagatgtgctataggagttggctttctaacataatcacttgagaaactgaacccccctcttcctggaaacattataagaaaaatatcagatggtctaggtgttgagaactcacctgtcacataaagagttgttgagtggctttcaatgagattagactgaaaatttgcagaacagcggtatgacccattgtcattaggaagcactggttcaaaatgtagaatgaaaaatgaaatgttcttctcttccttccaacttgtttgtctatcttcaagttttacacatgttgttccattgagcttgcaccaagtcacatgaggcctgttagcacagtatttcacagggcattctagttcaaagggatctcctgctaagatggagtgttcagattgtctctttatataaagctgtacatcacatgattctttccctaaaagataaaaacaaaactaaaatcaaatatgttcttctggaagtaccatatatatgtgacttcaatagttctcaagcattatttggtaattttcaaaaacaaccccccaatttctagtaattaagccttactagcagaatgtctcatacatattaggcatataataaatatgtttaaaaaatgaaataaatcatttaatcctctgtctgtcaggcctttgagcccaagctaagccatcatataccctgtgacctgcacgtatacatccagatggcctgaagcaactgaagatccacaaaagaagtgaaaatagccttaactgatgacattccaccattgtgatttgtttcttccccaccctaactgatcaatgtactttgtaatctcccccacccttaagaagtttctttgtaattctccccacccttgagaatgtattttgtgagatccaccccctgcccccaaaacattgctcttaactccactgcctatcccaaaacctataagtactaatgataatctcaccatcatttgctgactctctttttggactcagcccgcctgcaaggtgaaataaacagccttgttgctcacacaaagcctgtttggtggtctctacacacggacacatgagacactgtcttagtctgttttctgctagtataacagaatacctgagattggataatttttgaatcacagaagttttatttggctcatggctctgtaggctgggaagtccaagagcatggtgccagcatctagcaaaggcctttgtgctgcattatctcatggcagaaagcagaaagtggaagggagcacacaagacagagaaaaatgggggccaaaatttatccttttatcaggtgcctactcccgtgataacgaatccattcctacaataagggcattaatacattcataacctctgatctcttaaaggttccacctcacaaaactgttacaatagcaataaaatttcaacatgaattttggagggggcattcaaaccatagcattctgcccctggtcccccaaaactcatgttcttttcacatacaaaatacattcattccatctcaatagccccaaaagttttaatttattgcagaatcaattcaaaacactaaattcagagtcttatctaaaccagatatgggtaagattcaaggcacgattcattatgaagcaaattccctccaactatgatcatgtaaatcaaaacaagttatctacttccaaaatatagtggtaggacagatataagatagatattcccattccaaaagggagaaataggcaaaaatgagaaagtaacagttcctaagtaagtccaaaacccaacagagaaataaaatggcattgctgggcttggttgatgcttcagcactcacaagttggagactcctacctgcagctctcccaggctaatgcttcaggctaatagctccacagttctggggtctcagtggcagtccactcccatggctctactaggcactgacatgggagtggactcttcctgggccctcaggctgtccacaacatcctttgaaatctacatggaggaagttgtgttccacacctcttgcattctgctagcctgcacacttagcaagtgggtgccaccaaggcttaccaattgcaccttatggagtggtgggttgaactgcacctgggctcacttgagccatggctggagcagctaaggagcactgtgctggaattcagagaacagaaacctgaggcagatctgggcagcaagcctgtaaagggcattctagtttcccctgaaatcaatttgccctctgagctctgagcctatgatgggaggggcagcctcaaaggctttgaaatgccttcagggcctttttctcaacttcttgaatagtacttcactcccttctatccatattaatctctttaacaatggtcactaggccacacccttagtattttctcccattcatgccttttcactttttatatggctaggcagtgaattttccaaatctttctattctgcttctcttttaattataaattccatttttaagtcatttttttccctcctgcctcttactgtatgcagttaaaagtagccacacagcagcctaaatgctttgcggcttagatatttcttccaccagatatcctgaattattgctcttaatttctgctttccgtaaagtcctaagacatagatacatttccaccaagttcttagcaactgtatgacaagaatggcctttactccagtttccaatggcttgtttctcatttccttttagttatgcacttggtgttgatttgtatttttttattttccagtaaagttaaggctaagcacgtgatcctaaaagtattttcttttaaattatttttttctccactcttacagttctttcttagcctttctttctatgttttgaactaccgtctctcttagcaatgtctagttcatctccttcatttatttatttcactcattttcatgcattcttctgaatagatgtacagtatcatacattagaatgacataagtgtaacagagatgatagccaaaactctcttttaaatacaaagacagctaaaggccttgcctgtgatcacacagcttgtcagatgttgaaccaaggagcaaattttgaccctgagtttctcatacatgtctatccagaacaaggtttcaccttatttctacacccttgccagcataaatattctcattttatctatttcctcacacctaatacacctttcactcacatcctacttaaaaacccttcctgctcacatctcatgaatctctgctcagaataatagaaacctgattgagtttccaggaatcagagtgagaaaaaggacctgcagacaacttttagaacctcttaatatttatttatttataattgctttgagacctcaagcaagttcactttaagacttcttaattcagttgcttccaaaagtttagaactaaaatgaaaccaaactgaaaggtaagttataaggatgaggttttcaaaaaaatgaagagaaagggtaaaatattttaccaaaaggaagtgtacctgaatgtggttagacttaggacaaaaaaagtaagaaggccagaggcagaaaggtcaagtgaaactcttgtttccagaagtccgttcctctccctgaagttaatagactccctcagcctcctaacttcccttttcattttcttggataagtcaataatggtttatggagcctctaagtctgtgctagaattataaaaaacaatgagatggttatagacaaagatcttttaccctcaaagagtttaccatttaattggtaagccccaggagtatctaacaaagagggcacctttcttttttttttttttttttttttttgagacaagagtttcactcttgttgcacaggctggaatgcaatggcatgatctcggctcaccgtaacctctgcctcccgggtttaagcgattctcctgcctcagcctcccgggtaactgggattacaggcgcccaccaccacgcccagctgattttgtatttttagtaaagacgggatttctttatgttggtcaggctggtcttgaactcccaacctgaggtgatcagctcatctcggcctcccaaagtgctgggattacaggcttgagccaccacacctggccagaatcaatttaccttctagacacttttctagaatcaatttactatataccagtctttatttctttcagtttactgagctgaaagcaagccttgagggacgttgcatgctggttgttaggaagcctaggaataaatcagataggatgtctgcatttgtggagcttgccttctaatgggaaataaaaatgaatggcaattgggagagtgttatataacactgtaaagaggtacaaacaaggccgggcatggtggctcacgcctgtaatcccagcactttgggaggccgagggaggtggatcacctgaggtcaggagtttaagaccagcctgaccaacatggtgaaacaccgtctttactaaaaatacaaaaattagccaggtgtggtggtgcgtgcctgtaatcccagctactcaagaggctgaggcaggagaattgcttgaacccaggaactggaggttccagtgagctgagatcatgccactgcactccagcctgggcaacacagtaagactctgtctcaaaaaaaaaaaaaaagatacaaacaactttgcatgggtctgcagaaggttaacttcagccggggcaaagcttcatggaaaggctatacttgagctgaaccttggtgaatgagtagccctttggcaatcagagcagtgcatgggacagaggaggtattttaagagtgaggaaatggaacggaaaagtcttagggaccaggaatctcatgatagatttagatcattgatacacaactggatcatggttttctgacttagtgatatggagaccactggttgtttcagaacaaatggaataagcattaggcaggagtttaaactttgcttatccaccatgagaaaatacaatgcctaattttggggggatatttataaagggcacggaaatagctacaaatgagactattcatttgaacatgtctgtttcaaatgctaacacattgagcgaatttgatagtcccccagttttgctggtcctcagtttcttcaaaataagatgaaaggattgaactgtaaaagtaggaaagttctaactcaccatcccctgaccacacaaacacacacaacttcaccttccttaatgtgtgactgaaactacgaaaccacttctagcctgcaatttctattcctatcacaatatattacctttctatttagccatagggctatcacttgatgttagtggcacaattagacatcacttcaagttctgtcttttgtgactgtatgctccggagcagtgcgcaaagtgggttaggggtggagaaaagagctagctttttgtgttggtggcatcactgattcacaataggattatggaaacattgcagttcctaaatattcttatcagcaggataatgatcattgacaaccacactgactggcacaggaatttttcttgaatggaggaatgaaccgatgatgaatgtaggcttgcaagcaggcattagaaatcaagagtactccctctgtgcacaaacaaggtattataatacctcctatctctcagaggctaacactgatgtttgtagtgtaaaaatgacacactgagacaaatagcacaattctattttttttaattaatttattttttttgagatgaagtctcgctcttgttgcccaggctggagtacagtgatgcaatttcggctcactgcagcctccgcctcccaggttcaagcgattctcctgcctcagcctccccggtggctgggattacaggcacccacaaccacgcccggctaatttttgtatttttagtagggacggggtttcgccatgttagccaggctgatctcgaactcctgacctcaggtgatccacccgcctctgcctcacaaagtgctgggattacaggagtgagccaccggcctggccgacaaatagcacaattctaattgtccatctgacaagcttgttaacaccccttttctgcctgttctgaattatgcatatccatcttatgatacttaggacacacaaagctatcccccaaaagtttgtcttatcaaataaatatttcccgaagaggaataactatcacagttgcttttggctgttactcaacttccaattatcagttatttgatttcattttttatttatgtattttttgagacggagttttgctcttgttgcccaggctggagtgcaatggagcgatctcggttcactgcaacctccatccccgggttcaagcgattctcctgcctcagcctcccaagtagccggaaccatcagttatttttattcctgctcttattatctctgctgtttttctcaagcattcatatctgatgacaggaaattttcaatgctaaaaatgattaaaataaatacatgcagtaaaagaataaaaacttctggccgggcacggtggctcacgcctgtggtcccagcactttgggaggccgaggcgagtggatcacgaggtcaggagatagagaccatcccggctaacacggtgaaaccccgtctctactaaaaatacaaaacaaaaaattagccgggcgtggtggcgggagcctgtagtcccagctgctcggcagactgaggcaggagaatggcgtgaacccgcgaggcggagcttccaatgagcctagatcgcgccactgcactccagcctgggtgacagagcgagagtccatctcaaaaaacaaaccaacaaacaaagaataaaaacttctactcccccccaggctcttatataatgaaatatcccttgttaagtcactataggtttagaaattctttcatgtttaaaatttttatcaaaaccactagtggtatatatattccacgatcaggtggtaccgatgatattttattttaggtctagagtacatcatttgagcaacccctttctctatacataaaaatattttcagaaataatcatgagataaaacaagtaataaaatggccagaaaagaaatatagacaatgaatattttcttgtgctgaacttcatgtataaaaccatacaaatgaaaaaatgttttaaaaaaattaaaatacaaaaaaagaaaaatgcacaggtatttattcaatcatttttatatccacctaaacagtatgaactttgattctttagttatagtctgatataatagtttatgtaaatagttgtccaataactaataaatggattgtattaaaactgaaattctgcaaagatacaatttaggtaactactaaattgtaacactaaagttttattttctaaagttagttttaaaacaacattaaaaaaatttcaattgtaaaaatattaatcaatctaacattttatgcatgaaataaagttgccaagccgaagattttatatatcacagtttgtatccttttcactgttttaaattttaaacacaaataaaaattcaagaagtttgcaccaaatgacaaaaatgaaacagctcctgttctgcttctttgtctcagcattctctgtggtattattgtttatttaaaattgaatgttgaaaggctggagtatgtagtaccacagagatgaggacacaaagtgtccttggaggaaactggagtgatcctggactttataaatttgctatcaaaatgaacacaagtagctgaatggtatatgtccaaggccagctgtataactgggaagttctctgagttaacttgcaagtagaatgcaatgtttgtcaaatgatatatactacaaatgtgctaatttgaagtttacatatatatcataaaactcaacagtaaccatagtatttagaacttagaccaaaaatattttgaagggtaaatatttcacctctgacattgttcatgtttgctagtatgtggtgataattaaaaggaaaccggccgggcgtggtgactcatgcctgtaatcccagcactttgggaggccagggcgggcggatcaccagaggtcgggagtttgagaccagcctaaccaacatggagaaaccctgtctctattaaaaaatacaaaattagctgggtatggtggcgcatgcctgtaatcccagctactcaggaggctgaggcaggagaatagcttgaacccaggaggcggaggttgcggtgagctgagatcgtgccattgcactccagcctgggcaacaagagcgaaaatctgtgtcaaaaaaaaaaaaaggaaatcaacttttagttgtttttaaattcaatacagacaatggagccacttgttcacacccaggagtctggatatcccactgtccttgacacattagtaacgagacagtttctagcacaaagaagaggctgaaagtcttacaccacttttcaattttgccattagatttttgttgtattattttggatatgatataatctctcagagctttcagatccctcaagaggaagacagtctttctggctgggtcaatcaggaaaggcttcatgggggaagataaatctctttcttcctccaagccaacccccaggcaaatttggtcctcctctcattatcacagtataataccatcatctacctaatcacattagccagaacctggggagccatcttagtctccttccttgtcaccgtcccattccatcagccatgaagttcaattgattcaggatggaaaatgtcttccatatttgtttccatgacactgccttaatttggatctcattctgtttcatgtggattattgtcacagcgtaccaaatggtcttctacattccaaacttggccttgtttccctccctccacctcaattctccacatcactgtcacagtttccgttttcttttttctttttttttttttttttgagacagagtctcgctctgtcgcccaggctggagtgcagtggcgcaatctccgctcactgcaagcctcccgggttcacgccattctcctgcctcagcctcctgagtagctgggactataggtgcccaccaccacgcccggctaattttttgtatttttagtagagacggggttttacccggttaaccaggatggtctcgatctcctgacctcgtgatccgcccgcctcgggctcccaaagtgctgggattacaggcgtgagccaccgcactgggcctagcccagtaagtttatgcaaacttaccataccctcatatccccactccctagcaaatgtctgatgctattttgtgtgagatgcatcactccttttttgttgttgttgttgagacggagtctcgctctgtcacccaggctggagtgcagtggcgcgatcttagctcactgcaacctccacccaccgggttcaagcaattctgctgcctcagcctctggagcagctgggaatacaggcacctgccactgcgcccggggaatttttatatttttagtagagatggggattcaccatgttggccaggctggtcttgaactcctgaccttgtgatccacccgccttggcctcccaaagtgctagtattacaggcatgagccaccgcacccagccgacatgcatcactctttataactacatatgtgttcatgtttctgtcttctatctagtctgctacttccttgatggtgtgttacctttctatgtagtactggttgcacagcagagacagctaagcccttagagaggtgggctaaaaggcactgaggtgaagaacatatgcagctcaacataccttacagtggttaagttataactaccaaagaaaagctagactttacaagtattcagtttgaaaaggcctgatttatgtccactcaggggtggatattaaaaatatttaacaagtgacactccatggccatccagctacacagatcagctgatcagaaaggagtgccagccacaaacaactgtatagtctcgtaactcccagctgagcaagtgtagttgctgagctgaagagagtaggtaatttttgaaaccaatcagccatttaaaaaaaaagagggttatgattatgaatattttataaaatatcattatttcttatttttaaataccatatgttttgattataaccattatcatgaggaaaatctcacctgagtttcactatgtctccattgaaaaattcttacaaatttatggaaacttcaaagtggttgcaaccattcaaataaatgaatgactgtaatgaatgcagattgccttaacttgagctaagaaagtgtcagagtttaacatagaaattaaacaaatgattttttgagaaactaaaatgattactaacggtataataaaccaataattttctgtgacatcaaccaggattttagcttctatcagaaaatactatcacagacaaacaacaagcaaaccaaaacttcagacgcatgctggggaggctacagaaggaatgaagtctttacactcaggagcaaaaaggcatccagatggtatgttctgccttactttagaaggctggaatggtagagaggaggggagagatgatggccaccagggaagggaaataatctgtctctcaaatcttcccttgaaattagagtttagggatcccataaggcagtggtttgtacatagtcagggcaaatccacacacagcaatagcagccatggaaccatacttcaaggatcttgggaggacattgacttgcataccttgggaaatcacacggacgacatcagaaaacccaggtagcatactttcccatcataaactagctcacatacactcacaaaatcagaaatgtggtgacatgaggttagggtgggggagttccacctcatatagaaagtattcatttaatgtattatgtaatgtctattaaaggtattactttaactctgtggtaaataaaccactccataagtcagatattctcagaagtactaggaatacctggagaaaattaagtaagtatgacacacacaaacatatgttaaaatcagagcttcttttgtaaaagtgactattgttactttaaggaaaaccctgtgattgttctcacgagtacagtgaaaactgactggccctcagtcccttctgtaaaatgaaagtttatttacatatgtctttcctgaaaaacaacactaaagatacagatcatagacaatacagatcacagacaaggatgtagtatgcaatagtagatttaacttattctctgtggatatcacctgatattgctctttagacaagaagagccattttctccctgggtaaacacacacacacacacacacacacacacacacacacaatgtaaaatttccttcacaaaaatggaactggaaagtattaatgccaagaatacacagggcataaatctacatttatgcccattatttaaaaaaaaaaagcaaccatgaaacaagaaaattgagagcattttcacaatcatcttttattattatttcctcttaaaaatccccttcttataaaaacatatcttcttatattcatttatgaaatttttctttaagtttactttcatatggtattagcacactttaaagcaatttcttctacagttagaatttctcattgttagtgtagtatgactatttggcaagtaaatttgaagactgatctcttcaatgcagttgtattgagccactgaagactttaagctctgtatctcttgattttatcatgtttgaaataattctgaacttgttttgtctaaaatcagtcattctagtatttgtcattgctttttccgacatttagcaaagcttacaaagtccccatgtcatttcctctccttgagatatttaagagtagaacaagaagagaaccttagaggtcatgaggtcagatgcccaatggaaagtttaagttacatttaggagatcacctctagaatcactgctacacattctttgccacttgcccacaggtacactccacctcacattatctatatactgtagacccaacctagatccatcttaacacgaggaaaaaaagaatatgactaatattttcaaagttcttattatgaggtaggcacttttagataccaaacatgtattgtttcatttgaccctcacaatgattttatgagggaattactattatggcctttatttttttaagttgaggaaactgggtattagagaatataagccacttgcccaagatcaccagctggtaggaggaagagtcaaggctaggactttaacccaggtgtggctaactccaaagcacaagctcttatccagtagggttgttgtgaaagcaaatgagaacatataggaaatattcttagcactatgcttggcacataacaacaacataaagtaccagatattattatgttttctgataggatgaatttagggaaatcacacagaagttgagtcattgtccagaggtgtaaagcctatgaatggtaaagacaagatggaaacacagaagactctgctgtgaaaaattacccccaacaaccattctagggatcagcagtggtgcataataactagtatatacaccaggcaaaaatatatctatataatagagagaagaaaggcagcacatccaatataagcatgctcttcttttatgtgggagaggaaactctacagaaatatattaaccagcaaggcttgccttggtcaaaactagaatattgaaaaaaactttgtcctttgataattttctaagcttgctttcaggacttcttcattacatctctgccaagtcacaaatgtccccttgcagatctaccctactggtcactgactttgcttctctaggccagaggattcatatgcattgcactccttagagccctgtctactctgtgtaacaaggatgagtttctggtggttttagttggtcaacatgtaattatcgcccttgaatagtaaaagcttctagtcaacttaatgagtcctaaagaacaatgatttagagagactttgattgcctgttacacataggccctgtccttcagagaggctaaattttccacctttgtcacagggatttcaggaagaaacatagggcagcaaatgtagacagcatacctgagaagctgttgacagtagcatcagtgagtgcctctggcatttgatcagaaaccaacatgagtatttctaaatattgacttcagtggaaggattgttacttgtgatgttcagattaagtgtggcttatgtattatgattggaaagggaaagtccatctctactttcttcccagatacttcctcacatctctaatacattctaccacagacatcacactgagattcactggcattttcaaagcccttgaagatactaaacaatacttatgtggacagaatctgctaaatgtcttccaatattaattctcatcttctaatattatagaggaaaatgaagtggggccataaccccccagataaaaatctcaatgccccagcctcccttgtagccaaatactggataataggccatttgtgatgtgtgtgagttccaggttgtgcttataagatgaacatggttatcaagaaggcagaaaaaagaaattaaagagctctgccagctaaacttgatgttttcctgggactgatctaacactcttctggactctgttctaagtgaatctcaaattgtatgacacctctgcatgcatacacacagacacatgctgcacacaagccacttcttccattgagataaacatgtaaatcaggtccataaccatgagagtataccagaaaggtacaaaatattgagcttattttgaggtaagagaatggagagtattagaaaagtgaagcaaatcgcatatgatacaattcactgacacaatacaactcaagcgcatgattctcaagcactattagcttttcttggtgaccaaggataagagtagataatgcttttggcatttttctcacaaagtcttcatgacataaatgccaaaagcaattgcaacaaactgaagaacttctgcacagcaaaagaaactctcatcagagcaaaaaggcaacctacagaatgggagaaaatttttgcaatctacccatctgaaaaaggcctaatatccagaatttacaagaaacttaaataagtttacaagaaaaaaacaaacaaccgcatcaaaaagtgggcaaaggatatgaacacacagttctctctgtttttttttggagacagagtctcactctgttacccagctggagtgcagtggtgcaacctggctcactgcaacttcagtctcctgggttcaagcaattctgcctcagcctcccaagtagctggtcttacaggcgtgtcccaccacgcccagctaatttttgtatttttagtacagacagggtttcactatgctggccagactgctcttgaactcctgacctcaaatgacccgccctcctcagcttcctgaagtgctgggattacaggcgagagccactacacccagcctaaacagacacttctcaaaagaagacactggctgggcgcggtggctcacgcctgtaatcccagcactttgggaggccgagacaggtggatcatgaggtcaggagatcaagaccatcctgactaacacggtgaaaccttctgtactaaaaatacaaaaaattagccaggcgtggtggcagccgcctgtagtcccagctactcgggaggctgagttaggagaatggcatgagcccgggaggcagagcttgcagtgagcggagattgcgccactgcactccagcctgggcgacagagcgacactctatctcaaaaaaaaaaagaagacatttatgccaccaacaaacataagaataaaagctcaacatcactgatggtcagagaaatgtaaatcaaaaccacaaggagataacatctcacgccagtcagaatggtgattattaaaaagtcaggaaacaataggtgctggcaagtctgtggagaattaggaatgcttttacacggttggtgggagtgtaaattagttcaaccattgtggaagacagtatggcaattcctcgatctagaaccagaaataccatttgacccagcaatcccgttactgggtatatactcaaaggaatataaatcattctactataaagacacatgcacacgtatgtttattgcagcactatttacaatagcaaagacacggaaccaacccaaatgcccatcaatgatagactggaaaaagaaaatatggtacatatacaccgtggaatactatgcagccataaaaaagaatgagatcatgccctttgcagggacatggatgaagctggaagccatcatcctaagcaaactaacacaggaacagaaaaccaaacactgcatgttctcactcataagtggaagttgaaaatgagaatatatggacacagagaggggaataacacaaaccagagcctgttggggagtagggggagaggagagggaacttagaggatgggtcaataggttaagcaaaccatcatggcacacgtatacctatgtaacaaacctgtacatttctgcacatgtatcctgttttccttttttagaagaaataaagaaaaaaaagagtagataataatatcaagagtaatttatagaagacttttgtgaactccaaatttttatttgtggttgattcccaattgtcacccaatgttactttaacaggactattaaactaatgaaatgttggactaaaagaaaaaaaattagctaaatatacacagcactgaatggcatgccatgcactattctaagtgttttacagaattaattcacttaatagtcacaacaaccttataagattattctcccatttttttagatgagaaaactgagaaccagagattttatagtcacaaaaccattaaatggcagacataggatactaatccatggagtctggctttagagtccctgatcttagccactataccacacagcttctccaaggaaaaaagaaaatgattattttttggacctgattacaaatgcctgtaaatatttttcttttaacaattctgaactctacataaagatgaaactcacaaataatggaaattaagtaggaaagtcccaatgaggcaagataaatagttttgacgtcaactttacaatagaggaaactttggtagtaggacagaggaagcaagaaatttaaaaacttctctgtgataggaaaagtatattcaaggctgcaatgagcacaaggttaatcttttcatgctttaattcaagaagtcctgtaaccacagaatgcattcctaaacatttatttaatatatggcaggcattgttgtaacaatacataggcacttggcagaagacagagctctatctctagcattcctccatatgcacatttcaataagaacaaatagctgaagccatagaaatatgccttataaagatactgtgctacaaaacctgaacttcaaggaatgatattttttgacccaaagatatggccagtttgtagtagagcaaaacaatctgtgtgggatgtggaacacggtgtttaaaagctggtccatggaccatactggaccatcataataaagggaaaaaaatgacacaagccagaccaaaatggagacatagccctaaccactgtattctcaaaagagccagaatacaggtgtctttcccttactgaaccagactaggattgctttttttaaaaatcacaataaccagtaatcaatcaaacagttccaactgcctttattctgcatcatatatggtgttggtgatacccagacattaactgcagtgttcctgcctgcctaaaagtggaatccttggttgatcctcaactgaactagggtctagggcagcctcagacaaatggtccaggatgacagggcaggcaatggacagagacacttccacttgcagtctagatcttgccagcatgatctgcccatgaagggaagatattgacatttttattacttctatcaggacagaaactgtatgccacacactgaggggcaagtttctctaattttttagagaaacacaaaaagtaagcaagcatacttttgtaataaagaaggaccttaaacaggaagtttgtagagaacattacattttttccagccttattatatatgcagcctcactcctaggaacaaggacacggatctcacattgctttgaagtagggggaaaaaatcttcaaaggctatctttaaacactgaaaatgtattactgtaaagaactcagcaattaagtaaatcacaggaaatccccaagatataaggtatttaatgtggttttaagaaatggagccatcagctctgcctgggagaacaaatttcaccaaatgttccttctcttaacctatagctttaatttaatgcaactgctgctgcaatccattatatcaactggtatatatctgaccagtacttcactcaagtctttcccttttttttttgagtgcagtggtgtgatctcagctcactgcaacctctgcctcctgggttcaagctattctcctgtctcggcctcccgagtagctgggactacaggcacctcccaacacacccagcaaatttttatatttttagtagagacggggtttcaccatgttgaccagtctggtcttaaactcctgacctcaggtgatctgcccgtcttggcttcccaaagtgctgagactaaaggctagggccatggctcccagccatatttcattttctgaataatttgattcactatattttgggctaaatatattgcaaaatatattgtacttatttattttatttttaactttaaaaactcaactattttaaataataatgttaaaacataattctcatttaattacatagaggttgcatggtgaaaataatttaggaaaaataccactaacatttactgagctttaaatacgtgcacttactatgcgaggcactttacccatattattgcatctacagtcttcacagcagccccataatttaggtacaattattacctgtattgtacaaatgaggaaactaaagagaagagaagagacttaatcaatgccatacagtaagtggcagagccagtaaattaacccagttctaacagccaagttcacttttgcaaatgctaggttgcacattgggagaaataaaggtcttaccccaccatcaatgtggtttagcactgaaactcattgttcttaatttcatagagagtagtttatgtatccttcaaatggggaagaaatctatttaataatatttgactccagttgtagctatgtgactgtaggcatctgatggaaggtggaaaattcagtcaaccatctaagcacctagttgacttaatactagatacttacaaacataaagatgtttgagtaactaaggacttttttactttgcacttggttgtgtggcatcctggcatcatagagacatattccaaactacacagtttaaaattatagatagactttccatagaacctcagtggccagattttctaatttaaaattgcagtagccaaactgataaatgtgtgcttgtagggaataataagacagaatatttaaaacctgaaaaatcactgggcatggtggctcatacctgtaatcctagcactttgggaggctgaggcaggtggatcacttgaggtcaggagctccagaccagcctgcccaacatgcattgcatccatagcttggctgactttcttaaaaaacaggttgatggcaagaaaagagaactgagtagatgttataaatagttaagtacaaatctatcactacttcttgcgaaaatgctcaggctgccacactgatgatgaatagatagctcgttcttcccaaactgagtgcagtagagtgttgcagtgctcagttgggtaggacagatgttggataattggggttatccaacatctctactaaaaatacaaaaattagctgtgcgtggtggaaggtgcctgtaatcccagctactagggacgctgaggcaggagaataaattgaacccgggaggaagaagaatcgattgaacccgggaggcagaggatgcagtgaggcgggatcacgccattgcactccagcctgggtgacgagagcaaaactcttgtctcaaaaaaataaaaaaataaaacctgaaaaatcagaagcttctgatgagccactcataggcttttcctcttgataatatgtgggttcctatgcaatataaggtaggaagcgactttacaataaaaaagaaattgcctttttttttttttttttttttttgcctgtataaagtctttgcaggggtggctaaatatcatctttgcagaatccaacttattttctgtgttcaattgacaaccaagtaggaaccattccctttcaacaaaatagaagcaatgacgaaaagttctgctcctatattttgtagcattttctcaatcggtattctcaaggcatacatcccaatgaagcaagtatagagattttatttagaggtaatattatttgagggtaaccatggagatatgtataattccgattatccaacaactgtcctacccaactgagcactgcagcactctactgcactcagtttggaaagaacgagctatctattcattatcagtatggcagccagagcatttttgcaagaagtagtgatagatttgtacttaactatttataacatctactcagttctcttttcctaccatcaacatgtttttaagaaagtcagccaagctattgatgcgatgcctatgattaggcaggtgaatactatgttctaatttggtttatgctctacgatgtcttcggtaagcaaatgtaacagcttggtttcatctacgattacccacttcgtataaacgttacaccgtactaagttcagcaagggagaatgttgcctccaagaccccctgagaaataaaaccagaaataacctaagcaggtgccttaccatggatgttccagatgtccagatatgggattaagaagaagacccaaaataatttcccagttccaagcatggcaggcaatgtcttcatttcctgcacatatcagtgatggaaaaactgctcaagtagaaggctttgcttcgtcttctgagtgctgcagagttgggtcagtttacctaccccagtggcatctgtgaaataactaaaaaaaaaaaaaaaagaagagagaggtggtaagagaggagagtaggaagagcctggatgattttgtgaaaaaaagtgaacagaaagac

SEQ ID NO: 2350 - DNA, 35596 bp, Homo sapiens; identical to SEQ ID NO: 2349
  source 1..35596: mol_type = genomic DNA

SEQ ID NO: 2351 - DNA, 78415 bp, Homo sapiens
  misc_feature 1525..74524: note = Unsure
  source 1..78415: mol_type = genomic DNA
ttgcacactggcatttctcataaaactttatttggaaaaagttatattcaatgacccaatggtatcaaagtggaagaggaaagtgacaactagagattgataactatatcctctgcaatcctcagaagaaagaaaggggccctttgggttgtttcaggtaaagtacatcaatgggactacaggaaagagaatttcacacacggtctttctgcatcagtaattttaatagagactcttagtggttatcaacaactggtcagttgttttttgtttttttttttccacactgctctctggattcgaacctagtgaattctgggctcagtcctcctcctccatctctttcttgatccagtccacgtagttgagcactttggtgtagaagccatagcccctgctgcacccgatgccccaggacacgatgcccgtggccacccagcgatcagtgttcgggtcccttactgcaaaaacgcccccactatccccctggcaggcgtcctgctttagagatgggtgtccagcacagaacatgttttgagagaacacatccatcctattctttccccggagccagttctcacaggcctgtggattagctacgggcagacggacaaacctgaggtcatgagcaatcttctcctccatgaccccgaagccactgacatagcccatcaagcccaggtcgtagaaggtatcgttgtcagggaggcagatggggaggaggttgggacccagggtgacactattttccagctccagcagggcgatgtccccctcaaaattgtaggactcatcctgacggtagtccgggtggacgctgaccctgcggatggggtgatttcctagcttcatgagctcttccacatttgtgtggcccaggaacacatccaaagaggcgttgctttgcgcttcgtgttccttgggatacagggtgtgggcagctgtgaggatccagcggtcgcccagcagggccccgcccccgcgcccgtggatgttggtgaacacctgccaggggaagttgcccatcttggctttttgccctccgatgatgcgctgcctctgttccacggggttcacgggcttcccacacactgagggagagacagggaagacaagggcaagtcagttccaggtcccacatctcttccttctgcagccagccagctccctgtttgccctctctttttggcttctgtctcttttctctttctcctcccatccccacacctccgtcattggcctattgacaggctcttcttgttcttgttttttttttttttttaaattattatttttattttttgagactccttgctctgttgcctaggctggcatgcagtggcgcgatttcagctcactgcaacctccgcctcctgggttcaagcaattcttgtgcctcagccactcaagtagctgggactacaggcatgtgccaccatgcttggctaatttttctctttttagcagaggctgggtttcgccatgttggccaggctggtctcgaactcctgacctcaggtgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcctcctggggtgctgggccggctctctcccctcagccctgggctcttacctctatgagctggtagccttgcttgcaggtagcaatgaagtagtcacggaactggtactgaggctgcaggttctggatgatggtgaactcgtctagggtcttgggctgggggcacttgatgactgttggggagaccagggggcatatttatttcagagccacttgtccttccttcttccccccttttccccattgctggccatcgagggaggcctgcagggagccttactctcggtggtgtagcgcagcttccagccccggctgtcccccgactcatctgtgaagaacagcagatccacagcattgctgctggtgtcgaggtcggggggcctttgcttcccacagaactcgccaatgttcttcccgttggcatagatctagtaggggaggagggtttttttttttcagcttggacgtttttacacagggccaactgggtagtagcctggtggccagggtggtggtggtggtgatgaaatcctgccttatgtgtgttttcaggggaaggtgaaaagggatccccatgacccaattctagttgtgtgggaacttacccagcccatgggtgatgttggccgttcctgccccagctggccaggggatccaggaggaagttgggacaagaggagccaagtgcagacagaaggggaggaaggggtctttcaggggtaggacggctgtacctgtagctggtcataggggcagtgtacttgctggtggtcatcaatatcaaaaggctccaggaacttgaggtgcagggtgaggccccgctccacccggatgctgtagttgcagcgcaggtcaggggggtaggaccgagggtactccaggctggagatgtagcctgatgcctccgtgtacagctcgctgctgcactcagctgtgagagcagagccacagggcattacgggggactccagctggcccagcaagccctggctcaaccccttcccctctgctacaccactctggctcaccctggcaggaatgcgtgtcttcctgaagctcatagcctggacggcaggaacagaagtagcctccaacgtagttgtgacacaggtgctggcactggggctggggatcctcctcccctgatttgctccgggaagcacattcatcaaggtctggaaggcattcaggaaggagggttaagcttctgctgggagacctgagtagtggctctgatcttagggaggtcactcaccagagacctaaagacaaaggcatctttaggccacctggacctccaggcctctccaatgctctctggggactgctccatggggacagagcccaggttgacaggcctcgttaggaaaagctctctcgaggggaggaacaaggaaagccaggctttcggcttctttgcattcaagattccctttcttggccccccattcaatatggctgaggtcagagaaaagggatccctggggggctactcacccacagcttggtagtaggccaggaagcccttgtagaacatgatggtcccattctcctcgttggagaagtctgtgtggaaggtcagcagcatcttgttcccttgggacataaattccttctttcccggggggttgcccagtggagaacccagttgcccacagaacctccccaggcttttcttatcagcagagatctggtggaagaaggacagtgggtaggaagaagatctgttgcggagtggcgcacgtggtggctcagtgatggtcctccttgtctcgcccagagtgcatcatgcaccgcaatggctctggctggtcactacctgctgggctcagctgctgcaaacttccccatgtgactttcagctgttccctgagtctcccactgattcactctttgcgtgttgtcctggactgggtacctcaccctttccctgttttctgctcctctggcaggtttcaggtccttctccatccccaccacctcctatggcctgttcccctggggtcctggttgtctgtacccagcctttacctgcccctcattcccagagctcagacagctccgctttattttctgtcttcagattccacctcagcctaatcaaaccattcacacctcgagtgcctcctgatgccctcggcggaacatgagccctgaagcccacccatctcagtgtcagcaggcactgcctcgtccctcttccttcctcctcacagcctcctcaacctctccttgactctgccagcaaacgccctcccccaacactgcacactcgccaagtcttctgagccggtaagacgtgccattgtcatgtaattcacgcataatctccaggggtctcctgggaatggtagttgttggaccttcgcaggctctgcttgagccctgaatctcatttttactggatagagaaagacaggcctgggaaggtacccttggttgccacagaggtgagggttctgagcacactgtccttgctgaaggctattcctgtgctgccagagcccacatttctcctcctcatgtccctgtgttcctgttgaagcaggcagccatgtcaatcatttccttggagacagggaagctgaggcacagtggtttcccaaagactctcagctagacagcagatggggaaggttttcctgactcagtggatgttgaatttcctgagtgggtcctgtccccttccttctctgtgcttctcccctcagtgctcaccgagggcctctacaccagtgagcgcccatccagggcatccccgggctctcagagaggccgttggccatcagctcttgtggggctgggctgtgtctgggggtgtgcatgccatacagatcccagatcccagagggcccagttttgtctcccctctgcccgcccatcctgcccctaccttgacataatcatagaagcagccttcagaaggctccaggtcaaactgctggaagacgagcttcaccctgtatcccgtggggactgtgatcacagtggttgtttcaaagttgttggggtaaggcttggggaacagaggggaagtcacctccccaaataacttctgagggatgggaatggagcctcctgccctgcagaacagggccggcaccaggaggtacaagagccacctgccaaaacaaaagagagtatctggagctggaggggttcagcactcttgccatgtgggcagtggctgtggcaggggatgagacggccataccactgggcattctcctctctgcccaccctgaacctcacagacatgttctcagcaggggtgcgtgggtggggaggatggcctgtgcagctgctgcatcgggtcactctccagggcagtgtccagtccagaggccaccacactcccctcacactccctttccagcctcctcccctgcccggacgcgtccctcccctccccttccaggaataggactggcttgggaccagttaatggagggtgagggtttccacccgtgggtctctgaaagggctcccacaggttcagcaagagcgtctgggagaaaccatctgtggagtgggggacacaggcacagagtgtcccgtcctgggcaaggggtcccctcctctcgctgctccctgccaagagcccagagggaagaaaggaccatggcatgagcatctatgtatgaagtctcctctgatccctaggaggagggatggggcgtgtgttgtgtgtgtccacgcgtgtgcacagtggaactgatgaggtgtgtgaagagagaagggtgttcctgtctccctgaattgcctcccatgccctggcttctcccctggcttctccctcccacctggttgcccatcacccttactcacatttctcaaggcccgtgttgaatcctgggctctcccgacagcgtcttcgtgcactgtgtgc

SEQ ID NO: 2352 - DNA, 10356 bp, Homo sapiens
  source 1..10356: mol_type = genomic DNA
gtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtaaaatccttacaaacgaggagcagagctttgatggaggaaaaaggaaaggcagaaaacttcacgtaggagggcttggggcaatgatagagggctgacaaaggcagcataaaaaaaggcagaatatagacaacctatttctcttaggctcaccccatccacccctacttcacccccttacctaccactgttttcagggttaaagcaattttagcaaccctttactaggaactgtggggagatagcttgtattttcagtaagttggcggtggggggcagggacaaactccaaacaaactctggaaaacgaatgtaggaagtttttatgttccttgtcatttggctgtcccttttctccttcctcgcacaaccctgtatcagtggggcagcacttccttctcagaccgcttgtcccagggtccctgccttcccctagtgaaagaagctcctgcctccatcggtgggcgttgggagcatcagcggagatgcacgcaatgataaacagcagacagggctgcttgaggagatgaggtgatcacggttaaagaagaggggctgtcctacatggatgatcatgatgcgccaagactgttgaaaacctgagtggaaatgggagcatcgttcttgagggcaggagagagactgataccgcgggggtggggctggtggaggacaatagaggaagaagaaaactgggagaaagtactcgattcctttggagaaaaattaggagaaagtctagagaagcaatgagggaaggatacaatttagctatagtctagaaagttagtcgaagttaactagggagggtgtgaggggcacggtgccatgtggggatgttggtgatatggccctgtgtgttatacctttgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtaagtgatcaagggtccctgagatgacacagactccattcccttcatcttctcaagaaaagcgctcaagggccaggcatgatggctcacacctgtaaccccagcactttgggaggctgaggcgggaggattgcttgagcccaggactttgagaccagcctgggcaacataaggagaccctgtctctattaaaaaaaaaaaaaattagcccagcgtcatgcgtgtcacctgtggtccctgctactcaaaaggctgaggtggtagaatcacttgagcgcgggaggtcaaggctgcagtgacctgagatcgcaccactgcactccagcctgggtgacagagtgagaacctgtctcaaaaaaaaaaaaaaaagggctcttgtctgaagcctgggttttggtttgacctgggccttttctttattccgacctaagattctcccccatggccgattgactgcctctcttcttccccctttcttctgcctctggcaaatagcgcgttctgtcctaggctactggtgcctggtcacccgccaatctatgcctctgttttttcaggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcaggtatgttataagcacaaaaagaatagagatggaagactagggctaaggtagcggaataaggatgtgggagggagtgccacctgtactcacagtgaactggagtcaagtcctagtggcataaatgttctattctctctgtcccttcttttaactccataccaaaatattaccctttcctagattttttttttgtgactcttctcttagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacaggtaaggctcacccttctgcatgtgccttattgacccagctaaaagattagaaatgagaaatccactgagcaacacattgaatgaggattctgttcgtaattcttataaaaagtgttgacttggcctgggtcgctccataaatcacttttgtgaaattcaaatgcatgatcatatcttagtggtgatgatgatcatggtaataacacatagtacataataaacagcaatttgttgagagccactataaactgggtatgtattggggattggggatttttcctattttaacacaatcgtcactttaatccttcaaggtaggtattatttgctccatataaagatgaagaaaataaggactaggaaagttaataacttgccaagaatcacacaaggaatgtgtagtatttaaacccattcaatatatggcattcaaaccttcaaattctgggtacttctgtatctctctctaggttaaaatgaagctaggacatctcataaagccaaactattgtttagatttgacagaaggaccaacatcatataaagcaatgaatgtactgattcctccctgcagaaggcatcgtcatgatgtttaccttgcagagtgtcattcctggagctgaaatgctctgtacatgagaaaagtcaaggatctctgacattaagagctgcctaggccgggcatggtagctcacacctgtaatcccagcactttgggaggctgaggcaggtggattaccggagcccaggagttcaagaccagcctggccaacatggtgaaaccctgtctctactaaaaatatgaaaaattaaccaggcatagtggtggtgcgtgcttgtgttcccagctcctcgggaggtagaggcgtgagacttgtttgaacttgcttgaaaatgtggaggttgcagtgagccaagatcccaccactgcactccagcctcggtgacagagtgaggctatgtcacttacacacacacacccccgagcttccttatagctgtgtagtggtagggctcaactctggaatcatatgtcaggagagtaatatggaataatagtagcctgaaatgtgatcccttgacggatctttaagcaataggcctttcctactttttcttacccttatggttttggatttaacctcattctcccttcttggtgtttgttcttgacctcagcctctttctactctttgtagacataaatgaatgcacagattttgtagatgtcccttgtagccacttctgcaacaatttcattggtggttacttctgctcctgccccccggaatatttcctccatgatgacatgaagaattgcggaggtgagcttggtgttaagagggttgcatgttccctgggatttggaatggctgaggcctcagaaagggctttgtccacccttccaacttcgattaggccaagccttcatttggcacttcttttttattttagaatttatttatttatgtattatttttaataatttcaatagttttgggggtactggtgtttttggttacatggatgagttccttagtggtcaattctgagattttagtgcacttgttacttgagcggtgtacactatacccagtgtgtagttttctcgcccctgtttcaacctcctcccacgttgagtccccagagtccattatatcactctgtattggcatctattcttagttactcataagctgagatgaagccacaagaaggaggaagataagactatagggtaaagttagttaattggataagagagatagatgcctgtaaagggtctactgggggctgttcataaccagaaaggctccatcctaagcaaagtgatggaaacctaatagggattgggtattcctactgatacgtattgcacgtgtaattgctctatccctccagttagggcagggatctcaggttagtttgaatgcaggactgtcagtttctgagagaaggaatcatagaatagtgcaggaattcctttgcttgaccctgtatttgattctccctttctctttttctctgttagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagttgtgcgtgatggttgattaataccccacccttaacttacacagagagatctctccctgaagacaaatttttttttcatacagcatctttctctgttgctcaagctggagtgcagtggtgcaatcacagctcactgtagccttgatctcttgggctcaagcaagcgtcccacctcagcctcctgagtagctgggcccacagacgtgtgtcatcaaacccagctaatatttttattgttattctttttttttttacagagatggggttttgctatgttgctcaggatagcctgaaactcctagcctcaagcaatgctcccacctcggcctcccaaagtgctgggattataggtgtgagccactgcactcagcctgaagataaaattatcttttctcctgacccttattttcttcttattttatgtgacatttaatgcctcttttatttgtatctcccacttcccaattttacctcttccctttagttctttccctcttctgatttcatcattttgttcagtttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatcgtgagtaacttagaagtgcctctttggttggtgataccaaagtccccaaacaatgtgggatcaaagcaggtagatgatccaggcacactggaagcacctgtgatctcagctaccgagggaggctgaggcaggaggatcccttgagcccaggaagtaggagtttgagtccactctgggcaacagagcaaaaccttgtctctaaaacaaaacaaaaacaaagcaacaataatttaaaaaacagatagattgttgttctgatagaatcctgagatacttcacttcttcaggaaaatctaaaccagtcaacggttgctagaaatgcctcaacctctagtaatcctttaactagacctgagactgcagacagcttgcgggtggttagttggtaatgccatatgattttagacatctgctgtattggaatgttaagcatcaggattgaggacaactggacgattttagaaagtgtgagaatgatgtaaatagaatgagagtcttcaactatttagtaattttttcctcctgtcccaacttctgttctttcaagcaatgccctgccctaaggaagacactcccaattctgtttgggagcctgcgaaggcaaaatatgtctttagagatgtggtgcagataacctgtctggatgggtttgaagttgtggaggtaaagtaccaccttggcttctccccagtccctggccccagatcaggatgagcggactgaaattgtccagttgtttacccaatgtatgtgtgtgatcaaggtataacacctttcccataaacacaacagcttaagatctgtagttctcccttgtgagtcatggagctgcctggccagcttggcattctctctgccttcagtcttcttgaggaaggggagttgacacgttggggcaaagctttctgtcagcctcatctcctgggtgctttaggtctgctaagatgttcccaagcttcttgtggtgaggactcctcattgatccaaggccagagatcaattccagttttgattttggtttcccatatctctcttcagaaataagtggtgatgtttattattctccagggacgtgttggtgcaacatctttctattcgacttgtcaaagcaatggaaagtggagtaattccaaactgaaatgtcaacgtatgtgtctcttcaaagtggaagtctttctttttctctcagagagaatggaaagatcagcacatcaaaattcaaatgcatggtttcctcttaggcatgtgagggagtgggttgggtttttgaagggaagccagtcatggaagcttttctagtcccagccccgcatctggtcccaggccaactagatcggcatgtttctttccaagaaaggggctatgggataggtcgagttagtagccccacgtgggtgcatttgtggcttccactgggccttcaccaaccactgagaaccaggctcttcactacggctttcatggggccatctgaattggcatctcagcgggtgagagagctgagagatgccagttggggaggatggccacagagaggctggtgtggggaggttcatcccaggtgtgcctgtggatatggggtggggaagcagtgaggatgaacctggccccatgactcttccttggaggaagtggctgtcctgaccatcgctctccttccttcgtctggtagctgtggactgtggcattcctgaatccattgagaatggtaaagttgaagacccagagagcactttgtttggttctgtcatccgctacacttgtgaggagccatattactacatggaaaatggaggaggtggtaggtttcttctactggagaagagagagagagagtgagaaggtgttggagggtggatagcataatctgtgccagagacagagtttggagacaaatgaaggcgataggacagacattgttcatccccttggcttcgtccaaagatacagttttcatctggagcagggcaagttcaggggagcatcagcctcagggaatcatagaggtcaccaactgagttcacagctgcagcaggaattcccctacaacatccatttcatgggattacccaccttttgaccagttatttcatgtaaaacccacaggagcaatgccttcagctttaagccaccaaactacactgactggctttcttgatgtagaggctttggtcatgctaggtgcagggctgaatgagaccctaatacgttctctgcattgctctgtatttatttcgccactttcccgatgccttctttccttctgctttggagatgttccctttgtctccctggcaggctagaggcctgagggattgtttggaggaagatattttttttctggctgatttaatctgatttactacttgaatcctagacgagctgaggttctgaaggaacggggcagggtgttggggtcggaggggggaatggaagaaggaagatgtggtggtgagtgtggcctgtgttctctgtgctattccaggggagtatcactgtgctggtaacgggagctgggtgaatgaggtgctgggcccggagctgccgaaatgtgttccaggtaaggagggctgaggcttggggagagatgatagccatgggtgactgggagtcaccttctgaaagcaactgtaatcctcttgggaaaggactgaacagtgacctgccagagtccagctcagtgaggtggcagtatcactgtgccgtgggctgccagggccgtggggaacctcctcagccgcactgaagccaggccaactggaaggaaatagaaacgtcagccagcgacagttggtgtctggtaatgtagctgcagtgagaagatacagaactgctaaaaacagggcctgaaagctgagagtgtgtgagtaatcaacactcagaaacaagtctagctaaatagcctagttattatattaaaagtttatagggcagcaagatatagaggaattcaaagaatgaggaagataagagttgggtagcagaaggctgaggcaaatccaataggataataaccatcctgggtggtactgaaagctgaagactgagctgatttgttgcatttattatctcattcgtgtccgtataacagccctgtgagctaggtgtcattggtcttatctgaccaatgtcaaatgtgaatgggtggggtgcaagttcacagagttagcaagtggcaaaggcaggctttgagcccaggtctgtctaagttcacagcccattgtgctcaacttggagtccctccaggctgtctagtaagggatttaagtaagcagcttcacttgaattcagttattagtataactgaatggtaatggcaccagtcactgggagtgagaggtcagggccaaagaagggacccctctctacttcctaggctgacctgtggtttactaggagggactcaggtgcaactaggactccagtaaagaaggtgattaaagtttgatctgggcatctgaagaaggcagaaatctttcctcctccaccatctgtgtgagaaaagggtttccagcactggctcttgattgggcaccggcctcatgtgccgagttgggaggtgcaaaggggacccctgcctccaggggggctgtgggtcgcactgtggatagtgtgaggcattagtgcatctggactcagtgattcacacactgcctccgtttaactgagctctcccatgagccagcttatgacatcggcaaagcgggatgtttaggtaaggccagagtgggtcaggtattgagattgttgaccaaatagggttgactattttgtactagagaatcctgcaacctagcaggtaacattatgtgagtggttggaggatttgcaggaagccagcatcatttcttcctccttccctgtgttgttttattccttcctagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaa

SEQ ID NO: 2353 - DNA, 10356 bp, Homo sapiens; identical to SEQ ID NO: 2352
  source 1..10356: mol_type = genomic DNA

SEQ ID NO: 2354 - DNA, 18184 bp, Homo sapiens
  source 1..18184: mol_type = genomic DNA
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtaggaggcagggaagggggaacgtcagggtcctgtgtgtgaggttggtgctcccagcttgaattcccatgtgtgaaacagtctcttttgctttccttttctcatctgtgtcttccttctttctccattgctgtctccttgttcccacggctctaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcagggtgctacaccaggggccaccccagaacttttgtttaggagttgctcagggtgggacttaacctgactagatggcaaagttgcttttgcagagggcttttcaaaatatccagaaaatgtcaattgccagtagcaaggaattgggaacaggtcttgatggagactgtggggtactaaagccagggatgactttttatgtacaattgactgcctagtagtgaccattcagaacagatgctgaatggtcctggagtcctctagacatctgaggatcccaaggggagtgtctggggaggccacggccctcaggagactgagggaagtggctatttatcaatcagttcgcttagactctgtgaaattggcaatattcaatcagttgccaaaaacagcaatttcacatgttgcaacctaatatttcagtgttttgacagccagttgaccattcccatgcattccagcataaaatcacctgcttaatccccagcccaggtgttatccatccagtcctatattccccacccacttcctctctctccagctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatgggggtgagttctctggctgatgggctacacagggggctggggtctcctggggaaccctggggcccaatgtgcatccaggaagcctctgtggggataggagtctgttgttcagtgtgccataataatattcctggattttggtaaattgaggtctacaggtcacacatcacaagtctgcaagggccaggccccaggcagctggtgctaagcttcagatgtagcataaagcctccacacactctgcctggcttttctaagtgcctcaaagcaagacttcatattcaggccccacagattgttgtagggaagatatgctgggagagagtcaagtactgtgctttaatgccttgcctttaaagccaggtttgggttccaagccctactctgactttgacagactttgggaaggctatttaacctttctagccctcagttttcccatctgtaagacaaggatagtgagtgctgacctgagattgccatctggattaaatgagttgacattagtaagcatatacaacagccctggagtgcggtggctcacgcctgtaatcccagcactttgggaggccaaggggggtggatcacaaggtcaggagtttgagaccagcttggccaacatggtgaaaccccgtctctagtaaaaatacaaaaattagccgggtgcggtggcgcatgcctgtaataccagctattcaggaggctgaggcaggagaatcatttgaaccaggaagtggagattgcagtgagccgagattgcatcattgcactccagcctgagtgacagagtaagactctgtctcaaaaaaaaaaaaaaaaaaaaaaaatgccagcctcggtgcctcacgcctgtaatcccagcactttgggaggctgaggtgggtggatcacctgaggtcaggagattgagaccagcctggtcaacgtggtgaaacctcgtctatactaaaaatacaaaaattagctgggcgtggttaatcccagctactcaggaggctgaggcaggagaatcacttgaacctgggaggcagaggttgcagtgagccgagatcgtgccactgcactccagcctgggtgacagagtgagactctgtctcaaaacaaacaaacaaacaaacaaacaaaaaacaaaaaaaacagcccctggaatctgataaatgccatgtacacttttttttttttttgagacggagtctagctcttgttgcccaggctggagtgcaatggcgcaatctcagctcaccgcaacatctgcctcccgggttcaagtgactctcctgcctcagcctcccaagaagctgggattacaggcatgcgccaccatgcctcggtaattttctattcttagtagggacagggtttctccatgttggccaggctggtctcaaactcctgacctcaggggattctgcccaccttggcctcccaaagtgctgggattacaggcgtgagccacggcatccggccttgtttttgtttctttaagagacaggatctcgctgtgttgccaaggctggcttcaaactcctgagctcaagtgatcttcctacctcagcctcctcagtagctgggaatgcaggcatgtgccaccacacctggccataagcacttttgtcatagttattgctgcccctgtgaatggtgaggggctctgcttggcagaagtagggctcctaggattccctggagctgcatttgcctgtgggtttgggagcttcttggatcatggttcttagcacatcatacagaagacacggagtccacaagatggcaggaccaccttcacctagtggcccagaccatggatccccactcatgcccttgggttttggcaaatggccatttattctgtaggagggtgaagtagatgcctggtaagactgtgataagtaatgcttgaattattagacgtgactctaacttattttaaaattgaggcataatttacctattgtaaaatgtacaaatcttaactattcagctcaatgatttgttacaatgcatccactcatctaatcaccacccaagacagaatgaggttccctcttgtcccctcccacaaggtaactgctcttctgacctctgtctccatggactaggtaccttgtgcttacatttcctgtaaatggaatcatgcgggatgtggtctgttgcttctggcatcctttgttctatattctgcctgtgagatttatccatgctgttgtgtgtatcagtactttgttcttttttattgctgtgtagtattccattatatgggtatattacaatttatccattcccctcctgatggacatttggattatttccagtttggggccattaggagtaaagctctaggaacattctttttttttttttttttttaattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgctcttaatccattcaaccctgagtggatacagcacatgtttcagagagcacagggttgggggtaaggtcaccgatcaacaggatcccaaggcagaagaatttttcttagtacagaacaaaatgaaaagtctcccaggtctacctctttctacacagacacggcaaccatccgatttctcaatcttttccccacctttcccccctttctattccacaaaaccgtcattgtcatcatggccccttctcaatgagctgttgggtacacctcccagacggggtggtggccgggcagaggggctcctcactttccagtaggcgcggccgggcagaggcgcccctcacctcccggacagggcggctggccgggcggggggctgacccccccacctccctcccggacggcgcggctggccgggcggggggctgatccccccacctccctcccggacggggcggctggccgggcggggggctgacccccccacctccctcccggacagagtggctggccgggcagaggggctcctcacttcccagcaggggcggccgggcagaggcgcccctcacttcccggatggggcggctggccgggcgaggggctgacccccccacctccctcccggacggggcggctggccgggcagagtggctcctcacttcccagtaggggcggccgggcagaggcgcccctcacttcccggacggggcggctggccgggctgggggctgacccccccacctccctcccggacggggcggctggccgggcggggggctgacccccccacctccctcccggaccaggtggctgctgggcggaggggctcctcacttctcagacagggcggctgccgggcggaggggctcctcacttctcagatggagcggttgccaggcagagggtctcctcacttctcagacggggcggccgggcagagacgctcctcacatcccggatggggcggccgggcagaggtgctccccacatctcagacgatgggcggcagggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggtggccaggcggagacgctcctcacttcccagacggggtggcggccgggcagaggctgcaatctcggcactttgggaggccaaggcaggctgctgggaggtggaggttgtagcgagccaagatcacgccactgcactccagcctgggcatcattgagcactgagtgaacgagactccgtctgcaatcccagcacctcgggaggccgaggctggtggatcactcgcggttaggagctggagaccagcccggccaacacagcgaaaccccgtctccactaacaaaatacgaaaaccagtcaggcgtggcggcgcgcgcctgcaatcgcaggcactcggcaagctgaggcaggagaatcaggcagggaggttgcagtgagccgagatggcagcagtaccgtccagcttcggctcggcatcagagggagaccgtggaaagagagggagagggagaccatggggagagggtgagggagagggagctctaggaacattcttgcatgtgattttggtacatgtatgcacttgcttctcttgagtaaatgatctaaatgtggaattgtcacatcacaggctggcatatgtttagttgtagtagaggctgagaaagtttcacccacgtacatgccagcaaggtaacagagtgccagtcgctctgcatcctctccaacacttggaattacctgttgtttcagtgttagccgttttgatgggtgtgtagggatgcctcactgtggtttatgaaatataaatgttctctgaaggagtggagggaccatcagctgacttcttccctgggtctctgggggctctgggacagacatgggtgcatccctgggttggaactgggaagcttctgctggcaactgaggccgctgaggaggcagagcctgatgggagggggctactcacctctgccttcctttgttcactcgcagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccgtgagtagctgccctgccctcctgagattcctcggcacacccggccactgccccggctgactcctgtgtggctctccccacagaaccctactcttatgacttccctgaggacgtggcccctgccctgggcacttccttctcccacatgcttggggccaccaatcccacccagaagacaaagggtgagtgtttgaggtggggtttctggttgagcagggtgctggatctgggccggagcaagggaggatgcaaccttcctggaggccaggagccttggtgggctcagccactgaaagggagggaggcagagaagctggacctgcttggcgagagcgcaggaaggaggtggggatctgaatcctccccttccacatttctccagaaagcctgggccgtaaaatccaaatccagcgctctggtcatctgaacctctacctgctcctggactgttcgcagagtgtgtcggaaaatgactttctcatcttcaaggagagcgcctccctcatggtggacagggtcaggaatcaggagtctgcctgcagcagaggccttcctgtgctcactatctctctctgtctccttcccctcctcagaaccccactcacagcccacctcctccaagaagtcttctcagattatactcatgccatgtaggaatcatgaattcaatttatacaatcataatttttattccacaagcactgttgggacactgtgctggggctgggcgacagcaaagatggaaaggctgaggtcttactttccaggaattcatcatctagaacagtggtctccacagaaaggtagtgagataacccacaggagtgaagcagaaaaatactggtgcccctgtggaataatttaaatcagattaataatttaatatttaataatttccttttaaaacttcaacattttgtgcaggctttaaaatgtgtgtgatagactgggcatggtggctagtgcctgtaatcccaacactttgggaggccgaggcaggtggatcacttgaggtcaggagtttgagaccagcctgaccaacatgatgaaaccctgtctatactaaaaatacaaaattagccacatgtgatggcgcacgcctgtaacccagctacttgggaggatgaggcaggagaatcgcttggatccgggaggtggaggttgcagtgggctgagatcacgccattgcactccagcctgggcaactagagcaaaactctgtctcaaaaaaataaataaaataaaataaaataaaataaaatatgtgtgatagaagtttggaagccactggtttaagttcctcgccagaactttgttttgtaattgtgcttttcacaatacttcatgtaacattatagatggttttccctcccagctacattttaaagagggcagtttctgtgctctcttgggactcaaaattaagtaactcattgcactgcgaggcggcaacacacaccagttggagcagtgattgagaatcatgtgacacattcagatcccacttccacctcctcctcatggtgtgatgggggaagggggacaaggcaacatacctcagtttccttatccataaaataggggtcatcatgcccctcacagggtggagtgaagagagtctgtcaaagagaaagatgttcaacaaaggtttcttccttagctgctgctgttccttatttttattattattattattattattatttttgagatagagtctctgtcacccaggctggagtacagtggtgcgatctcagctcactgcaaactttgcctcctgggttcaagtgattcttctgcctcagcctcctgagtagctgggattataggtgcttgccaccataccaggctaatttttgtatttttagtagagatgggttttgccatgttggtcaggctggtctcgaactcctgacctcaggtgatccacctgcctaaagtgttgggattcaggcatgagccaccgcgcccagcccctagcttcttcctaacagccatttcctagtgtctcccctggtccttgcctctgtcggtctcactccagtttctctgcctcctccagggccctttgtttgctctcttaccatctcccctttggcttcagggccctttacgctgcctctcacttgccccgcacagatcttcagctttgagatcaatgtgagcgttgccattatcacctttgcctcagagcccaaagtcctcatgtctgtcctgaacgacaactcccgggatatgactgaggtgatcagcagcctggaaaatgccaactataaaggtacgggtgtcatcacgtgatggtgatgagagaggagaagatggaccctctcagggcctgcaaacaaattctggatgagttaaaaagagagtgaggcctcttggtggcacctgagtcccacgagtctggggtagtttcaacgtccagggttatggtgggggagtccagctgcccccagctcatagctcattctgagatgctgcaggtccaaagacactgtgcaggtcttcaattccttccagttgccaaaaccacactgtctggtttgcatggctgcacactgccatctccccatgtcattagccacccatacaccatgtaaagtgcctggttggcacttagcaaatggctgaagccactcaaggttttggaaacctcatctttgaatcttgggactttagtgtggtcttggattggggttatgcaatgaacatttcttttttcttcttcttttttttttttttgaggtggagtctcgcactgtcacccaggcttgagtgcagtggcacgatcttggctcactgcaacctctgcctccagggttcaggcaattctcctgcctcagcttcccgagtagctgagatttcgggcacctgccaccatgcctggctaattttttatatttttagttgagatggggtttcactatgttggtcaggctggtctcgtgatcctgactttgtgatccgcccacctcagcctcccaaagtgctgggattacaggcgtgaaccaccttgcccggccctatgcaatgaacatttctaaggtggaaaggcttttaaagtttgaacaagcaatgatgccacatctctatctgaatggcaaatgtctgagtttatcaaaacaatcgataaattgcatttccaggccgggtgcagtggctcatgcctgtagtaatcccagcactttgggaggctgagatgggcggatcacttgaggtcaggaaaccagcttggccaacatggtgaaaccccatctctactaaaaatacaaaaaattagctgggcatggtggctggcacctgtaatcccagctacttgggagactgaggcatgagaatcacttgaactggggaggtggaggttgcagtcagccaagatcacgccactatactctagcctgggtggcagagcgagactctctcaaaaaaaaaaaaaaaattgcatttccaataattgggggaatagagtgattccctacccctaggtggtaggtgggaagtttctaagagagtccttccttttggcatattccagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggtgggtatcatggtctctgagtgtgtctggaatagtggaaggggcaccaatatggggtcagaagccctgaattctgattctccctctgcctgccactttgggccccagttttgtttttgtttttagagatggggccttgctatgttgcccagctgatctcaaactcctggcttcaagcaatcctcctgcctcagcctcccaaagtgctgggattacaggcatgagccaccacacctggcccagtttcttatttataaaatagggccagtgtggtggcttatgcctgtagtcccagcactttgggaggccaaagcgggtggatcacttgaggttaggagtttgagatcagactggctaacatggtgaaaccccgtctctactaaaaatacaaaaccattagctgggtgtggtggcaggcgcctgtaatcccagctacttgggaggctgaggcaggagaattgcttgaacctgggaggcagaggttgcagtgagccaagatcatgccactgcactccagcctgggtgacagaccaagatcctaccttgtctcaaaataaaataaataaataaatagaattagtgttgatgatgatgaccgtaaccacaatgacagcaatgatgatcatgatggctgtcctcctttccttacacaatttttatggaaagctatttaagttgcctgtgtgaaagtgctctgtgttagctcttgttaccatctgggaggtaacttggagatagatgaggaaacgtggctcttgagcaggaatgtcgaagggcacggatgcaaggaacagtctgtagtggatctggccttgtcatttgcctcttgctattgtccaaattacacagttcctccaggacttagtatataaaatgaggatacccactctacctggggtttcatgagaattaaatgagttaaagtataggaagcacctggcctggtgcctggaatgtagaacatttcagtaaaagtgtgtatatatatatatgtatgtatatatatatatatgtatacatacatatatatatatatatatttatttttttgagacagggtctcactctattgcccaggctggactacagtggtgcgatctcggctcactgcaacctctgcctcccaggctgaagcaattctcgtgcctcagcctccagagtagctgggactacaggcatgtgtcaccatgcctggctaatttttatttttattttttgagatggagtttcactcttgttgcccaggctggagtgcaatggcgcgatttcggctcaccgcaacctccgcctcccaggttcaagcgattctcctgcctcctgagtagctgggattacaggcatgtgccaccacacccggctaattttgtatatttagtagaggtgcggtttctccatgttggtcaagctggtctcaaactcccaacctcaggtgatccacctgccttggcctcccaaagtgctgggattacaggcatgagccaccatgcccggccacacctggctaattttttgtggttttagtagagacagggtttcaccatgttgcccaggctggtctggaactcctgagctcaggcaatccgccttcttcggtctcccaaagtgctaggattacaggtgtgagccaccatgcccagcctaaaagtatattttgaagctctcacaggcaatgtaaatgttgaggttcccaggctaaatgctttcctactcttccagggcctggggaaatcctgatattacctagaagaattctttattctctttgttctaggaaagtccaatatgggtggctctcccaagacagctgttgaccatatcagagagatcctgaacatcaaccagaagaggaatgactatctgggtgagcccctgccactgccaccacatttgttctgctcctgcagaggtcatgagatcttcagccagggatcccagcatcttagctatggtccagagccacatggttttatttctgcgttgttctgtacaaaggcaactcatgttgaagagcctggggtcaaactactgcccatggtctcaaccttaccttctttttttttttttttttttttaagacagtgtctcactgacactcagagtatattcctggaaagatgtccacccatgccggcccagaagctggtccagaaagtaacgatgtccaccatgccaccatgaagtgcagtggtgcaatcatagcttactgcagcctcaaattcctggtttcaagtgatcccctcaactcagcttcccaaagtggtaggattacaggtatgagccactatgctcagcccgtcttcacaaattttttaaaattaatttttaaattttttttgagacagaatcttgccgtgttgcccaggctggagtgcagtgactcgatctcaactcactgcaacctccacgtcctggcttcaaatgattctcctgcctcagcctccagagtagctgggattacaggtgtgtgccaccatgcccggctcatttttgcatttttaatagagacagagtttcaccatgttggcagtctggtgtcaaacccctggcctcaagtgatccgcctgccttggtctcccaaggtgctgggattacagataggcgtgagccactgtgcctggccaatttttaattttttaattattatttttaatcaacagctttagacagagaaccttggtttcatcttcagtgggctgtggccatgggcagtttcttcatctgcaaaaggggagtagtactaggacccagctcacaagctgacaggggaagatgctcagacaaacactgcctgcctggcatagaaaaatgcccagcatatgttagccatgaccacgaccgtcgtcgttatcatcatcatcatcatcatagcatctcatgtttcaggaaactttccaggaagaagggacctcgattccctctggggaatgtccctggtggttgctctttcagcagcacagctggctaactaaggctttggcagttgcagcctctaaaggaaaaattcctcaggttcagactaaacacaaattgcactgacctttgatcagaaagtaatttcagagagagagatgctcagacagggagggcagctggttttgagccccaacctttcatcttccccttagctcctctcctttccattcacactgccccctcccccatcacctggccctcgggggtaagctgattcctctttaaaactctggcccaaggaagacaaaatttaaagcccactcccttcctccttagcatcactggaccaaggtcaaatgctacaaaaacattttattgaaaataagcaggaaaccaaacgaaaatagtcaaagaaaacgcacaaggcacgatcgttgtctagctccaactgtaactgtttctatctgggccattgccagattgcctcctggctgaagatctcttggtccacctaagcaccttgctttttacacacaacgcggggctctctgagaacaaaaatgggccacaaggggtgcaaaggctgggagaggagtagactctgtggtctgtctgagggcagttctgactggcaccacagtcggaggacaggcgcggcctgttgtgtgggtccagggcctccagtgggaaaacgtggctttaggcccttctcccagatgctaccttttacagaggaagaccagatctgaggtttagtttccatgttgtgttctgagttctttctattcattcagtcatttaaaagtacttaccaaactaccacaaacctgggtggcttagaacacagaatttctttttcttacagttctggaggttagaagtctgaaatcaaggtgttggcagggccgtgcttcctcagaaggctcttgggaagaattctttcctgccttttccggctgccggcagctccaaccttggcttgcggcagcataaacccattctctgcctctgtcttcaactcgccttcttttctgtgtgtgcctctgtgtcattacatgctgttctcttatatagataggagacccactacctgtgtctttgtgtccaaattcctttcttctttttctgttcatttgtttgagacagagtctcgctctgtcacccagaagcccaggctgcagtgcagtggcgggatcccggctcactgtaacctctgcctcctgggttcaggtgattctcgtgcctcagtctcccaagaagctgggattacaggcatgtgccaccatgcccggcaaatttttgtatttttagtagagacatggtctcgccatgttggctaggctggtcttaaactcctggcctcaaggcgatctgcctgccttcgcctcaaaaaaactgccgggattacaggcatgagtcaccaccatgcccagccagttcacttttttttttttttttttttttgagatggagtcttgctctgttgcccaggctggagtgcagtggtgcaatctcggctcactgcaacatccgcctcccggttcaagcgattctcctgcctcagcctcctgagtagctgggattacaggtgtgtgccagcatgtctggctaatttttgtatttttagtagagacagggtttcaccatgttggtcaggctggtcttgaattcctgacctcgtgatctgcccgcctcagcctcccagagtgctgggattacaggtgtgagccaccgtgcccggctcacctcttctttttttttttttgagacggggttttgctcttgttgcccaggctggagtgcaatggcgcgatcttggctcaccacaaccaccgcctcctggtgattacaggtgtgagccaccacgcctggctctggcttacctcttcttataaggacctcagtcattggattagagctcaccctaatctagtatgacttaatcttaacttgattacatctgcaaagaccctttttccaaataaagtcacagatactggggattaggactcgaacacatctttctgggggacacaattccaccattacagggaataaacaggataagaaaaccatagaacccagcaggtggtaggtgacacaagctaaggggtgttgccatgttgcccaggctggtctcaaacttctggcttcaagggatcctcccaccttgcctcccaaagtggggatgaaagtttgtctggggcattgcagttttagacaggaagaccagggaaggcctcactgagaaggtgacatttgagccaagacttaaaaaggtacgaaagtgagccatgtggaagtctgggggggaggagtgaactaggcagaggcacagctgggcaaagggcctgaggtgtgaccatgcctatggatttgaggaacttcaaagaggctgtgtgctgcaggagagtgaagggcagggagtggcaggaaatgaaggcagacaggtagcagtggggaggacgcaggggtccagctcatgtaggtcttgattggacacagtgagtttcagatgacagcctcctgtctcatggggtagccccaaagccacaggagtctggtgatttccctcttccccaccagacatctatgccatcggggtgggcaagctggatgtggactggagagaactgaatgagctagggtccaagaaggatggtgagaggcatgccttcattctgcaggacacaaaggctctgcaccaggtctttgaacatatgctgggtgagtgagctttgccctccttggtgtggggaggatggtgaggagcccgccagaggcccgtgttgggaacctggacacagtgcccctcacttgcctccttccccatctgatcctcacacccacagatgtctccaagctcacagacaccatctgcggggtggggaacatgtcagcaaacgcctctgaccaggagaggacaccctggcatgtcactattaaggtaccaggaaggaggggcagggcttggattccagaggtaaaagcggccatgggccagacatactgcaatctctgaaaatcacctgttcccctgcagcccaagagccaagagacctgccggggggccctcatctccgaccaatgggtcctgacagcagctcattgcttccgcgatggcaacgaccactccctgtggagggtcaatgtgggtaaggcaggggatgcaccagcctcctgatcctgaagccacagatcctaccacctcacccagcctctggcccctgcaggagccctggtctagcctaatctagtgtatcatttccaggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggtgcctggagtctgggatgggagggtgccctgcagggaagagtgctctggagatccctggaagagatactggggacaggctggtgtgacccttgctcttctccccaggcccatctgccttccctgcacgatggaggccaatctggctctgcggagacctcaaggcagcacctgtagggaccatggtgagtgctgggacttatggtgcttgagagctggggccggggtttgggggtgataacaaggactaggctgcagtccccaagccaggaacctggattctgggtaaaaggaccagcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 2355 - DNA, 18184 bp, Homo sapiens; identical to SEQ ID NO: 2354
  source 1..18184: mol_type = genomic DNA

SEQ ID NO: 2356 - DNA, 44674 bp, Homo sapiens
  source 1..44674: mol_type = genomic DNA
agttgacgatgtccctaacagcgaattccaaggcgcccgtgtagcaggagaggagcaagtcggccacgatgcgtgcactgtgcatcagggagacctgcagctccgagctggggttcagcaggaactggtcccgcaggaagggtgagcaggcggccaagatgaccttgtggcctcgaaacttgaggctgtcggccacaatggtcacgtcgcagaaccgctcctctgcccggagctggttcatgttccgtagcgttgcggcctcgtggccgggcagctggaagcgcaggacttccaccccagaggccattgtggcgggggtgggcaaccctggttgggaaggaaaccggtcagagacaaaggtctctggctctccgaagccaaggctccaggaccctcgcccccattcttgcccagccccccggcatccgatctcccggtcttcagatttcttcctcagtttccccaaccctggggaggtgctgtccctctgagaggagggaggcgtggttctcgggggcggggcagcggcgtccacaccccccagcccagcagcccgctaggatggggcgagcccgcgcgcccacggtggaaggacggagaaaaaggggggccagaggcctggggctctggactccaaggtggccccggttgcaggctcttctcaccccgccccctttaccggctgcctcattcctccgccccccccttacacgtttgcacgcgcttttcacgtcctcccccccgccgccagcacgcaccgtgcacgccctgcccccacgctcagagctccgtggcacgcccccccagccccacgaccctgagtgcacgctcctctcacctggcccggttccgcgcgctgtttttttaatcccttattttccccacccccccccggggccggcagcgacccccacacacgggcagggcctgggcagcgcgcaggcgcggggatgcacgggacgcgcgcgcgcgcggggccggctccgcgtgggcgtaaggggggaggggcgggggcggctcgtgccgtgtgttccaggccccgcgcgcgcggcggcggcggcgtcggctaggactcggggaggaggaagaggggagggaattaaaggagcaggatccccccttcccgacccccctttcttcaccagcacccccacgcggttaaagggccggacggccttgcctcctctttggccgggattatttgtccgccagagcggaaatacgttccacacccccctctttctcgctccccctcctctgtacctccaagccccgcggccagtttgcgcgtgcgtgccaagtgccgcgcggaggcccgctcactcgggcccgccccccaatcccggctgcccatggcgctactcgctccgcgtccccgcgccccgcccgcgccgcatcccgcagcgcgcgcgcgcacccgttctctcggctgcgggcgctgccacctgctcccaggggtggtgcgtctccggtccagctgtgccgagcgctgccctgggtgcatccgtggcacctctcagggccccatccgccccgtggctaacagagctgttggtagctattacccacgcctgcctcctctgctgagtgtgctcacagttgctccagacacattcccaggcttttccaactcttgtaaagctagtaaccgcctcagcccttcaggcctgaaatatgatttcactttccacaaagccagacgatccagtgccctcaactttcctccactccatgtcagtcctttaaaatcacacccgccctcccctccattctcaggattgatcccaacttcttgccaaggcagtcgccctccgcttgtgctatcgatgaccttgcccatttcacctttagtatataattaaccctaggactaattttaatgatgtgatttattatgttagtatgattctactctaatcttccaccgctccgtcccccttattcctcacctctcctccagactgacaaggtccagctctaaacaaaacttcccttcaacactgcgcccgggccttctctttctcttgtctctctcagactaagttatagtctccacagcttcagcgacagcacttaggagcgtcttgaaggctggtgccttcccttccacttcctcgtacctacacccacttccccacctatccaagtccgcgtgaagatgccactgtttcctgccaattggatttcttttttacgtccttcaggagactagtgcgttttccatacatttcaattctgatgaagtttcttattatgtgttcaatatctggtttccccattagactataaacttcttggttgcaggaattatgttgtgggttttgttttgcaaataaaaatcatgcaatagggagggtgtggtggctcacgcctgtaatcccagcactgtgggaggccgaggcaggtggatcacctgaggtcaggagttcgagaccagcctggccaacatggtgaaaccctgactctactaaatatacaaaaattagctggacgtggtggcaggtgcctgtaatcccagctactggggaggctgaggcaggagaatcgcttgaacctgggaggtgaaggttgcagtgagcctagattgcgccattgcactccagcctgggcgacagagcaagactccttctcaaaacaaaacaccaaaaaaggtcatgcaacaaatgattgttgaagtaattcctctttggctcagccagcatccacccataaaaagtttgttcttgagctgaaactgaattcttgaactcaagggatgctgtttggcaggagggtggaggcagcgtagacagtgtttaggtggtaccttgactttttgcctttttcttttaaattctctgatttgtatgcccgcacccagttccctctgttgaatctaagagtctgttctaaactgctctctttgtatttaggccttgtagatttgaggaagaacacctgattttgtgtcagacgcacctaggcttaaagccacattcctaggagtttctgagcctactctggctcagaaggctgccagattcgcaaatcattaaaaaaataaaataaaagccctattcctgtaccaaatgaggcccactgggcaagttacttaattctctgaatcacagtgtccttatctttgtctcccccgcccatccttagctcatctgaaagcatttttatcttgaaggccctgatctctcacagggctaatgtgaggtttaaatgagcctggcatgcagtagttgctgagtaaacaatagctctgttctccttttcctaatctgggaaacggactatgaaattttcaaaagaattttattttattttaattaattaattaatttatttagctggagttttgctcttgtcacccaggctggagtgcaatagcacgatcttggctcactgcaacctccgcttcccaggttcaagtgattctcctgcctcaacctcccaagtagctgggattacaggtgcccgccaccatgcctagctaattttcgcatttttagtagagacggggtttcaccatgttggccaggctggtctcgaactcctgacctcgggtgatccaccttgctcagcctcccaaagtgttgggattacaggcgtgagccactgcgcctgacccaaaagaactttaaaaattctgtttttctatctcatctcttcttttccgcattgccaaacttctcagaagaatagttcacattccagtgagagcagaaatacaaaaagctgtcaagttaagaattagagtttgtaaaattttgtttcttgtccctttcttgctacttttcctttctaggaatgtagatgggacagggggcctaactcagcccatggctcaagacaggtagtccttggtggcaggtggagttgacagccaatgaatccttcaagtgtccagcccacccagttacaactctgcgtaaaaacaagcagaggtgcacaaactcttttccatgtagtctggtggagagatgatgtggagccatttcccatgcatcccatccagggggtttacaatcatctagatccttgtcccttcttccccaacttctgccagtataaaaccaggggctttcctgtccttagcttgcagtaccaaatgccttggtgtggtgtcaagaacagataaatttaggagatacttttaggatttttgggtcaggctcaatggttcattcctgtaatcccagcactttgggaggccgaggcaggaggatcccttgagcccagcagtttgagaccagtctgggcaacatagcaagaccccatctctacaaataataagaaaattagcagggcatgatggtgtgtatgtgcttgggatcccagttacatgagaggctgaggtgggaggactgcttaagcccaggcagttgaggctgcagtgaaccatgatagtgccactgtactccagcctgggcaacagaatgagaccctgtcttttaaaaaaaaaattaggattcttagtgagctttagaaataaaatctgggctgggcactgtggcttatgcctgtaatcccagcactttgggaagctgaggtgggaggatcacttaaggccgggagtttgagaccagcctgggcaacaaagcgagacacctgtctcaaaaataataaaataataaataaaagtaaatacattttttaaaggaaataaaatttgactagggatgcaaggaataactaggagacaaaaggtccaggttccagtccatcttgaagtcatcaaggctccccaggtttcagtattctctttaataaaatggagggattactctctgaagtattttccagtcctatgagtccatagcagcttactttgaaaaggggtgtttatgtttgtgggcatctctgagagaagctagctcacagcttagagcactacccttggctactcatagaggtaaggagtggccttgataatccaaaaccgtagcaaacattggacatttgtctaagacattcaaagtattttaggctgtgggcttactttttacaacgatgcttagcacgtactagaataaccatatttcctgagcaatctataggaaaggaagaggtaagtcagcctggacttttaaatccataggctgatgaaactgtcttacattacaacaaaacctccaacttctttctctttctcctttgatctgcactcagctctgccctcagcgcaggaaccctggtaaaaactgcaggatgttttggcaatgttggaaggggcttactgcttggggaaagaagccatgtgaaaacaaagtgcctgcaccactcccatccatctgcaaaaccaccttttctgaactcccatccatcccccttgactgctcctcaatgctggctcctcctccttcttcagagctccttatccctagctcttcggagccctctcccagcctcaacctgcctccagacaaactcttccctccccctcctacctcggagggaatttactccctgcagcccaccacctttgccatcgtccaagtcctccacacacccttgctgactctgcccagatccaggtctatctggggaaatggaggcagattctcccagcaccttgtgaattccagacagaaaaagactcttccacttctcgacaaatattctatcctctgagcctcaccaagtctgctctgctaccctatgtcatccttgctgcttgagcaactgactttcgggcctgtgatacctgcctggatcaggttgtcctccccaggcctgcctgtgtccctgcaaatgacctaatccatatcccaagtttaaaaaaaaaattgttcattttatttttttcatggagtcattcgtgagagcagaaatacaaaaagctgtcaagttaagaattagagtttgtagggccgggtgcagtggctcacacctgtaatcgcagcactttgggaggctgaggtggccggatcatttgaggtcagaagtttgagaacagcctggccaacatggtgaaacctcgtttctactgaaaatgcaaaaaaaattagctgggcgtggtggtgcatgcctgtaatcccagctactcaggaggctgacgcaggagaattgcttgaacctgggaggcagaggttgcagtgagttgagatcacgccactgcactccagcctgggtgacaagagtgaaactctgtcttaaaaaaaaaaaaagcaaaataaaagcattagagtttgtaaaattttgtttacaaactcaaaattcaaagttcaaaattcaaaatgtagttttgttcaaaattcaaaatgtgtaagtacaattccaaattcaaattgtaaagttttgttcaaaatttaaaaaatataagagggtacaaggctgggtgtggtggcttacgcctgtaaactcagcacttttgggaagccaagggaagaggatcacttgaaaccagcctgggcaacaaggcaaaacccagtctcagaaaaaaaaaaaatagctgtgggaggtggtgttgcctgtggtcgcagctattcaacaggctgaagtgggaggattgattcagcccagggaggagaaggctgcagtgagccttgttcgcactgctgcactccagcttgggtgatggcgcaagaccctgtcaaaaaaaaaaaaaaaaaaaaaaaaagtggtttcttttgctcaggctggagtacagtggtgcaaagaaggctcactgcagcctcgaccttcctggactaatttatttatttattttttagacagagtcttgctctgtcgccaggctggggtgcagtggcacaatctcggcttactgcaacctccacctaccaggttcaagtgattctcctgcctcagcctctggagtagctgggactacaggcgtgcgctaccacttctggcttttttttttttttttttttttgagatggagtttcgcccttgttgcccaggctggagtgcaatggtacaatctcagctcactgcaacctctgcttcccaggttcaagcaattctcctgcctcagcctcctgagtagctaggattacggacgtctgccaccacgcccagctaatgttttgtatttttagtagagatggggtttcaccatgttggccaggctggtcttgaactcctgacctcatgatccgcccacctcagcctcccaaagtgctgggattacaggcatgagccgcagcacccggccattttttttttttttttaattaaaagtggcaagactgggtcttcccgtgttgcccagtcattgatcttgaattcttgggttcaagtgatactcctgccttggcctcccaaagtgttgagtctacaggcatgagccaccgtgctcggcccagataaatctttttataaaagttagagtcagtagatacagcaaatttcattgttgtcttattttaagaaattgttggctgggtggggtgactcactcctgtaatcccagcactttgggaggctgaggtgggcggatcacctgaggtcaggagttcgaggccagcctgggccaacatggtgaaacccaatctctactaaaaacacaaaaattagctgggtgtggtgggggtgcctgtagtcccagccacttgggaggctgaggcaggagaattgcttgaacccaggagatggaggttgtaatgagccgagattgcaccactccactccagcctgggtgacagcatgagacttcatctcaaaaaaaaaaaaaagaaaaaaagaaattgtcaaagccatcccaaccttcagcaaccaccaccctaatcagtcagcagctatcgatatcaagataaaatcctccaccagcaaaaatgttacaactcactaaagactcagatgactgttagcattttttagcaatacagtattttaaaattaaggttacatacattgtttttagacgtatgctattgcacactgaatagactacagtacagtgtaaacataacttgtgtgcactgggaaaccaaaaagttgttgatatgactggctttattgaggggatctggaacgaagcccaaaatatctctgaggtatgaccgtgtatacttcatttgcttattgtaatagtttcagtatctatgcagttgtaggttttcccggacagtttagttttgtctgtttgaccatcacacagatgaatcatactgtacatgttctggggctggccttttcactcaacattatggttttgttgacttgtgtagctgtaattcattcattgtcttttaattggatgcttatactagaatttgtttgtatacctatttacagttcttttggatatatacctaggagtggaactgttggattatatggcaattatatgttaaatttttaacgtattattattattatttttttttagacaggatctctgttgaccagactggaatgcagtggtgtgatcttggctcactgcaacctccacctcccaggcttagcctcccgccttagcctcccgagtagctaggactacaggtatgcaccaccatgcctggctaatttttgcatttttgtagaaacagggtttcaccatgttgctcaggctggtctggaactcctgagctcaagggatccgcctgccttggcctcccaaattgttgagattataggcgtgagccatggcatttgctcccccgcccacctctttttttttttttgtagagatgaagtcttgctgtgtttcccaggctggtctcgaactgctaggctcaagcgatcctccagccttagcttcccaaattcctctcagcctgggatcacaggcgtgagccactgtgcccaccctatatgttaaaccttttgaggaactgccaaactgttttccacagcagctgcaccattttatgttcccaccaggagattgtacacaagcttcaatttctccatatccttgccaacagttgttattttctgtttttttttgttttttgtttttttttgagacagcgtctcactctgttgccccggctagagtacagtggtgcgatcttggctcactgcaacctctgcctcccgggttcaagggattctcctgcctcagcctcctgagtagctgggactacagtcacgcgccaccacgcctggctaatttttgtatttatagtagagatggggtttcaccatattggccaggctggtctcgaactcctgaccttgtgatccgcccacctcagcctcccaaagtgctgggattacagacgtgagccaccgcgcctggcttgtttttttttttaaatagacattctagttgatatgaagttgtactcattatagttttattttcatttacttaatgactaatgatgttgagcatcttttcatgtccttgttggccatttgtgtgtcttctctggagaaatatctattcaagtcctttgctcatttttttttttttgacaaggtctcactctgttgcccaggctggaatgcacaatcatgactcactgcaggcttgacctccccaggaacaggtgatcctcccacctcagcctccagagtagctaggactacaggcacacgccaccacacccagctaatttttgttatttgttgtagagacagggttttgccatgttgctcaggcttagaaggctttcaagcacaaaatgtattacattaggataatgtcttgggggtagaaatagaactatgaaaataagaattcagaagaaatagaacaatgtgaaatttctgactgttaaagaagattataatcatgtactttaaaaatgaatcatgagcccagcacggtggcccacacctgtaatcccagcactttgggaggctgaggcagatgaatcacttgaggtcaggagttcaagaccagcctggccaacatgatgaaaccccatctctactaaaaatacaaaaattagccaggcgtggtggcgcatgcctgtaatcccagctactcgggaggctgaggcaggataatctcttgaacccgggaggcagaggttgcagtgagccgagatcgtgccactgcactccagcctgggtgacagagcaagcttccatcttaaaaataaaataaaaaataaataaataaaatgaattgggctgggtgtggtggctcatgcctgtaatcccagcactttgggagaccaaagcgggtggatcacctgaagtcaggagttcgagaccagcctgagcaacaaggtgaaaccccgtctctactaaaaatacgaaaattagccagacgtggtggcaggcacctgtagtcccagctactcgagaggtggaggcaggagaattgctggaacctgggaggcggaggttgcagtgagccgagatggcgccactgcactccagcctaggagacagagggagactcttgtctcaaaaaataaacaaataaatacataaaaaaaaaaataaaatgaatcatgaagggaatggttaaaaagtgaaataagacttttaaaaaaagatccatgtttacaacacactggaatggcattcttttgcaactaaacatttggggaaagttttagatagcagcataaaaacatgcaaggggtacataatttgcaaaattcttttaatgtgagcaaaagggtttgaagattacatgcttcttgaaatcagcatgcacatgagtcatctggagttttaattcggagtctgagtcagtaggtctgggtggggcctgagattctgtgtttctttctttttttttttttctctctcttttttttttgagacagagtctcgctctgttgcccaggctggagtgcagtggcacactgcagcctccgcctcccgggttcaagcaattctcctgcctcagcctcccaagtagctgggactacaggcacatgccaccacgcctggctaatttttgtatttttagtagaaatggggtttcaccatgttggccaagctggtctcgcactcctgacctcaggtgatttgcccgcctcagcctcccaaagtgctgagattacaggcatgagccaccatgtctggccctttttttttttttttttttccaatttgagaccgggtcactacgttgccaaggctggtctctaactcctgggctcaagcgatccgcccactgcagtctcccaaagtgctgggattacaggcgttgagccaccgtgcctggccagattctgcatttctacaagttcctgctgatgctgatgctgtctgtctgtggaccacagtctgagtagcaagcatccacatattcgtaagagtggagttgctggatgttgaggtctgcacctgttcagcttccctgctaatgctaaactattttctgaagcagttgtacaccagccatgagactgttgcttcttgggaaaaaagatataaaggcttcaaatttaatggatattattcagtgctcctcttacttgagctttctgcagtctgtgacatacttgaccacactgtttgatccactgcttttccctggtttccatgacacccctgtatccaggctcccttccttctataatttcagtctgttctataaaccctcactcctttcctgtcttgaccttttcctctgttgatgcctttggccttctaggcctttatctcattctctctgggtggtaccatgtgctctttagagattggttaccaggccgggcacggtggctcacacctgtaatccgagcactttgggaggctgaggcaggtggatcacctgaggtcaggagttcgagaccagtctggccaacatggtgaaaccctgtctctactgaaaatacaaaaaattaaccagggtgatggtgtgtgcctgtaatcccagctactcaggaggctgaggcaggagaatcgcttgaacctgggaggcagaggctgcagtgagctgagatcatatcactacactccagcctgagtgacagagcgggactctatctcaaaaaagaaaaaaaaaaaaaaagagattggttaccacattgatgactctgtgatggttaattttatgtgtcaggccaagcgcagtggctcacgcctgtaatcccagcactttaggagggcaaggtgggaggattacttgagcccaggatttcaagaccactctgggtaagatggtgaaaccctgtttccacaaaaaaaaaaaaaaaaaaaaaaagatgtgtcaatttggcaaggctatggtgcccttgggcactgtatatatacacatttgcattattatttatcttaatgagatagactctcactatgttctccaggctgaacttgaactcccagtctcaagtgattctcctgcctcagcctcctgggtatctgggactacaagcatgccaccatgcctgactgtagtctggatacttcagtgagggcattttgtagataacactgacatcttggctgggcacagtggctcacgccagtaattggagcactttgggaggccaaggtgggcagatcacctgaggtgaggagttcgcgaccagcctggccaacatggtgaaccgctatctctactaaaaatacaaaaattagctgggtgtggtggcaggcacctgtaatcccagctagttgggaggctgaggcacaagaatcatttgaacctggaaggcagaggttacagtgagctgagaccgtgccattgcactccagtctgggcaagtctgggcaacaaaagcgaaactccatctcaaaaaaataaaacgaagcaaagacattgccatctatactcagctgacgttaagtaaaggagtttactcttttttttttgagatggagtctcattctgtcaccctggctggagtgtagtggcgtgatctcggctcactgcaacctccgcctcctgggtgtaagcaattctcccgcctcaggctcccgtgtagctgggactacaggcaccacacccggctaatttttgtatttttagtagagacaggatttcactatgttggccaggctggtcttgaactcatgacctcgtgatctgcccgccttggcctccagaagtgctgggattacaggcatgagccaccgtgcctggcccttttttttttaagacggaatctcgctctgtcacccaggcgcgatcttggctcactgcaacctgcgatccgactccctggttcaagtgattgtcctgcctcagcctcccaagtagctgagattacaggcacatgccaacacgcccagttaagttttgtattcaccgtgtttcactatgttggccaggatggtctcaatctcatgaccttgtgatccgcctgcctcggcctctcaaagtgctgggatttcaggtgtgagccaccacgcccagccaggagattactcttgatattgtggcctaaagagcaaagacttaggtttcccagagaaggaattctgcctcaagactgtcacatagaaatcctgcctgagtggccgggcgcggtggctcactcctgtaatcccagcactttgggaggccgaggtgggcggatcatgaggtcaggagttcgagaccagcctggccaatatggtgaaaccccatctctactaaaaatacaaaaattagctgggcgtagtggtgtatgcctgtagtcccagctacttgggaggctgaggcagaagaatcgcttgaacctaggaggcagaggttgcagtgagccgagatcgtgccactgcactccagcctgggcaacagagtgagactccgtctcaaaaaaaaaaaagaagactatagttaatgaacaagcaatcggccgggcgcggtggttcacgcctgtaatcccagcactgtgggaggccgagacgggtggatcacgaggtcaggagatggagaccatcctggctaacacggtgaaaccccgtctctactaaaaatacaaaaaaattagccaggcgtggtggcaggcgcctgtagtcccagctacttgggaggctgaggcaggagaatggcgtgaacccgggaggcggagcttgcagtgagccaagatcacaccactgcactccagcctgggcgacagagcaagactccatcacaacaacaacaacaacaacaaaaacaatgaacaagcagtcatggtgcaatgtgataagacacccaggtgttctgagagtcagaggagggctcaggggccccgtggtctatgcctcaacgttggtgctggctttcccttcctcatttctgtgcttgcttttagcccctgttgtcttgccaggactctaaatgtctcttaactggtcttccagcccctacatactgattccagaataatatttctgaaatgcaaatcaaatcatatcacttccttatctaaaattccatatagcaaatcgccttacaagctgtaaatgctgtttcttccataaggcattctctccttcctccctggtctagtgtcattgtggccttccttccctccccagccctgaaaggtcctgaacttgcagttcctttaatgcgctctggggtttcattgctcacctggatgcttgcatctcttccttgtcaggtaaacactcatcttttaaggctatctcaagttcattgatgaaacctttctgatcttctagagagacctaatattcccctgtttgtgtccctgtgaactttatatggactcctatctcagcttgtatcagtcaggatggctacatcatgctgcagtaacaaacaaccctggaatctcagtagcttaacacaacagttttatttctcactattgctctctgttgggtcagtaggagtgttagagtctctgatcatcatagtcactcaggcatccagatcaaaggaggctccatcaaaagagggtgctggagtgtcttgtgttacattggcagttaaatacttgtgcctgacagtaacaacacatgtgacttctgctcttatttcactggccaaagcaagccagttaggcctcttgcagtggcctaacttcaggagggctgaggaattccatcctatcatgtgcctggaaggcagaaaacgggaaaattcatgaagagcctcaatggctgcctcaactcggtgtagcgctgactggctcacatatctctctcccactggacagtgggggaaccaaacgtgtcacagcgttcctaccctttagcagtttgtgctccaggaatgtggagagaccagtatatggatggattataactctgtgttaatgttacagtctgggtttgctggcgtggaaggagtttgtggaagaagggcagtagtttatagggagaggaggatggaaagggatgatcttaattttggtgaccctgacagcagagcttgagacaggacttggccataggtagttaatttaggtgatcccagaaagcagaagcgaggctatagggagtgtgagatcctgaaggaggaaaggccagtttaagagaatgatgttggccgggtatggtggctcacgcctgtaatcccagcactttgggaggctgaggtgggtggatcacctgaggtcaggagttcgagaccagcctggccaacacgacgaaaccctgtctctactaaaattgcaaaaattagcctggcgtggtggcatgtgcctgtcatcccagctatttgggaggctgaggcaggagaattgcttgaacctgggaggcggaggttgcggtgagcagagattgcaccattgcactccagcctgggcaacagagtgagactccgtctcaaaaaaaaaaaaaaaaaaaagagtgatgtcactgttgtgtgcagtggagttcgattcccccaggccctcctgaggagagagctgaatgtctccagacgctttccacctgaaggacaggaggcaggagcatctgtctactgcttcccactctgcaataattgcaggttgactctgggcattagttctctgcccttttttttttttttttttgagacagagttttgctccttttgcccaggctggagttgtagtgagctgagatagcgccactgtactccagcctgggtgacagggcgagactccatctcaacaaaaaaaaaaaaaaaaaaaaggctggctgtggtggctcatgtctgtaatctgagcactttgggaggccgaggcgggtggattacctgagatcatgaatttgagaccagcctggcaaacatggtgaaacctcgtctctactaaaaatacaaaaattagccggcgtgctggtgggcacttgtaatccgagctacttgggaggctgaggcaggagaatcgcttgaacccaggaggcggaggttgcagtgagccaagacggcaccactgcactccagcctgggtgacagagtgagactctgtctcagaaaaaaaaaaaaaaagaaaaaaattatgatacagagaacaatgagatgttttataaatttatagttcaaaagaaacattttattttggtaaaagccaagaagtgaaagataaatagttttgcagccataaaaaaaaaaaattaaatcatgtcctttgcagcaacatggatggagctggaggacagaatcctaaatgaattagcgtaggaacagaaaaccaaatgcctaatgttctcacttataacggaactaaatattgagcacatatggacataaatataggaacaatagacactgaagactactagaaggggagagagggagggagtgtgggttaaaaaattacctaattggttctatgactacctagtgcaatatacccatgtaacaaacctgcacctgtaccccctgtatctaaaataaaagttggaattttaaaaaaagaaaaaaaggccaggcgcggtggctcatgcctgtaatcccagcactttgggaggctgaggtaggcggatcacctgaggccaggagttggagaccagcctggccaacatggtgaaaccccgtctctactaaaaatgcaaaaattagctgggcgtggtgtcagccgtttgtaatcccagctacttgggaggctgaggcaggagaattgcttgaacccgggaggcggaggttgcagtgagccgagatcacgccattgcactccagcctgggtgacacaaagagactctatctgaaaaaaagagaaagaaaatgtgctcttatgtaagtgagaaatgttctgaaaaaagaaaaaagagaaatattttaaaatgaaaaatttgagcttttccgtaaaaaaatttttaatgaattcccagcactttgggaggcctaggttggaggattgcttgaggctagttcaagaccagcctggaaaacatagcaagacctcatctctaattaaagtaaacaattaaaaaaaacttagcctggtatgatggcatatgcctgtaatctcagctactcaggaggctgaggtgggaggattgtggaagcccaggagtttgaggctgccgtgagctatgatcaggtctctgcactccagcctgggcaacaaagcaagaccccatctcaaaaaaaaaatattcctcgaggccaggcacagtggctcacacttgtaatcctaacactttgggagactgaggcaggaggatcacttgaagctaggagtttgaggccagtccgggcaacatactgagacccctgtctttacaaaagtaaataaatgaataaattagctgggcatggtgatgcatgcttcttgtcccagcttcttggaaggctgaggtgggaggatcatgtgagcccaggagtttgtggttacagtgagctgtgattgcaccactaaactccagcctgggtgacagtgagaccctgtctttaacttaaaaaaaaaaaaaaatcctggctgggagcggtggctcacgcctgtaattccagcactttgggaggccgaggtgggcggatcacgaggtcaggagttcaagaccagcctggccaagttggtgaaaccccatctctactaaaaatacaaaaaaattagctgggtgtagtggcgggcacctgtaatcccagctactcaggaggcttgaacctgggaggcagaggttgcagtgggccgagattgcatcactgcactccagcctgggtgacagagcaagactctgtctcaaaaaaaaaaaaaaaaaaaaaattcctggaaggaatggttggtgggtggtatatagacatgaacccagaccgtctatgaaccgagaccgtctatgaactgaagctagatgatggatacatacatgaaagttcattttactattctctctactttacaatatgtttgaaattttacaaaataaaacttaatctgcagagagattgtatcagggtctcttgttaatagtccagtagggtatttcttttcttttcttttcttttcttttttttttttttctggagacggagttttgttcttgttgcccaggttggagtgcagtggtgcaatctcagctcacagcaacctctgcctcccaggttcaagcaattctcctgcctcagcctcctgagtaggtggggtgacaagtgcctgccaacacacccggctaatttttgtatttttagtagagacgggatttcaccatgttggtcaggctggtctcaaactcctgacctcaggtgatccacctgccttggccacccaaagtgctgggattacaggcgtgagccactgggcctggccttgaataggtatcatatgtacccagtgaaaactacaaggagtaataaaggggatttggtgaaaattaagttgccttctttacctcccacctcattttccagcccccagttctccccagaggcaactctcctatccagttttttgtaaacttttccagtgaaattatatacacacagagagcatatgtggctactatcctctttccctcctttttttgcataaatggtggcatcccatacatacagttctgaatgtctatctagtttaaaagtgtatattatataacatatatatctggagacattcagctctgtacacacagataagccttaagcttgcagagactgcgtagtattcagttgtccccataccacaatgtgctgtgtctgtcccctattaatggacgtgggagtttccaaacatttcctcttggtaacagtgaatgctaaagcaaatatcctggtaccttttatacctgtagggtagccgatcttctccttttgatggtcctaattctcaaaggtaaccttaaggggagtgtattttgctgttggttctgtggatgacaggtgacaaaacagggtgagtaaggctacgaaatagctaatgaatttgccaagccaaacctgaggttccaggctgtcttaagtcaaagcctgaattcctcataccacactggggctggggccagagacggggcaggaggagctcttctcaggtataacctttcatttgtgttgggcaggaaagcaaggcatgaacgtatgtctttctactgggcaagttccctcttcaccccttggcagcactggaggagtgagggcaggaggattctcccatgtgagccccaggctatccttttgtcaagagggtactggtacccagaactgggaaggggatgaatatctccccactccccaggataaaggaaaacattagagaggaattttcaatgaaagggcagaggaggctagtgaggcccccactgccaccaatgctaagcccagagctggggttggggtggtgaggaccggagccagggcaattcagccataggccacccctccccctggcccatcctcagctgacccctgagcacctgagttgtgtttaccaccctcttacctgggttacccagggcagctcccctgatgggtagcaagaagtgggtgataacatgcaccatgccccccaccagcccaaggacagtggagacctcagagggctgaggtaagagctgcggtgtgggcagatggacaccctggtacaccccaggcctgtgagtctttagaggttgagtttttgtctgaaagagatatggcgcctacaggaggtcagggacaggccttctgtttcttgggaggccctaccccaccccttagttcctcgttccattctcaggaattgtttgtgcaatggatggacaaggacaggaggttcagtgtctaacccagtgtctgggcctgcagggtggcctctgaggcccagggccctggaagagcctgggcatggggaggagccccatggggcagggcaaaaccctttctgaggctctaagggtgatgtatgtggagattcctcaagatcatagttgggcaatcacttcaaagttagtaggcagtgcctgctaggatgggggatggtgtgtgtaccgaggaacttagcagaggcctttgtgtggaaatgggtggggtctgacccaatgtaaatatttttattaaaaaagaaatggatgagaaaccaaagccaattctgttgctgacctgaaagatgctatttacttggggtggaaataggatgggggagggcattggcttgaccttacttggatagctcattgtttaaaaaaaaaactcctggatccttcctctggggagcttgagacaagtgcacaagtagctagaaggtgggaaatggcgtggacaggtcttgtaggagtctggaagatgagggatttgagaaggatggaaaagaaggtgttatgggagagggggtgccaagaggaaagagcctaggggagagagggcttggaaatgcaaggggctggggtagacttcagggatgcgcaaggagctcccagcagtcactaaagagaagacgtgaggaagaggcactaccacttggtggctatgagtgtggacccaggagccatgctgcctgggtttgaatcccggctctgctgcttagtacctgtatgaacctggggcagctcacttaacctttgtgtgcctcagttccctcatctgtaaagtgggagtaacaacagaacctgtgtcataagcttgctgtgaggattaagtgagcacctacatttaagacttaaaaatactgtctggcactatgtcctgctaatatgaagtcttcctcccccagaagcagacctggagacaagggttccagtgcagacagtgcattctggaggtgatcgcaagaaacatgggtagtggagtgtgatagagaaggaaggcagtcaatgaagggtgtgttatcaggcaaatttaccattgtgggtgagtggaggtcaatcccactcaggaaccctggagtggtgcagagttatcccatggtccagggtgagggagcccagtatttataccaatcagtcattggttgaaggccttaattctctgtcatttccagctttctgtgcacagatggtgcaggacaccaaaaacaatccttgggtagagacagagatgctgcagctggaagtcagtggagcaccccagtgataaggcccaagggatatggtggggcaaggacagatccactaaaaccaccaagaggcttgcagagcaatgctgaatccccatctaaagtcacacattaaggctgtgaaccaggccaagccagactagttttccaatttgggggttgacctgcagttgccatagaaggttgaggggtggcagatcctaggatgaccgcgaagtccatgcccaagtggccagactggataaggagtagactggccactagagtggggtcggcctctgctatatgccacgtttcctcagaaattttcagctgcaaggtgctgagctctccaggggagaataaggcatcctgagaggccatcagagcatcatttctgatttttaaactctgattagggggcctggcacagtggctcacacctgtaatcccagcactttgggaggcagaggcaggtggatcacctgaggtcaggagtttgagaccagcctgaccagcatggtgaaaccccatctctactaaaaatacaaaaattagctgggcatggtagcacatgcctgtaatcccagctacttgggagtctgaggcaggagaatcccttgaacccaggaggtggaggttgcagtgagccgagatcgtactgcttcactccagcctgggcaacaaagcaagactttgtctcaaaaacaaaaaaccaaaaaaaccaaaagcaaaaatccaactctgactaggagatgaagtacagaattggggtattggttttttctctttggaattgtacccttggaagcagatattagaagcctagaattgataagaagaaatttggacaagatggaagaagctggcaggagaggcatgtctgttttttagatattattcacctgcttccctctacctggagtgaaaacacggttacatttgctgggcttttgaatggtacaagaaatagagaagccaaggtcgccctcatctggtggggtctactgaaaagctaatcgggagtgccgaggggaataaaggtctggcatctttagccccacaggtcaggtcatggtccttccacattcgactgggcctcctggagagctgacagtggactataactgactttttgccaatggaatatgaatggaagagtggggtgggaggcagacttgatggagaccctgtttcaaccatgcagacaaggacaatttccaaaggcatgaaccacagatggaaggaagctggaggcctgaaggaggctgatgagcagctctgccagccagggccacacacgccatctcagccttgtctgcttaccctgagcctcttattttgtttttattttttttttgttgagatggagtcttgctctgtcacccaggctggagtgcagtggcacgatctccgctcactgcaagctccatctcccgggttcacgccattcgcctgcctcagcctcccgagtagctgggactacaggcgccgccaccacacccagctaatttttttttttttgtagttttagtagagacagggtttcaccatgttagccaggatggtctcgatctcctgacctcgtgatccgcccgcctcggcctcccaaagtgctgggattacaggcgtaagccaccgcacccggcctctgaggctcttatttatttattttttttgagatggagtctcgctctgtctcccaggctggagtgcagtagcgcgatctcagctcactgcaaactctgcctcccgggttcctgccattctcctgcctcagcctcccgagtagctgggactacaggcgcctgccaccgcgcccggctaattatttgtattttttagtagagacggggtttcaccgtgttagccaggattgtctcgatctcctgaccttgtgatccacccgcctcggcctcccaaagtgctgggattacaggcgtgaaccaccgcgcccggcctctgaggctcttatttgaaagtgcagcaaaattctatcttatttaagttactgtattttagggtctctttattacagaagtttaacgtgtatcctaataaacacacttctctgagtgttgcctttggctctcacattgatttcttgctaggtatatcagttagacatggtttggctttgttataaccaagctagaataacagcagcttaaatggtctgagcataagtggtccaggtcaatcctattagctctacaggattggagagcagggcctctttaattttgtttctttatcatcatccacatgtgacttccattttgtgatctaggtggctgttccagagtccaccattctgtccacattccagctggtgggaagggaagaagttttatacattgaggagtaaacacttctccttaagaacatactctgtgggcccagaaaacttgggagttttattacttaagcaggaagagagaatgaattctgccacactgtgccaagttgatgtagctcaacaaatactgggaaaaactcatgaaagaaaggccctttcttttgaaggcagctgttacatattagtttgatggctttaaaaggcacccaaagtttagtgatttgaatgttcagtcaggttaggcttcattacgttctggtaaccaacaacctagaaatatttgttgccataggagggcttacaaaatatagccatcagtctctcctattctgatgtgcctgcccctttgccgtgtgactttgccattcctcctatcaagaggtaaattctatgcctccagtcttaaatctgggctgaccttgtgatttgctttgaccaatagaatgtggcagaagtgatgttatgtgacttttggggctaggcctcgagagaccttgcagcttatgttttggattcctcagaagttgtcctgagactgccatgctatgagggctagggaggaaggacctgctgtcctactgttaactgaactcagcccctagctgactgccgctgcatggaagatcagcagaagaaccttctggccaatatgagaaagaataaatcatttttaaatttcctacatattgggtgggtactttttttcctgcattagtagaaatgcaatgaattaaaataacaaaggtttattttttggtcatattacttatccactgagagtcagccgagtattgcgctttttttttcttttttgagacagagtctccctatgtcacccaggctgaagtgcagtggtgtgatctcggctcactgcaatctctgcctcccgggttcaagcgattctcctacctcaacctcctgagcagctgggattacaggcgtatgccaccacgcccagctaatttttgtatttttagtagagatggggtttcaccatgttggtcaggctggtctctaactcctgaactcaggtgatccccctgcctcggcctcccaaagtgctgggattacaggtgtgagccactgtgcccggctggtactgtgctttcgatatcacccagggatcttggctggtggagcagccaccatctcagacgttaccatacagaggggaagagcagggtgaagactacattgagcttccatcaggaagtgatacatatcacttgtactcacatcttattggctaaaacaagtggctggggaaatcctatcctaccatgtgattgaaagaagacaaggctacagtatttgtgaacatccttaaataccccccacctttacgatagtttatttctctcttgtaacaatctaagtggctgtgcagggctggtatgacatcaacactgtgtcagacacccaggctcctctgtctgtttgctctgtcatccccagcatgttgccctcatcctcctggtggaagacggatctccgctaggtttatattccagcccatgaaaagaaaaggcacactgcctttttattttagggacataacttggaaatgacatacataagttctactaacatcccattagccagaaccaagtcacctggctacctagctgcaagggaagctaggaaatatggtctttagctgggtgactgtgtgttcccctaaccatctcttactgtggaaggagggagaaaagatacttgaggggcaggggaggcactagcagctctgccacagcagccactttggagtccctaacaccaggatgtcctgattttcatgcacttagccctgtccaaggggagtctcaatttgtgtactcttttttttttttttgagacagagtcttgctcttgtcacccaggctggaatgcagtggcatgatcttggctcactgcaacctctgcctcccgggttcaagtgattctcctgcctcagcctcccgagtagctgggattacaggcccctgccaccacacccggctaattttttgtaattttagtagagacggggtttcaccatgttggccgggctggtctcaaattcctgacctcatgatccacccgcctcagcctcccaaaatgctgggattacaggcgtgagtcactgtgcccggtcttattttttttttttctttttgagatgtagtcttactctgttgcccaggctggagtgcagtggcacaatcttggctcactgcaacctccatcttctaggttcaatcagttctctaaggactcacttataaatcaaaagggtttttacgaacctaaatgatcacttcagagaggtttcatgttcatttttttattggtcttatttatttttaccctacattgttcaaaaaggtattgaaaagacttctgtgggtcagggagactaacacactagcttcaagtttctttgcttcctgcatttcatacaagtgtaggttatgatttaaaggcatatcccagcccccgcaaaagttttattcctttgagtaaccaaccccaaatgtatttactttgccagttgggaatttcatctactagactttccgtaaaaatgttgtaaacatttttcctgtctccaaaactaagtgttgatttcattttttccacctagattatctctagggaaggattgtagggaataaaaaagtattgtcaatcttcctatttatcaagaagttctaaaaaaattagtttcacccccctcggaagtttatcttcaagaagacagaactgttctaggctctcaggaagtaaaacccacttggtacaacccaaaagaacactaaaactttacttaaatgaaatattttgcaatatcttggatggtttgtgggtttgtgtgctttagactattgactattcacacaagagcaaggtgcatgtgtgcacacacgagcccaaatatgtgtttgcctgcgtgtttgtgagcatgcgtgtatggtgcacatgtgcacgcatgggtgggtggagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtaggaggcagggaagggggaacgtcagggtcctgtgtgtgaggttggtgctcccagcttgaattcccatgtgtgaaacagtctcttttgctttccttttctcatctgtgtcttccttctttctccattgctgtctccttgttcccacggctctaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcagggtgctacaccaggggccaccccagaacttttgtttaggagttgctcagggtgggacttaacctgactagatggcaaagttgcttttgcagagggcttttcaaaatatccagaaaatgtcaattgccagtagcaaggaattgggaacaggtcttgatggagactgtggggtactaaagccagggatgactttttatgtacaattgactgcctagtagtgaccattcagaacagatgctgaatggtcctggagtcctctagacatctgaggatcccaaggggagtgtctggggaggccacggccctcaggagactgagggaagtggctatttatcaatcagttcgcttagactctgtgaaattggcaatattcaatcagttgccaaaaacagcaatttcacatgttgcaacctaatatttcagtgttttgacagccagttgaccattcccatgcattccagcataaaatcacctgcttaatccccagcccaggtgttatccatccagtcctatattccccacccacttcctctctctccagctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatgggggtgagttctctggctgatgggctacacagggggctggggtctcctggggaaccctggggcccaatgtgcatccaggaagcctctgtggggataggagtctgttgttcagtgtgccataataatattcctggattttggtaaattgaggtctacaggtcacacatcacaagtctgcaagggccaggccccaggcagctggtgctaagcttcagatgtagcataaagcctccacacactctgcctggcttttctaagtgcctcaaagcaagacttcatattcaggccccacagattgttgtagggaagatatgctgggagagagtcaagtactgtgctttaatgccttgcctttaaagccaggtttgggttccaagccctactctgactttgacagactttgggaaggctatttaacctttctagccctcagttttcccatctgtaagacaaggatagtgagtgctgacctgagattgccatctggattaaatgagttgacattagtaagcatatacaacagccctggagtgcggtggctcacgcctgtaatcccagcactttgggaggccaaggggggtggatcacaaggtcaggagtttgagaccagcttggccaacatggtgaaaccccgtctctagtaaaaatacaaaaattagccgggtgcggtggcgcatgcctgtaataccagctattcaggaggctgaggcaggagaatcatttgaaccaggaagtggagattgcagtgagccgagattgcatcattgcactccagcctgagtgacagagtaagactctgtctcaaaaaaaaaaaaaaaaaaaaaaaatgccagcctcggtgcctcacgcctgtaatcccagcactttgggaggctgaggtgggtggatcacctgaggtcaggagattgagaccagcctggtcaacgtggtgaaacctcgtctatactaaaaatacaaaaattagctgggcgtggttaatcccagctactcaggaggctgaggcaggagaatcacttgaacctgggaggcagaggttgcagtgagccgagatcgtgccactgcactccagcctgggtgacagagtgagactctgtctcaaaacaaacaaacaaacaaacaaacaaaaaacaaaaaaaacagcccctggaatctgataaatgccatgtacacttttttttttttttgagacggagtctagctcttgttgcccaggctggagtgcaatggcgcaatctcagctcaccgcaacatctgcctcccgggttcaagtgactctcctgcctcagcctcccaagaagctgggattacaggcatgcgccaccatgcctcggtaattttctattcttagtagggacagggtttctccatgttggccaggctggtctcaaactcctgacctcaggggattctgcccaccttggcctcccaaagtgctgggattacaggcgtgagccacggcatccggccttgtttttgtttctttaagagacaggatctcgctgtgttgccaaggctggcttcaaactcctgagctcaagtgatcttcctacctcagcctcctcagtagctgggaatgcaggcatgtgccaccacacctggccataagcacttttgtcatagttattgctgcccctgtgaatggtgaggggctctgcttggcagaagtagggctcctaggattccctggagctgcatttgcctgtgggtttgggagcttcttggatcatggttcttagcacatcatacagaagacacggagtccacaagatggcaggaccaccttcacctagtggcccagaccatggatccccactcatgcccttgggttttggcaaatggccatttattctgtaggagggtgaagtagatgcctggtaagactgtgataagtaatgcttgaattattagacgtgactctaacttattttaaaattgaggcataatttacctattgtaaaatgtacaaatcttaactattcagctcaatgatttgttacaatgcatccactcatctaatcaccacccaagacagaatgaggttccctcttgtcccctcccacaaggtaactgctcttctgacctctgtctccatggactaggtaccttgtgcttacatttcctgtaaatggaatcatgcgggatgtggtctgttgcttctggcatcctttgttctatattctgcctgtgagatttatccatgctgttgtgtgtatcagtactttgttcttttttattgctgtgtagtattccattatatgggtatattacaatttatccattcccctcctgatggacatttggattatttccagtttggggccattaggagtaaagctctaggaacattctttttttttttttttttttaattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgctcttaatccattcaaccctgagtggatacagcacatgtttcagagagcacagggttgggggtaaggtcaccgatcaacaggatcccaaggcagaagaatttttcttagtacagaacaaaatgaaaagtctcccaggtctacctctttctacacagacacggcaaccatccgatttctcaatcttttccccacctttcccccctttctattccacaaaaccgtcattgtcatcatggccccttctcaatgagctgttgggtacacctcccagacggggtggtggccgggcagaggggctcctcactttccagtaggcgcggccgggcagaggcgcccctcacctcccggacagggcggctggccgggcggggggctgacccccccacctccctcccggacggcgcggctggccgggcggggggctgatccccccacctccctcccggacggggcggctggccgggcggggggctgacccccccacctccctcccggacagagtggctggccgggcagaggggctcctcacttcccagcaggggcggccgggcagaggcgcccctcacttcccggatggggcggctggccgggcgaggggctgacccccccacctccctcccggacggggcggctggccgggcagagtggctcctcacttcccagtaggggcggccgggcagaggcgcccctcacttcccggacggggcggctggccgggctgggggctgacccccccacctccctcccggacggggcggctggccgggcggggggctgacccccccacctccctcccggaccaggtggctgctgggcggaggggctcctcacttctcagacagggcggctgccgggcggaggggctcctcacttctcagatggagcggttgccaggcagagggtctcctcacttctcagacggggcggccgggcagagacgctcctcacatcccggatggggcggccgggcagaggtgctccccacatctcagacgatgggcggcagggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggtggccaggcggagacgctcctcacttcccagacggggtggcggccgggcagaggctgcaatctcggcactttgggaggccaaggcaggctgctgggaggtggaggttgtagcgagccaagatcacgccactgcactccagcctgggcatcattgagcactgagtgaacgagactccgtctgcaatcccagcacctcgggaggccgaggctggtggatcactcgcggttaggagctggagaccagcccggccaacacagcgaaaccccgtctccactaacaaaatacgaaaaccagtcaggcgtggcggcgcgcgcctgcaatcgcaggcactcggcaagctgaggcaggagaatcaggcagggaggttgcagtgagccgagatggcagcagtaccgtccagcttcggctcggcatcagagggagaccgtggaaagagagggagagggagaccatggggagagggtgagggagagggagctctaggaacattcttgcatgtgattttggtacatgtatgcacttgcttctcttgagtaaatgatctaaatgtggaattgtcacatcacaggctggcatatgtttagttgtagtagaggctgagaaagtttcacccacgtacatgccagcaaggtaacagagtgccagtcgctctgcatcctctccaacacttggaattacctgttgtttcagtgttagccgttttgatgggtgtgtagggatgcctcactgtggtttatgaaatataaatgttctctgaaggagtggagggaccatcagctgacttcttccctgggtctctgggggctctgggacagacatgggtgcatccctgggttggaactgggaagcttctgctggcaactgaggccgctgaggaggcagagcctgatgggagggggctactcacctctgccttcctttgttcactcgcagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccgtgagtagctgccctgccctcctgagattcctcggcacacccggccactgccccggctgactcctgtgtggctctccccacagaaccctactcttatgacttccctgaggacgtggcccctgccctgggcacttccttctcccacatgcttggggccaccaatcccacccagaagacaaagggtgagtgtttgaggtggggtttctggttgagcagggtgctggatctgggccggagcaagggaggatgcaaccttcctggaggccaggagccttggtgggctcagccactgaaagggagggaggcagagaagctggacctgcttggcgagagcgcaggaaggaggtggggatctgaatcctccccttccacatttctccagaaagcctgggccgtaaaatccaaatccagcgctctggtcatctgaacctctacctgctcctggactgttcgcagagtgtgtcggaaaatgactttctcatcttcaaggagagcgcctccctcatggtggacagggtcaggaatcaggagtctgcctgcagcagaggccttcctgtgctcactatctctctctgtctccttcccctcctcagaaccccactcacagcccacctcctccaagaagtcttctcagattatactcatgccatgtaggaatcatgaattcaatttatacaatcataatttttattccacaagcactgttgggacactgtgctggggctgggcgacagcaaagatggaaaggctgaggtcttactttccaggaattcatcatctagaacagtggtctccacagaaaggtagtgagataacccacaggagtgaagcagaaaaatactggtgcccctgtggaataatttaaatcagattaataatttaatatttaataatttccttttaaaacttcaacattttgtgcaggctttaaaatgtgtgtgatagactgggcatggtggctagtgcctgtaatcccaacactttgggaggccgaggcaggtggatcacttgaggtcaggagtttgagaccagcctgaccaacatgatgaaaccctgtctatactaaaaatacaaaattagccacatgtgatggcgcacgcctgtaacccagctacttgggaggatgaggcaggagaatcgcttggatccgggaggtggaggttgcagtgggctgagatcacgccattgcactccagcctgggcaactagagcaaaactctgtctcaaaaaaataaataaaataaaataaaataaaataaaatatgtgtgatagaagtttggaagccactggtttaagttcctcgccagaactttgttttgtaattgtgcttttcacaatacttcatgtaacattatagatggttttccctcccagctacattttaaagagggcagtttctgtgctctcttgggactcaaaattaagtaactcattgcactgcgaggcggcaacacacaccagttggagcagtgattgagaatcatgtgacacattcagatcccacttccacctcctcctcatggtgtgatgggggaagggggacaaggcaacatacctcagtttccttatccataaaataggggtcatcatgcccctcacagggtggagtgaagagagtctgtcaaagagaaagatgttcaacaaaggtttcttccttagctgctgctgttccttatttttattattattattattattattatttttgagatagagtctctgtcacccaggctggagtacagtggtgcgatctcagctcactgcaaactttgcctcctgggttcaagtgattcttctgcctcagcctcctgagtagctgggattataggtgcttgccaccataccaggctaatttttgtatttttagtagagatgggttttgccatgttggtcaggctggtctcgaactcctgacctcaggtgatccacctgcctaaagtgttgggattcaggcatgagccaccgcgcccagcccctagcttcttcctaacagccatttcctagtgtctcccctggtccttgcctctgtcggtctcactccagtttctctgcctcctccagggccctttgtttgctctcttaccatctcccctttggcttcagggccctttacgctgcctctcacttgccccgcacagatcttcagctttgagatcaatgtgagcgttgccattatcacctttgcctcagagcccaaagtcctcatgtctgtcctgaacgacaactcccgggatatgactgaggtgatcagcagcctggaaaatgccaactataaaggtacgggtgtcatcacgtgatggtgatgagagaggagaagatggaccctctcagggcctgcaaacaaattctggatgagttaaaaagagagtgaggcctcttggtggcacctgagtcccacgagtctggggtagtttcaacgtccagggttatggtgggggagtccagctgcccccagctcatagctcattctgagatgctgcaggtccaaagacactgtgcaggtcttcaattccttccagttgccaaaaccacactgtctggtttgcatggctgcacactgccatctccccatgtcattagccacccatacaccatgtaaagtgcctggttggcacttagcaaatggctgaagccactcaaggttttggaaacctcatctttgaatcttgggactttagtgtggtcttggattggggttatgcaatgaacatttcttttttcttcttcttttttttttttttgaggtggagtctcgcactgtcacccaggcttgagtgcagtggcacgatcttggctcactgcaacctctgcctccagggttcaggcaattctcctgcctcagcttcccgagtagctgagatttcgggcacctgccaccatgcctggctaattttttatatttttagttgagatggggtttcactatgttggtcaggctggtctcgtgatcctgactttgtgatccgcccacctcagcctcccaaagtgctgggattacaggcgtgaaccaccttgcccggccctatgcaatgaacatttctaaggtggaaaggcttttaaagtttgaacaagcaatgatgccacatctctatctgaatggcaaatgtctgagtttatcaaaacaatcgataaattgcatttccaggccgggtgcagtggctcatgcctgtagtaatcccagcactttgggaggctgagatgggcggatcacttgaggtcaggaaaccagcttggccaacatggtgaaaccccatctctactaaaaatacaaaaaattagctgggcatggtggctggcacctgtaatcccagctacttgggagactgaggcatgagaatcacttgaactggggaggtggaggttgcagtcagccaagatcacgccactatactctagcctgggtggcagagcgagactctctcaaaaaaaaaaaaaaaattgcatttccaataattgggggaatagagtgattccctacccctaggtggtaggtgggaagtttctaagagagtccttccttttggcatattccagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggtgggtatcatggtctctgagtgtgtctggaatagtggaaggggcaccaatatggggtcagaagccctgaattctgattctccctctgcctgccactttgggccccagttttgtttttgtttttagagatggggccttgctatgttgcccagctgatctcaaactcctggcttcaagcaatcctcctgcctcagcctcccaaagtgctgggattacaggcatgagccaccacacctggcccagtttcttatttataaaatagggccagtgtggtggcttatgcctgtagtcccagcactttgggaggccaaagcgggtggatcacttgaggttaggagtttgagatcagactggctaacatggtgaaaccccgtctctactaaaaatacaaaaccattagctgggtgtggtggcaggcgcctgtaatcccagctacttgggaggctgaggcaggagaattgcttgaacctgggaggcagaggttgcagtgagccaagatcatgccactgcactccagcctgggtgacagaccaagatcctaccttgtctcaaaataaaataaataaataaatagaattagtgttgatgatgatgaccgtaaccacaatgacagcaatgatgatcatgatggctgtcctcctttccttacacaatttttatggaaagctatttaagttgcctgtgtgaaagtgctctgtgttagctcttgttaccatctgggaggtaacttggagatagatgaggaaacgtggctcttgagcaggaatgtcgaagggcacggatgcaaggaacagtctgtagtggatctggccttgtcatttgcctcttgctattgtccaaattacacagttcctccaggacttagtatataaaatgaggatacccactctacctggggtttcatgagaattaaatgagttaaagtataggaagcacctggcctggtgcctggaatgtagaacatttcagtaaaagtgtgtatatatatatatgtatgtatatatatatatatgtatacatacatatatatatatatatatttatttttttgagacagggtctcactctattgcccaggctggactacagtggtgcgatctcggctcactgcaacctctgcctcccaggctgaagcaattctcgtgcctcagcctccagagtagctgggactacaggcatgtgtcaccatgcctggctaatttttatttttattttttgagatggagtttcactcttgttgcccaggctggagtgcaatggcgcgatttcggctcaccgcaacctccgcctcccaggttcaagcgattctcctgcctcctgagtagctgggattacaggcatgtgccaccacacccggctaattttgtatatttagtagaggtgcggtttctccatgttggtcaagctggtctcaaactcccaacctcaggtgatccacctgccttggcctcccaaagtgctgggattacaggcatgagccaccatgcccggccacacctggctaattttttgtggttttagtagagacagggtttcaccatgttgcccaggctggtctggaactcctgagctcaggcaatccgccttcttcggtctcccaaagtgctaggattacaggtgtgagccaccatgcccagcctaaaagtatattttgaagctctcacaggcaatgtaaatgttgaggttcccaggctaaatgctttcctactcttccagggcctggggaaatcctgatattacctagaagaattctttattctctttgttctaggaaagtccaatatgggtggctctcccaagacagctgttgaccatatcagagagatcctgaacatcaaccagaagaggaatgactatctgggtgagcccctgccactgccaccacatttgttctgctcctgcagaggtcatgagatcttcagccagggatcccagcatcttagctatggtccagagccacatggttttatttctgcgttgttctgtacaaaggcaactcatgttgaagagcctggggtcaaactactgcccatggtctcaaccttaccttctttttttttttttttttttttaagacagtgtctcactgacactcagagtatattcctggaaagatgtccacccatgccggcccagaagctggtccagaaagtaacgatgtccaccatgccaccatgaagtgcagtggtgcaatcatagcttactgcagcctcaaattcctggtttcaagtgatcccctcaactcagcttcccaaagtggtaggattacaggtatgagccactatgctcagcccgtcttcacaaattttttaaaattaatttttaaattttttttgagacagaatcttgccgtgttgcccaggctggagtgcagtgactcgatctcaactcactgcaacctccacgtcctggcttcaaatgattctcctgcctcagcctccagagtagctgggattacaggtgtgtgccaccatgcccggctcatttttgcatttttaatagagacagagtttcaccatgttggcagtctggtgtcaaacccctggcctcaagtgatccgcctgccttggtctcccaaggtgctgggattacagataggcgtgagccactgtgcctggccaatttttaattttttaattattatttttaatcaacagctttagacagagaaccttggtttcatcttcagtgggctgtggccatgggcagtttcttcatctgcaaaaggggagtagtactaggacccagctcacaagctgacaggggaagatgctcagacaaacactgcctgcctggcatagaaaaatgcccagcatatgttagccatgaccacgaccgtcgtcgttatcatcatcatcatcatcatagcatctcatgtttcaggaaactttccaggaagaagggacctcgattccctctggggaatgtccctggtggttgctctttcagcagcacagctggctaactaaggctttggcagttgcagcctctaaaggaaaaattcctcaggttcagactaaacacaaattgcactgacctttgatcagaaagtaatttcagagagagagatgctcagacagggagggcagctggttttgagccccaacctttcatcttccccttagctcctctcctttccattcacactgccccctcccccatcacctggccctcgggggtaagctgattcctctttaaaactctggcccaaggaagacaaaatttaaagcccactcccttcctccttagcatcactggaccaaggtcaaatgctacaaaaacattttattgaaaataagcaggaaaccaaacgaaaatagtcaaagaaaacgcacaaggcacgatcgttgtctagctccaactgtaactgtttctatctgggccattgccagattgcctcctggctgaagatctcttggtccacctaagcaccttgctttttacacacaacgcggggctctctgagaacaaaaatgggccacaaggggtgcaaaggctgggagaggagtagactctgtggtctgtctgagggcagttctgactggcaccacagtcggaggacaggcgcggcctgttgtgtgggtccagggcctccagtgggaaaacgtggctttaggcccttctcccagatgctaccttttacagaggaagaccagatctgaggtttagtttccatgttgtgttctgagttctttctattcattcagtcatttaaaagtacttaccaaactaccacaaacctgggtggcttagaacacagaatttctttttcttacagttctggaggttagaagtctgaaatcaaggtgttggcagggccgtgcttcctcagaaggctcttgggaagaattctttcctgccttttccggctgccggcagctccaaccttggcttgcggcagcataaacccattctctgcctctgtcttcaactcgccttcttttctgtgtgtgcctctgtgtcattacatgctgttctcttatatagataggagacccactacctgtgtctttgtgtccaaattcctttcttctttttctgttcatttgtttgagacagagtctcgctctgtcacccagaagcccaggctgcagtgcagtggcgggatcccggctcactgtaacctctgcctcctgggttcaggtgattctcgtgcctcagtctcccaagaagctgggattacaggcatgtgccaccatgcccggcaaatttttgtatttttagtagagacatggtctcgccatgttggctaggctggtcttaaactcctggcctcaaggcgatctgcctgccttcgcctcaaaaaaactgccgggattacaggcatgagtcaccaccatgcccagccagttcacttttttttttttttttttttttgagatggagtcttgctctgttgcccaggctggagtgcagtggtgcaatctcggctcactgcaacatccgcctcccggttcaagcgattctcctgcctcagcctcctgagtagctgggattacaggtgtgtgccagcatgtctggctaatttttgtatttttagtagagacagggtttcaccatgttggtcaggctggtcttgaattcctgacctcgtgatctgcccgcctcagcctcccagagtgctgggattacaggtgtgagccaccgtgcccggctcacctcttctttttttttttttgagacggggttttgctcttgttgcccaggctggagtgcaatggcgcgatcttggctcaccacaaccaccgcctcctggtgattacaggtgtgagccaccacgcctggctctggcttacctcttcttataaggacctcagtcattggattagagctcaccctaatctagtatgacttaatcttaacttgattacatctgcaaagaccctttttccaaataaagtcacagatactggggattaggactcgaacacatctttctgggggacacaattccaccattacagggaataaacaggataagaaaaccatagaacccagcaggtggtaggtgacacaagctaaggggtgttgccatgttgcccaggctggtctcaaacttctggcttcaagggatcctcccaccttgcctcccaaagtggggatgaaagtttgtctggggcattgcagttttagacaggaagaccagggaaggcctcactgagaaggtgacatttgagccaagacttaaaaaggtacgaaagtgagccatgtggaagtctgggggggaggagtgaactaggcagaggcacagctgggcaaagggcctgaggtgtgaccatgcctatggatttgaggaacttcaaagaggctgtgtgctgcaggagagtgaagggcagggagtggcaggaaatgaaggcagacaggtagcagtggggaggacgcaggggtccagctcatgtaggtcttgattggacacagtgagtttcagatgacagcctcctgtctcatggggtagccccaaagccacaggagtctggtgatttccctcttccccaccagacatctatgccatcggggtgggcaagctggatgtggactggagagaactgaatgagctagggtccaagaaggatggtgagaggcatgccttcattctgcaggacacaaaggctctgcaccaggtctttgaacatatgctgggtgagtgagctttgccctccttggtgtggggaggatggtgaggagcccgccagaggcccgtgttgggaacctggacacagtgcccctcacttgcctccttccccatctgatcctcacacccacagatgtctccaagctcacagacaccatctgcggggtggggaacatgtcagcaaacgcctctgaccaggagaggacaccctggcatgtcactattaaggtaccaggaaggaggggcagggcttggattccagaggtaaaagcggccatgggccagacatactgcaatctctgaaaatcacctgttcccctgcagcccaagagccaagagacctgccggggggccctcatctccgaccaatgggtcctgacagcagctcattgcttccgcgatggcaacgaccactccctgtggagggtcaatgtgggtaaggcaggggatgcaccagcctcctgatcctgaagccacagatcctaccacctcacccagcctctggcccctgcaggagccctggtctagcctaatctagtgtatcatttccaggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggtgcctggagtctgggatgggagggtgccctgcagggaagagtgctctggagatccctggaagagatactggggacaggctggtgtgacccttgctcttctccccaggcccatctgccttccctgcacgatggaggccaatctggctctgcggagacctcaaggcagcacctgtagggaccatggtgagtgctgggacttatggtgcttgagagctggggccggggtttgggggtgataacaaggactaggctgcagtccccaagccaggaacctggattctgggtaaaaggaccagcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 2357 - DNA, 47888 bp, Homo sapiens
  source 1..47888: mol_type = genomic DNA
cattttcccctgagagcggcctcggagatggctgtgactgtcctaagctgggagctgcaagggagaattcctgtcattcctggcctcagttctgcagggaccgagggcgagacacgcctgggcccaggtgtggcgtctctgtccccatctggttttaggtaacaagcggagcttctgaacttctcggctctcggcagcggctgtatttcctctggcctggttgggcttttcccgcctctggttgcttttctgcctttctagtttttgggttaccagatagaaggcttggcctcagttttggcctcgcctttttgctctttctaacgagcacgaaggggcgatagggacgcggaggacacctttattcttggctggttctagcatgctgcttcatgtcccctggagcagcgtgcccttctgaaaacctgtggctaaatgtctcttctgtttatatcaggcgtgttacaccttcacacgcactagggatccaggtaagcccagcggcccgaacgtcattactgactggtgacactgcagtaagtaaaccttttttgccgaacacttcataagcacagtcaggtactccgtgggtcatagcccagcggacaatttaagtataaatgatatacaccaagatagacaatctcgatagctgtatttagggtaccatccctttaggtattacgttttggtcgagtttggaaaagatctgtatgatttcacacgcagtatttgacacaggcaggtggggcacctgaggccaattaaaggccttctgggaactgtagttctctttggttaactattccagagctttctgggaattgtagttttccctgcaccttaatccaaacttagctttttttttttttttttagctttcctgaagacatgacctatttaccccagacaaaatatgaccaaacagactcctgcttacaatttccgtgggcaggttggccacctgtagctcatccctagcactgatcctaagtccctcaaatagagttcatgtgcatccccacgactgccaatcacttgtactgtgaggtacctggctaagtgttgagattgcagaactggtggagggctgggggtggggacttgggggagtccctgaccagaggagctcacttgtcacactcctctcccatgtttagggctgggctccttcaggcaagggatatgcagagttgtgacctctaggtattaagaacgcagcatcacagggagaggctgtctagggcaggatagtcatgtacacgcagttgccagagtgtaaaggaaaaaaaaaagtttttttttgttttttattttgtggaaaacaaaagcagaaaaactaaaaccccaaactccagaaaaaatcctaaaaaatatgttttttcttaaaaaatactgtatgtctctactcctctccctccctcccaacagcccttcttgtgttctttcttttctaagtgccctatcccccccacccccatgactatccattgtttcttgctattgtacccccacttcccaatatctacccaggatgcgcaccccacgttctcttacctggcgtcttactttgttctccctcaaatttcagcaagcctcatactcgcagtctcatttccccagcatgcaagaactgtctcccacttccttttctgggactcagtaatcttttccccttaccactccctcaccccaggtctattctaagcaggagcatgtcctcctgccaaattccctccctgttcccacccaccccccaacccttcttatctcgagaaatgtcagaaccttcccctgggcagccttagccaggaataaaacatttttgtcttccctcattctataggacccttttccctccctccacatatacatgcacttctaagagaaggaaatctttctctgggaccccgtattcccctggcctccaagaacccttttcccagctccagattcttgcactctcaagagcaagtctctccaaggaatcatcttccctctctcaggatgtgtgcatctgctcagcctcccactcttacctttctgccccagaccccccaccccccaattctcctgggccaaagagccctttttccacgcagcccaggggccccagcctcctggcctccacgcctgcgcggctagcggatgaggacgttaatctcggccacactggcctccagcacgttctcggccgtggtcttgccgtgttgctccttgaggtgccgcctaatggcaggcttgtgggcgaagcgcacgtcgcagtaggagcagcggtagggccgcgctcccgagtgcaggttgaggtggtcgtgaagggtggacttctgtgtgaagcacttgccgcagatgccgcacgagtgtgacttgacaccacgatgcacgttcatgtggcggttgaggttgctgctgtggttgaactgcttgccacagcgagggcacatgaagatgaagtgctgcgcccgcatgtggaagaccagcttctccacgccctggaacacttccgggcacttggtgcacttgatgttctttaaggggtttccacctgagaagcccccaggcaggggtccccggctgccccccgcccccaggctgccccccgccccccgggcagccatggccaccgctgctgcttccaccaggcccgaggtggcccccacgctggcccggcctccgggaatcaacagcaggccctccccttctgcatcttccgacaggctatagcaggccttcaccacaccctgcggtggggctacagtgctggggggaacgctgctctgggccagctccccaaggtggccacccacggagcctccaatgcccagaccccctcccaggcctccagggggtttgagccggtgtgccacctccagggccgactccaccttgacgatgcagatgtcagacacgtcctcatcctcatcctcatcctcttcctcggctttcagctccaagtcttcatccagtgggaactccagcttcactggccgcaggagtggagggggtagaggaggtgggggtgggggcttcggggctggctttggggtcctggctggagggaggagggacttggtggcgctgatgctgctcacaaggctagcctcactgaccccatcctctttgaggcctattttgggctcaatgaactggctgagggcattccggcatttctccaccacgtgctccatctgcaggtaggaggcggctgtaaggtagttgacgatgtccctaacagcgaattccaaggcgcccgtgtagcaggagaggagcaagtcggccacgatgcgtgcactgtgcatcagggagacctgcagctccgagctggggttcagcaggaactggtcccgcaggaagggtgagcaggcggccaagatgaccttgtggcctcgaaacttgaggctgtcggccacaatggtcacgtcgcagaaccgctcctctgcccggagctggttcatgttccgtagcgttgcggcctcgtggccgggcagctggaagcgcaggacttccaccccagaggccattgtggcgggggtgggcaaccctggttgggaaggaaaccggtcagagacaaaggtctctggctctccgaagccaaggctccaggaccctcgcccccattcttgcccagccccccggcatccgatctcccggtcttcagatttcttcctcagtttccccaaccctggggaggtgctgtccctctgagaggagggaggcgtggttctcgggggcggggcagcggcgtccacaccccccagcccagcagcccgctaggatggggcgagcccgcgcgcccacggtggaaggacggagaaaaaggggggccagaggcctggggctctggactccaaggtggccccggttgcaggctcttctcaccccgccccctttaccggctgcctcattcctccgccccccccttacacgtttgcacgcgcttttcacgtcctcccccccgccgccagcacgcaccgtgcacgccctgcccccacgctcagagctccgtggcacgcccccccagccccacgaccctgagtgcacgctcctctcacctggcccggttccgcgcgctgtttttttaatcccttattttccccacccccccccggggccggcagcgacccccacacacgggcagggcctgggcagcgcgcaggcgcggggatgcacgggacgcgcgcgcgcgcggggccggctccgcgtgggcgtaaggggggaggggcgggggcggctcgtgccgtgtgttccaggccccgcgcgcgcggcggcggcggcgtcggctaggactcggggaggaggaagaggggagggaattaaaggagcaggatccccccttcccgacccccctttcttcaccagcacccccacgcggttaaagggccggacggccttgcctcctctttggccgggattatttgtccgccagagcggaaatacgttccacacccccctctttctcgctccccctcctctgtacctccaagccccgcggccagtttgcgcgtgcgtgccaagtgccgcgcggaggcccgctcactcgggcccgccccccaatcccggctgcccatggcgctactcgctccgcgtccccgcgccccgcccgcgccgcatcccgcagcgcgcgcgcgcacccgttctctcggctgcgggcgctgccacctgctcccaggggtggtgcgtctccggtccagctgtgccgagcgctgccctgggtgcatccgtggcacctctcagggccccatccgccccgtggctaacagagctgttggtagctattacccacgcctgcctcctctgctgagtgtgctcacagttgctccagacacattcccaggcttttccaactcttgtaaagctagtaaccgcctcagcccttcaggcctgaaatatgatttcactttccacaaagccagacgatccagtgccctcaactttcctccactccatgtcagtcctttaaaatcacacccgccctcccctccattctcaggattgatcccaacttcttgccaaggcagtcgccctccgcttgtgctatcgatgaccttgcccatttcacctttagtatataattaaccctaggactaattttaatgatgtgatttattatgttagtatgattctactctaatcttccaccgctccgtcccccttattcctcacctctcctccagactgacaaggtccagctctaaacaaaacttcccttcaacactgcgcccgggccttctctttctcttgtctctctcagactaagttatagtctccacagcttcagcgacagcacttaggagcgtcttgaaggctggtgccttcccttccacttcctcgtacctacacccacttccccacctatccaagtccgcgtgaagatgccactgtttcctgccaattggatttcttttttacgtccttcaggagactagtgcgttttccatacatttcaattctgatgaagtttcttattatgtgttcaatatctggtttccccattagactataaacttcttggttgcaggaattatgttgtgggttttgttttgcaaataaaaatcatgcaatagggagggtgtggtggctcacgcctgtaatcccagcactgtgggaggccgaggcaggtggatcacctgaggtcaggagttcgagaccagcctggccaacatggtgaaaccctgactctactaaatatacaaaaattagctggacgtggtggcaggtgcctgtaatcccagctactggggaggctgaggcaggagaatcgcttgaacctgggaggtgaaggttgcagtgagcctagattgcgccattgcactccagcctgggcgacagagcaagactccttctcaaaacaaaacaccaaaaaaggtcatgcaacaaatgattgttgaagtaattcctctttggctcagccagcatccacccataaaaagtttgttcttgagctgaaactgaattcttgaactcaagggatgctgtttggcaggagggtggaggcagcgtagacagtgtttaggtggtaccttgactttttgcctttttcttttaaattctctgatttgtatgcccgcacccagttccctctgttgaatctaagagtctgttctaaactgctctctttgtatttaggccttgtagatttgaggaagaacacctgattttgtgtcagacgcacctaggcttaaagccacattcctaggagtttctgagcctactctggctcagaaggctgccagattcgcaaatcattaaaaaaataaaataaaagccctattcctgtaccaaatgaggcccactgggcaagttacttaattctctgaatcacagtgtccttatctttgtctcccccgcccatccttagctcatctgaaagcatttttatcttgaaggccctgatctctcacagggctaatgtgaggtttaaatgagcctggcatgcagtagttgctgagtaaacaatagctctgttctccttttcctaatctgggaaacggactatgaaattttcaaaagaattttattttattttaattaattaattaatttatttagctggagttttgctcttgtcacccaggctggagtgcaatagcacgatcttggctcactgcaacctccgcttcccaggttcaagtgattctcctgcctcaacctcccaagtagctgggattacaggtgcccgccaccatgcctagctaattttcgcatttttagtagagacggggtttcaccatgttggccaggctggtctcgaactcctgacctcgggtgatccaccttgctcagcctcccaaagtgttgggattacaggcgtgagccactgcgcctgacccaaaagaactttaaaaattctgtttttctatctcatctcttcttttccgcattgccaaacttctcagaagaatagttcacattccagtgagagcagaaatacaaaaagctgtcaagttaagaattagagtttgtaaaattttgtttcttgtccctttcttgctacttttcctttctaggaatgtagatgggacagggggcctaactcagcccatggctcaagacaggtagtccttggtggcaggtggagttgacagccaatgaatccttcaagtgtccagcccacccagttacaactctgcgtaaaaacaagcagaggtgcacaaactcttttccatgtagtctggtggagagatgatgtggagccatttcccatgcatcccatccagggggtttacaatcatctagatccttgtcccttcttccccaacttctgccagtataaaaccaggggctttcctgtccttagcttgcagtaccaaatgccttggtgtggtgtcaagaacagataaatttaggagatacttttaggatttttgggtcaggctcaatggttcattcctgtaatcccagcactttgggaggccgaggcaggaggatcccttgagcccagcagtttgagaccagtctgggcaacatagcaagaccccatctctacaaataataagaaaattagcagggcatgatggtgtgtatgtgcttgggatcccagttacatgagaggctgaggtgggaggactgcttaagcccaggcagttgaggctgcagtgaaccatgatagtgccactgtactccagcctgggcaacagaatgagaccctgtcttttaaaaaaaaaattaggattcttagtgagctttagaaataaaatctgggctgggcactgtggcttatgcctgtaatcccagcactttgggaagctgaggtgggaggatcacttaaggccgggagtttgagaccagcctgggcaacaaagcgagacacctgtctcaaaaataataaaataataaataaaagtaaatacattttttaaaggaaataaaatttgactagggatgcaaggaataactaggagacaaaaggtccaggttccagtccatcttgaagtcatcaaggctccccaggtttcagtattctctttaataaaatggagggattactctctgaagtattttccagtcctatgagtccatagcagcttactttgaaaaggggtgtttatgtttgtgggcatctctgagagaagctagctcacagcttagagcactacccttggctactcatagaggtaaggagtggccttgataatccaaaaccgtagcaaacattggacatttgtctaagacattcaaagtattttaggctgtgggcttactttttacaacgatgcttagcacgtactagaataaccatatttcctgagcaatctataggaaaggaagaggtaagtcagcctggacttttaaatccataggctgatgaaactgtcttacattacaacaaaacctccaacttctttctctttctcctttgatctgcactcagctctgccctcagcgcaggaaccctggtaaaaactgcaggatgttttggcaatgttggaaggggcttactgcttggggaaagaagccatgtgaaaacaaagtgcctgcaccactcccatccatctgcaaaaccaccttttctgaactcccatccatcccccttgactgctcctcaatgctggctcctcctccttcttcagagctccttatccctagctcttcggagccctctcccagcctcaacctgcctccagacaaactcttccctccccctcctacctcggagggaatttactccctgcagcccaccacctttgccatcgtccaagtcctccacacacccttgctgactctgcccagatccaggtctatctggggaaatggaggcagattctcccagcaccttgtgaattccagacagaaaaagactcttccacttctcgacaaatattctatcctctgagcctcaccaagtctgctctgctaccctatgtcatccttgctgcttgagcaactgactttcgggcctgtgatacctgcctggatcaggttgtcctccccaggcctgcctgtgtccctgcaaatgacctaatccatatcccaagtttaaaaaaaaaattgttcattttatttttttcatggagtcattcgtgagagcagaaatacaaaaagctgtcaagttaagaattagagtttgtagggccgggtgcagtggctcacacctgtaatcgcagcactttgggaggctgaggtggccggatcatttgaggtcagaagtttgagaacagcctggccaacatggtgaaacctcgtttctactgaaaatgcaaaaaaaattagctgggcgtggtggtgcatgcctgtaatcccagctactcaggaggctgacgcaggagaattgcttgaacctgggaggcagaggttgcagtgagttgagatcacgccactgcactccagcctgggtgacaagagtgaaactctgtcttaaaaaaaaaaaaagcaaaataaaagcattagagtttgtaaaattttgtttacaaactcaaaattcaaagttcaaaattcaaaatgtagttttgttcaaaattcaaaatgtgtaagtacaattccaaattcaaattgtaaagttttgttcaaaatttaaaaaatataagagggtacaaggctgggtgtggtggcttacgcctgtaaactcagcacttttgggaagccaagggaagaggatcacttgaaaccagcctgggcaacaaggcaaaacccagtctcagaaaaaaaaaaaatagctgtgggaggtggtgttgcctgtggtcgcagctattcaacaggctgaagtgggaggattgattcagcccagggaggagaaggctgcagtgagccttgttcgcactgctgcactccagcttgggtgatggcgcaagaccctgtcaaaaaaaaaaaaaaaaaaaaaaaaagtggtttcttttgctcaggctggagtacagtggtgcaaagaaggctcactgcagcctcgaccttcctggactaatttatttatttattttttagacagagtcttgctctgtcgccaggctggggtgcagtggcacaatctcggcttactgcaacctccacctaccaggttcaagtgattctcctgcctcagcctctggagtagctgggactacaggcgtgcgctaccacttctggcttttttttttttttttttttttgagatggagtttcgcccttgttgcccaggctggagtgcaatggtacaatctcagctcactgcaacctctgcttcccaggttcaagcaattctcctgcctcagcctcctgagtagctaggattacggacgtctgccaccacgcccagctaatgttttgtatttttagtagagatggggtttcaccatgttggccaggctggtcttgaactcctgacctcatgatccgcccacctcagcctcccaaagtgctgggattacaggcatgagccgcagcacccggccattttttttttttttttaattaaaagtggcaagactgggtcttcccgtgttgcccagtcattgatcttgaattcttgggttcaagtgatactcctgccttggcctcccaaagtgttgagtctacaggcatgagccaccgtgctcggcccagataaatctttttataaaagttagagtcagtagatacagcaaatttcattgttgtcttattttaagaaattgttggctgggtggggtgactcactcctgtaatcccagcactttgggaggctgaggtgggcggatcacctgaggtcaggagttcgaggccagcctgggccaacatggtgaaacccaatctctactaaaaacacaaaaattagctgggtgtggtgggggtgcctgtagtcccagccacttgggaggctgaggcaggagaattgcttgaacccaggagatggaggttgtaatgagccgagattgcaccactccactccagcctgggtgacagcatgagacttcatctcaaaaaaaaaaaaaagaaaaaaagaaattgtcaaagccatcccaaccttcagcaaccaccaccctaatcagtcagcagctatcgatatcaagataaaatcctccaccagcaaaaatgttacaactcactaaagactcagatgactgttagcattttttagcaatacagtattttaaaattaaggttacatacattgtttttagacgtatgctattgcacactgaatagactacagtacagtgtaaacataacttgtgtgcactgggaaaccaaaaagttgttgatatgactggctttattgaggggatctggaacgaagcccaaaatatctctgaggtatgaccgtgtatacttcatttgcttattgtaatagtttcagtatctatgcagttgtaggttttcccggacagtttagttttgtctgtttgaccatcacacagatgaatcatactgtacatgttctggggctggccttttcactcaacattatggttttgttgacttgtgtagctgtaattcattcattgtcttttaattggatgcttatactagaatttgtttgtatacctatttacagttcttttggatatatacctaggagtggaactgttggattatatggcaattatatgttaaatttttaacgtattattattattatttttttttagacaggatctctgttgaccagactggaatgcagtggtgtgatcttggctcactgcaacctccacctcccaggcttagcctcccgccttagcctcccgagtagctaggactacaggtatgcaccaccatgcctggctaatttttgcatttttgtagaaacagggtttcaccatgttgctcaggctggtctggaactcctgagctcaagggatccgcctgccttggcctcccaaattgttgagattataggcgtgagccatggcatttgctcccccgcccacctctttttttttttttgtagagatgaagtcttgctgtgtttcccaggctggtctcgaactgctaggctcaagcgatcctccagccttagcttcccaaattcctctcagcctgggatcacaggcgtgagccactgtgcccaccctatatgttaaaccttttgaggaactgccaaactgttttccacagcagctgcaccattttatgttcccaccaggagattgtacacaagcttcaatttctccatatccttgccaacagttgttattttctgtttttttttgttttttgtttttttttgagacagcgtctcactctgttgccccggctagagtacagtggtgcgatcttggctcactgcaacctctgcctcccgggttcaagggattctcctgcctcagcctcctgagtagctgggactacagtcacgcgccaccacgcctggctaatttttgtatttatagtagagatggggtttcaccatattggccaggctggtctcgaactcctgaccttgtgatccgcccacctcagcctcccaaagtgctgggattacagacgtgagccaccgcgcctggcttgtttttttttttaaatagacattctagttgatatgaagttgtactcattatagttttattttcatttacttaatgactaatgatgttgagcatcttttcatgtccttgttggccatttgtgtgtcttctctggagaaatatctattcaagtcctttgctcatttttttttttttgacaaggtctcactctgttgcccaggctggaatgcacaatcatgactcactgcaggcttgacctccccaggaacaggtgatcctcccacctcagcctccagagtagctaggactacaggcacacgccaccacacccagctaatttttgttatttgttgtagagacagggttttgccatgttgctcaggcttagaaggctttcaagcacaaaatgtattacattaggataatgtcttgggggtagaaatagaactatgaaaataagaattcagaagaaatagaacaatgtgaaatttctgactgttaaagaagattataatcatgtactttaaaaatgaatcatgagcccagcacggtggcccacacctgtaatcccagcactttgggaggctgaggcagatgaatcacttgaggtcaggagttcaagaccagcctggccaacatgatgaaaccccatctctactaaaaatacaaaaattagccaggcgtggtggcgcatgcctgtaatcccagctactcgggaggctgaggcaggataatctcttgaacccgggaggcagaggttgcagtgagccgagatcgtgccactgcactccagcctgggtgacagagcaagcttccatcttaaaaataaaataaaaaataaataaataaaatgaattgggctgggtgtggtggctcatgcctgtaatcccagcactttgggagaccaaagcgggtggatcacctgaagtcaggagttcgagaccagcctgagcaacaaggtgaaaccccgtctctactaaaaatacgaaaattagccagacgtggtggcaggcacctgtagtcccagctactcgagaggtggaggcaggagaattgctggaacctgggaggcggaggttgcagtgagccgagatggcgccactgcactccagcctaggagacagagggagactcttgtctcaaaaaataaacaaataaatacataaaaaaaaaaataaaatgaatcatgaagggaatggttaaaaagtgaaataagacttttaaaaaaagatccatgtttacaacacactggaatggcattcttttgcaactaaacatttggggaaagttttagatagcagcataaaaacatgcaaggggtacataatttgcaaaattcttttaatgtgagcaaaagggtttgaagattacatgcttcttgaaatcagcatgcacatgagtcatctggagttttaattcggagtctgagtcagtaggtctgggtggggcctgagattctgtgtttctttctttttttttttttctctctcttttttttttgagacagagtctcgctctgttgcccaggctggagtgcagtggcacactgcagcctccgcctcccgggttcaagcaattctcctgcctcagcctcccaagtagctgggactacaggcacatgccaccacgcctggctaatttttgtatttttagtagaaatggggtttcaccatgttggccaagctggtctcgcactcctgacctcaggtgatttgcccgcctcagcctcccaaagtgctgagattacaggcatgagccaccatgtctggccctttttttttttttttttttccaatttgagaccgggtcactacgttgccaaggctggtctctaactcctgggctcaagcgatccgcccactgcagtctcccaaagtgctgggattacaggcgttgagccaccgtgcctggccagattctgcatttctacaagttcctgctgatgctgatgctgtctgtctgtggaccacagtctgagtagcaagcatccacatattcgtaagagtggagttgctggatgttgaggtctgcacctgttcagcttccctgctaatgctaaactattttctgaagcagttgtacaccagccatgagactgttgcttcttgggaaaaaagatataaaggcttcaaatttaatggatattattcagtgctcctcttacttgagctttctgcagtctgtgacatacttgaccacactgtttgatccactgcttttccctggtttccatgacacccctgtatccaggctcccttccttctataatttcagtctgttctataaaccctcactcctttcctgtcttgaccttttcctctgttgatgcctttggccttctaggcctttatctcattctctctgggtggtaccatgtgctctttagagattggttaccaggccgggcacggtggctcacacctgtaatccgagcactttgggaggctgaggcaggtggatcacctgaggtcaggagttcgagaccagtctggccaacatggtgaaaccctgtctctactgaaaatacaaaaaattaaccagggtgatggtgtgtgcctgtaatcccagctactcaggaggctgaggcaggagaatcgcttgaacctgggaggcagaggctgcagtgagctgagatcatatcactacactccagcctgagtgacagagcgggactctatctcaaaaaagaaaaaaaaaaaaaaagagattggttaccacattgatgactctgtgatggttaattttatgtgtcaggccaagcgcagtggctcacgcctgtaatcccagcactttaggagggcaaggtgggaggattacttgagcccaggatttcaagaccactctgggtaagatggtgaaaccctgtttccacaaaaaaaaaaaaaaaaaaaaaaagatgtgtcaatttggcaaggctatggtgcccttgggcactgtatatatacacatttgcattattatttatcttaatgagatagactctcactatgttctccaggctgaacttgaactcccagtctcaagtgattctcctgcctcagcctcctgggtatctgggactacaagcatgccaccatgcctgactgtagtctggatacttcagtgagggcattttgtagataacactgacatcttggctgggcacagtggctcacgccagtaattggagcactttgggaggccaaggtgggcagatcacctgaggtgaggagttcgcgaccagcctggccaacatggtgaaccgctatctctactaaaaatacaaaaattagctgggtgtggtggcaggcacctgtaatcccagctagttgggaggctgaggcacaagaatcatttgaacctggaaggcagaggttacagtgagctgagaccgtgccattgcactccagtctgggcaagtctgggcaacaaaagcgaaactccatctcaaaaaaataaaacgaagcaaagacattgccatctatactcagctgacgttaagtaaaggagtttactcttttttttttgagatggagtctcattctgtcaccctggctggagtgtagtggcgtgatctcggctcactgcaacctccgcctcctgggtgtaagcaattctcccgcctcaggctcccgtgtagctgggactacaggcaccacacccggctaatttttgtatttttagtagagacaggatttcactatgttggccaggctggtcttgaactcatgacctcgtgatctgcccgccttggcctccagaagtgctgggattacaggcatgagccaccgtgcctggcccttttttttttaagacggaatctcgctctgtcacccaggcgcgatcttggctcactgcaacctgcgatccgactccctggttcaagtgattgtcctgcctcagcctcccaagtagctgagattacaggcacatgccaacacgcccagttaagttttgtattcaccgtgtttcactatgttggccaggatggtctcaatctcatgaccttgtgatccgcctgcctcggcctctcaaagtgctgggatttcaggtgtgagccaccacgcccagccaggagattactcttgatattgtggcctaaagagcaaagacttaggtttcccagagaaggaattctgcctcaagactgtcacatagaaatcctgcctgagtggccgggcgcggtggctcactcctgtaatcccagcactttgggaggccgaggtgggcggatcatgaggtcaggagttcgagaccagcctggccaatatggtgaaaccccatctctactaaaaatacaaaaattagctgggcgtagtggtgtatgcctgtagtcccagctacttgggaggctgaggcagaagaatcgcttgaacctaggaggcagaggttgcagtgagccgagatcgtgccactgcactccagcctgggcaacagagtgagactccgtctcaaaaaaaaaaaagaagactatagttaatgaacaagcaatcggccgggcgcggtggttcacgcctgtaatcccagcactgtgggaggccgagacgggtggatcacgaggtcaggagatggagaccatcctggctaacacggtgaaaccccgtctctactaaaaatacaaaaaaattagccaggcgtggtggcaggcgcctgtagtcccagctacttgggaggctgaggcaggagaatggcgtgaacccgggaggcggagcttgcagtgagccaagatcacaccactgcactccagcctgggcgacagagcaagactccatcacaacaacaacaacaacaacaaaaacaatgaacaagcagtcatggtgcaatgtgataagacacccaggtgttctgagagtcagaggagggctcaggggccccgtggtctatgcctcaacgttggtgctggctttcccttcctcatttctgtgcttgcttttagcccctgttgtcttgccaggactctaaatgtctcttaactggtcttccagcccctacatactgattccagaataatatttctgaaatgcaaatcaaatcatatcacttccttatctaaaattccatatagcaaatcgccttacaagctgtaaatgctgtttcttccataaggcattctctccttcctccctggtctagtgtcattgtggccttccttccctccccagccctgaaaggtcctgaacttgcagttcctttaatgcgctctggggtttcattgctcacctggatgcttgcatctcttccttgtcaggtaaacactcatcttttaaggctatctcaagttcattgatgaaacctttctgatcttctagagagacctaatattcccctgtttgtgtccctgtgaactttatatggactcctatctcagcttgtatcagtcaggatggctacatcatgctgcagtaacaaacaaccctggaatctcagtagcttaacacaacagttttatttctcactattgctctctgttgggtcagtaggagtgttagagtctctgatcatcatagtcactcaggcatccagatcaaaggaggctccatcaaaagagggtgctggagtgtcttgtgttacattggcagttaaatacttgtgcctgacagtaacaacacatgtgacttctgctcttatttcactggccaaagcaagccagttaggcctcttgcagtggcctaacttcaggagggctgaggaattccatcctatcatgtgcctggaaggcagaaaacgggaaaattcatgaagagcctcaatggctgcctcaactcggtgtagcgctgactggctcacatatctctctcccactggacagtgggggaaccaaacgtgtcacagcgttcctaccctttagcagtttgtgctccaggaatgtggagagaccagtatatggatggattataactctgtgttaatgttacagtctgggtttgctggcgtggaaggagtttgtggaagaagggcagtagtttatagggagaggaggatggaaagggatgatcttaattttggtgaccctgacagcagagcttgagacaggacttggccataggtagttaatttaggtgatcccagaaagcagaagcgaggctatagggagtgtgagatcctgaaggaggaaaggccagtttaagagaatgatgttggccgggtatggtggctcacgcctgtaatcccagcactttgggaggctgaggtgggtggatcacctgaggtcaggagttcgagaccagcctggccaacacgacgaaaccctgtctctactaaaattgcaaaaattagcctggcgtggtggcatgtgcctgtcatcccagctatttgggaggctgaggcaggagaattgcttgaacctgggaggcggaggttgcggtgagcagagattgcaccattgcactccagcctgggcaacagagtgagactccgtctcaaaaaaaaaaaaaaaaaaaagagtgatgtcactgttgtgtgcagtggagttcgattcccccaggccctcctgaggagagagctgaatgtctccagacgctttccacctgaaggacaggaggcaggagcatctgtctactgcttcccactctgcaataattgcaggttgactctgggcattagttctctgcccttttttttttttttttttgagacagagttttgctccttttgcccaggctggagttgtagtgagctgagatagcgccactgtactccagcctgggtgacagggcgagactccatctcaacaaaaaaaaaaaaaaaaaaaaggctggctgtggtggctcatgtctgtaatctgagcactttgggaggccgaggcgggtggattacctgagatcatgaatttgagaccagcctggcaaacatggtgaaacctcgtctctactaaaaatacaaaaattagccggcgtgctggtgggcacttgtaatccgagctacttgggaggctgaggcaggagaatcgcttgaacccaggaggcggaggttgcagtgagccaagacggcaccactgcactccagcctgggtgacagagtgagactctgtctcagaaaaaaaaaaaaaaagaaaaaaattatgatacagagaacaatgagatgttttataaatttatagttcaaaagaaacattttattttggtaaaagccaagaagtgaaagataaatagttttgcagccataaaaaaaaaaaattaaatcatgtcctttgcagcaacatggatggagctggaggacagaatcctaaatgaattagcgtaggaacagaaaaccaaatgcctaatgttctcacttataacggaactaaatattgagcacatatggacataaatataggaacaatagacactgaagactactagaaggggagagagggagggagtgtgggttaaaaaattacctaattggttctatgactacctagtgcaatatacccatgtaacaaacctgcacctgtaccccctgtatctaaaataaaagttggaattttaaaaaaagaaaaaaaggccaggcgcggtggctcatgcctgtaatcccagcactttgggaggctgaggtaggcggatcacctgaggccaggagttggagaccagcctggccaacatggtgaaaccccgtctctactaaaaatgcaaaaattagctgggcgtggtgtcagccgtttgtaatcccagctacttgggaggctgaggcaggagaattgcttgaacccgggaggcggaggttgcagtgagccgagatcacgccattgcactccagcctgggtgacacaaagagactctatctgaaaaaaagagaaagaaaatgtgctcttatgtaagtgagaaatgttctgaaaaaagaaaaaagagaaatattttaaaatgaaaaatttgagcttttccgtaaaaaaatttttaatgaattcccagcactttgggaggcctaggttggaggattgcttgaggctagttcaagaccagcctggaaaacatagcaagacctcatctctaattaaagtaaacaattaaaaaaaacttagcctggtatgatggcatatgcctgtaatctcagctactcaggaggctgaggtgggaggattgtggaagcccaggagtttgaggctgccgtgagctatgatcaggtctctgcactccagcctgggcaacaaagcaagaccccatctcaaaaaaaaaatattcctcgaggccaggcacagtggctcacacttgtaatcctaacactttgggagactgaggcaggaggatcacttgaagctaggagtttgaggccagtccgggcaacatactgagacccctgtctttacaaaagtaaataaatgaataaattagctgggcatggtgatgcatgcttcttgtcccagcttcttggaaggctgaggtgggaggatcatgtgagcccaggagtttgtggttacagtgagctgtgattgcaccactaaactccagcctgggtgacagtgagaccctgtctttaacttaaaaaaaaaaaaaaatcctggctgggagcggtggctcacgcctgtaattccagcactttgggaggccgaggtgggcggatcacgaggtcaggagttcaagaccagcctggccaagttggtgaaaccccatctctactaaaaatacaaaaaaattagctgggtgtagtggcgggcacctgtaatcccagctactcaggaggcttgaacctgggaggcagaggttgcagtgggccgagattgcatcactgcactccagcctgggtgacagagcaagactctgtctcaaaaaaaaaaaaaaaaaaaaaattcctggaaggaatggttggtgggtggtatatagacatgaacccagaccgtctatgaaccgagaccgtctatgaactgaagctagatgatggatacatacatgaaagttcattttactattctctctactttacaatatgtttgaaattttacaaaataaaacttaatctgcagagagattgtatcagggtctcttgttaatagtccagtagggtatttcttttcttttcttttcttttcttttttttttttttctggagacggagttttgttcttgttgcccaggttggagtgcagtggtgcaatctcagctcacagcaacctctgcctcccaggttcaagcaattctcctgcctcagcctcctgagtaggtggggtgacaagtgcctgccaacacacccggctaatttttgtatttttagtagagacgggatttcaccatgttggtcaggctggtctcaaactcctgacctcaggtgatccacctgccttggccacccaaagtgctgggattacaggcgtgagccactgggcctggccttgaataggtatcatatgtacccagtgaaaactacaaggagtaataaaggggatttggtgaaaattaagttgccttctttacctcccacctcattttccagcccccagttctccccagaggcaactctcctatccagttttttgtaaacttttccagtgaaattatatacacacagagagcatatgtggctactatcctctttccctcctttttttgcataaatggtggcatcccatacatacagttctgaatgtctatctagtttaaaagtgtatattatataacatatatatctggagacattcagctctgtacacacagataagccttaagcttgcagagactgcgtagtattcagttgtccccataccacaatgtgctgtgtctgtcccctattaatggacgtgggagtttccaaacatttcctcttggtaacagtgaatgctaaagcaaatatcctggtaccttttatacctgtagggtagccgatcttctccttttgatggtcctaattctcaaaggtaaccttaaggggagtgtattttgctgttggttctgtggatgacaggtgacaaaacagggtgagtaaggctacgaaatagctaatgaatttgccaagccaaacctgaggttccaggctgtcttaagtcaaagcctgaattcctcataccacactggggctggggccagagacggggcaggaggagctcttctcaggtataacctttcatttgtgttgggcaggaaagcaaggcatgaacgtatgtctttctactgggcaagttccctcttcaccccttggcagcactggaggagtgagggcaggaggattctcccatgtgagccccaggctatccttttgtcaagagggtactggtacccagaactgggaaggggatgaatatctccccactccccaggataaaggaaaacattagagaggaattttcaatgaaagggcagaggaggctagtgaggcccccactgccaccaatgctaagcccagagctggggttggggtggtgaggaccggagccagggcaattcagccataggccacccctccccctggcccatcctcagctgacccctgagcacctgagttgtgtttaccaccctcttacctgggttacccagggcagctcccctgatgggtagcaagaagtgggtgataacatgcaccatgccccccaccagcccaaggacagtggagacctcagagggctgaggtaagagctgcggtgtgggcagatggacaccctggtacaccccaggcctgtgagtctttagaggttgagtttttgtctgaaagagatatggcgcctacaggaggtcagggacaggccttctgtttcttgggaggccctaccccaccccttagttcctcgttccattctcaggaattgtttgtgcaatggatggacaaggacaggaggttcagtgtctaacccagtgtctgggcctgcagggtggcctctgaggcccagggccctggaagagcctgggcatggggaggagccccatggggcagggcaaaaccctttctgaggctctaagggtgatgtatgtggagattcctcaagatcatagttgggcaatcacttcaaagttagtaggcagtgcctgctaggatgggggatggtgtgtgtaccgaggaacttagcagaggcctttgtgtggaaatgggtggggtctgacccaatgtaaatatttttattaaaaaagaaatggatgagaaaccaaagccaattctgttgctgacctgaaagatgctatttacttggggtggaaataggatgggggagggcattggcttgaccttacttggatagctcattgtttaaaaaaaaaactcctggatccttcctctggggagcttgagacaagtgcacaagtagctagaaggtgggaaatggcgtggacaggtcttgtaggagtctggaagatgagggatttgagaaggatggaaaagaaggtgttatgggagagggggtgccaagaggaaagagcctaggggagagagggcttggaaatgcaaggggctggggtagacttcagggatgcgcaaggagctcccagcagtcactaaagagaagacgtgaggaagaggcactaccacttggtggctatgagtgtggacccaggagccatgctgcctgggtttgaatcccggctctgctgcttagtacctgtatgaacctggggcagctcacttaacctttgtgtgcctcagttccctcatctgtaaagtgggagtaacaacagaacctgtgtcataagcttgctgtgaggattaagtgagcacctacatttaagacttaaaaatactgtctggcactatgtcctgctaatatgaagtcttcctcccccagaagcagacctggagacaagggttccagtgcagacagtgcattctggaggtgatcgcaagaaacatgggtagtggagtgtgatagagaaggaaggcagtcaatgaagggtgtgttatcaggcaaatttaccattgtgggtgagtggaggtcaatcccactcaggaaccctggagtggtgcagagttatcccatggtccagggtgagggagcccagtatttataccaatcagtcattggttgaaggccttaattctctgtcatttccagctttctgtgcacagatggtgcaggacaccaaaaacaatccttgggtagagacagagatgctgcagctggaagtcagtggagcaccccagtgataaggcccaagggatatggtggggcaaggacagatccactaaaaccaccaagaggcttgcagagcaatgctgaatccccatctaaagtcacacattaaggctgtgaaccaggccaagccagactagttttccaatttgggggttgacctgcagttgccatagaaggttgaggggtggcagatcctaggatgaccgcgaagtccatgcccaagtggccagactggataaggagtagactggccactagagtggggtcggcctctgctatatgccacgtttcctcagaaattttcagctgcaaggtgctgagctctccaggggagaataaggcatcctgagaggccatcagagcatcatttctgatttttaaactctgattagggggcctggcacagtggctcacacctgtaatcccagcactttgggaggcagaggcaggtggatcacctgaggtcaggagtttgagaccagcctgaccagcatggtgaaaccccatctctactaaaaatacaaaaattagctgggcatggtagcacatgcctgtaatcccagctacttgggagtctgaggcaggagaatcccttgaacccaggaggtggaggttgcagtgagccgagatcgtactgcttcactccagcctgggcaacaaagcaagactttgtctcaaaaacaaaaaaccaaaaaaaccaaaagcaaaaatccaactctgactaggagatgaagtacagaattggggtattggttttttctctttggaattgtacccttggaagcagatattagaagcctagaattgataagaagaaatttggacaagatggaagaagctggcaggagaggcatgtctgttttttagatattattcacctgcttccctctacctggagtgaaaacacggttacatttgctgggcttttgaatggtacaagaaatagagaagccaaggtcgccctcatctggtggggtctactgaaaagctaatcgggagtgccgaggggaataaaggtctggcatctttagccccacaggtcaggtcatggtccttccacattcgactgggcctcctggagagctgacagtggactataactgactttttgccaatggaatatgaatggaagagtggggtgggaggcagacttgatggagaccctgtttcaaccatgcagacaaggacaatttccaaaggcatgaaccacagatggaaggaagctggaggcctgaaggaggctgatgagcagctctgccagccagggccacacacgccatctcagccttgtctgcttaccctgagcctcttattttgtttttattttttttttgttgagatggagtcttgctctgtcacccaggctggagtgcagtggcacgatctccgctcactgcaagctccatctcccgggttcacgccattcgcctgcctcagcctcccgagtagctgggactacaggcgccgccaccacacccagctaatttttttttttttgtagttttagtagagacagggtttcaccatgttagccaggatggtctcgatctcctgacctcgtgatccgcccgcctcggcctcccaaagtgctgggattacaggcgtaagccaccgcacccggcctctgaggctcttatttatttattttttttgagatggagtctcgctctgtctcccaggctggagtgcagtagcgcgatctcagctcactgcaaactctgcctcccgggttcctgccattctcctgcctcagcctcccgagtagctgggactacaggcgcctgccaccgcgcccggctaattatttgtattttttagtagagacggggtttcaccgtgttagccaggattgtctcgatctcctgaccttgtgatccacccgcctcggcctcccaaagtgctgggattacaggcgtgaaccaccgcgcccggcctctgaggctcttatttgaaagtgcagcaaaattctatcttatttaagttactgtattttagggtctctttattacagaagtttaacgtgtatcctaataaacacacttctctgagtgttgcctttggctctcacattgatttcttgctaggtatatcagttagacatggtttggctttgttataaccaagctagaataacagcagcttaaatggtctgagcataagtggtccaggtcaatcctattagctctacaggattggagagcagggcctctttaattttgtttctttatcatcatccacatgtgacttccattttgtgatctaggtggctgttccagagtccaccattctgtccacattccagctggtgggaagggaagaagttttatacattgaggagtaaacacttctccttaagaacatactctgtgggcccagaaaacttgggagttttattacttaagcaggaagagagaatgaattctgccacactgtgccaagttgatgtagctcaacaaatactgggaaaaactcatgaaagaaaggccctttcttttgaaggcagctgttacatattagtttgatggctttaaaaggcacccaaagtttagtgatttgaatgttcagtcaggttaggcttcattacgttctggtaaccaacaacctagaaatatttgttgccataggagggcttacaaaatatagccatcagtctctcctattctgatgtgcctgcccctttgccgtgtgactttgccattcctcctatcaagaggtaaattctatgcctccagtcttaaatctgggctgaccttgtgatttgctttgaccaatagaatgtggcagaagtgatgttatgtgacttttggggctaggcctcgagagaccttgcagcttatgttttggattcctcagaagttgtcctgagactgccatgctatgagggctagggaggaaggacctgctgtcctactgttaactgaactcagcccctagctgactgccgctgcatggaagatcagcagaagaaccttctggccaatatgagaaagaataaatcatttttaaatttcctacatattgggtgggtactttttttcctgcattagtagaaatgcaatgaattaaaataacaaaggtttattttttggtcatattacttatccactgagagtcagccgagtattgcgctttttttttcttttttgagacagagtctccctatgtcacccaggctgaagtgcagtggtgtgatctcggctcactgcaatctctgcctcccgggttcaagcgattctcctacctcaacctcctgagcagctgggattacaggcgtatgccaccacgcccagctaatttttgtatttttagtagagatggggtttcaccatgttggtcaggctggtctctaactcctgaactcaggtgatccccctgcctcggcctcccaaagtgctgggattacaggtgtgagccactgtgcccggctggtactgtgctttcgatatcacccagggatcttggctggtggagcagccaccatctcagacgttaccatacagaggggaagagcagggtgaagactacattgagcttccatcaggaagtgatacatatcacttgtactcacatcttattggctaaaacaagtggctggggaaatcctatcctaccatgtgattgaaagaagacaaggctacagtatttgtgaacatccttaaataccccccacctttacgatagtttatttctctcttgtaacaatctaagtggctgtgcagggctggtatgacatcaacactgtgtcagacacccaggctcctctgtctgtttgctctgtcatccccagcatgttgccctcatcctcctggtggaagacggatctccgctaggtttatattccagcccatgaaaagaaaaggcacactgcctttttattttagggacataacttggaaatgacatacataagttctactaacatcccattagccagaaccaagtcacctggctacctagctgcaagggaagctaggaaatatggtctttagctgggtgactgtgtgttcccctaaccatctcttactgtggaaggagggagaaaagatacttgaggggcaggggaggcactagcagctctgccacagcagccactttggagtccctaacaccaggatgtcctgattttcatgcacttagccctgtccaaggggagtctcaatttgtgtactcttttttttttttttgagacagagtcttgctcttgtcacccaggctggaatgcagtggcatgatcttggctcactgcaacctctgcctcccgggttcaagtgattctcctgcctcagcctcccgagtagctgggattacaggcccctgccaccacacccggctaattttttgtaattttagtagagacggggtttcaccatgttggccgggctggtctcaaattcctgacctcatgatccacccgcctcagcctcccaaaatgctgggattacaggcgtgagtcactgtgcccggtcttattttttttttttctttttgagatgtagtcttactctgttgcccaggctggagtgcagtggcacaatcttggctcactgcaacctccatcttctaggttcaatcagttctctaaggactcacttataaatcaaaagggtttttacgaacctaaatgatcacttcagagaggtttcatgttcatttttttattggtcttatttatttttaccctacattgttcaaaaaggtattgaaaagacttctgtgggtcagggagactaacacactagcttcaagtttctttgcttcctgcatttcatacaagtgtaggttatgatttaaaggcatatcccagcccccgcaaaagttttattcctttgagtaaccaaccccaaatgtatttactttgccagttgggaatttcatctactagactttccgtaaaaatgttgtaaacatttttcctgtctccaaaactaagtgttgatttcattttttccacctagattatctctagggaaggattgtagggaataaaaaagtattgtcaatcttcctatttatcaagaagttctaaaaaaattagtttcacccccctcggaagtttatcttcaagaagacagaactgttctaggctctcaggaagtaaaacccacttggtacaacccaaaagaacactaaaactttacttaaatgaaatattttgcaatatcttggatggtttgtgggtttgtgtgctttagactattgactattcacacaagagcaaggtgcatgtgtgcacacacgagcccaaatatgtgtttgcctgcgtgtttgtgagcatgcgtgtatggtgcacatgtgcacgcatgggtgggtggagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtaggaggcagggaagggggaacgtcagggtcctgtgtgtgaggttggtgctcccagcttgaattcccatgtgtgaaacagtctcttttgctttccttttctcatctgtgtcttccttctttctccattgctgtctccttgttcccacggctctaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcagggtgctacaccaggggccaccccagaacttttgtttaggagttgctcagggtgggacttaacctgactagatggcaaagttgcttttgcagagggcttttcaaaatatccagaaaatgtcaattgccagtagcaaggaattgggaacaggtcttgatggagactgtggggtactaaagccagggatgactttttatgtacaattgactgcctagtagtgaccattcagaacagatgctgaatggtcctggagtcctctagacatctgaggatcccaaggggagtgtctggggaggccacggccctcaggagactgagggaagtggctatttatcaatcagttcgcttagactctgtgaaattggcaatattcaatcagttgccaaaaacagcaatttcacatgttgcaacctaatatttcagtgttttgacagccagttgaccattcccatgcattccagcataaaatcacctgcttaatccccagcccaggtgttatccatccagtcctatattccccacccacttcctctctctccagctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatgggggtgagttctctggctgatgggctacacagggggctggggtctcctggggaaccctggggcccaatgtgcatccaggaagcctctgtggggataggagtctgttgttcagtgtgccataataatattcctggattttggtaaattgaggtctacaggtcacacatcacaagtctgcaagggccaggccccaggcagctggtgctaagcttcagatgtagcataaagcctccacacactctgcctggcttttctaagtgcctcaaagcaagacttcatattcaggccccacagattgttgtagggaagatatgctgggagagagtcaagtactgtgctttaatgccttgcctttaaagccaggtttgggttccaagccctactctgactttgacagactttgggaaggctatttaacctttctagccctcagttttcccatctgtaagacaaggatagtgagtgctgacctgagattgccatctggattaaatgagttgacattagtaagcatatacaacagccctggagtgcggtggctcacgcctgtaatcccagcactttgggaggccaaggggggtggatcacaaggtcaggagtttgagaccagcttggccaacatggtgaaaccccgtctctagtaaaaatacaaaaattagccgggtgcggtggcgcatgcctgtaataccagctattcaggaggctgaggcaggagaatcatttgaaccaggaagtggagattgcagtgagccgagattgcatcattgcactccagcctgagtgacagagtaagactctgtctcaaaaaaaaaaaaaaaaaaaaaaaatgccagcctcggtgcctcacgcctgtaatcccagcactttgggaggctgaggtgggtggatcacctgaggtcaggagattgagaccagcctggtcaacgtggtgaaacctcgtctatactaaaaatacaaaaattagctgggcgtggttaatcccagctactcaggaggctgaggcaggagaatcacttgaacctgggaggcagaggttgcagtgagccgagatcgtgccactgcactccagcctgggtgacagagtgagactctgtctcaaaacaaacaaacaaacaaacaaacaaaaaacaaaaaaaacagcccctggaatctgataaatgccatgtacacttttttttttttttgagacggagtctagctcttgttgcccaggctggagtgcaatggcgcaatctcagctcaccgcaacatctgcctcccgggttcaagtgactctcctgcctcagcctcccaagaagctgggattacaggcatgcgccaccatgcctcggtaattttctattcttagtagggacagggtttctccatgttggccaggctggtctcaaactcctgacctcaggggattctgcccaccttggcctcccaaagtgctgggattacaggcgtgagccacggcatccggccttgtttttgtttctttaagagacaggatctcgctgtgttgccaaggctggcttcaaactcctgagctcaagtgatcttcctacctcagcctcctcagtagctgggaatgcaggcatgtgccaccacacctggccataagcacttttgtcatagttattgctgcccctgtgaatggtgaggggctctgcttggcagaagtagggctcctaggattccctggagctgcatttgcctgtgggtttgggagcttcttggatcatggttcttagcacatcatacagaagacacggagtccacaagatggcaggaccaccttcacctagtggcccagaccatggatccccactcatgcccttgggttttggcaaatggccatttattctgtaggagggtgaagtagatgcctggtaagactgtgataagtaatgcttgaattattagacgtgactctaacttattttaaaattgaggcataatttacctattgtaaaatgtacaaatcttaactattcagctcaatgatttgttacaatgcatccactcatctaatcaccacccaagacagaatgaggttccctcttgtcccctcccacaaggtaactgctcttctgacctctgtctccatggactaggtaccttgtgcttacatttcctgtaaatggaatcatgcgggatgtggtctgttgcttctggcatcctttgttctatattctgcctgtgagatttatccatgctgttgtgtgtatcagtactttgttcttttttattgctgtgtagtattccattatatgggtatattacaatttatccattcccctcctgatggacatttggattatttccagtttggggccattaggagtaaagctctaggaacattctttttttttttttttttttaattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgctcttaatccattcaaccctgagtggatacagcacatgtttcagagagcacagggttgggggtaaggtcaccgatcaacaggatcccaaggcagaagaatttttcttagtacagaacaaaatgaaaagtctcccaggtctacctctttctacacagacacggcaaccatccgatttctcaatcttttccccacctttcccccctttctattccacaaaaccgtcattgtcatcatggccccttctcaatgagctgttgggtacacctcccagacggggtggtggccgggcagaggggctcctcactttccagtaggcgcggccgggcagaggcgcccctcacctcccggacagggcggctggccgggcggggggctgacccccccacctccctcccggacggcgcggctggccgggcggggggctgatccccccacctccctcccggacggggcggctggccgggcggggggctgacccccccacctccctcccggacagagtggctggccgggcagaggggctcctcacttcccagcaggggcggccgggcagaggcgcccctcacttcccggatggggcggctggccgggcgaggggctgacccccccacctccctcccggacggggcggctggccgggcagagtggctcctcacttcccagtaggggcggccgggcagaggcgcccctcacttcccggacggggcggctggccgggctgggggctgacccccccacctccctcccggacggggcggctggccgggcggggggctgacccccccacctccctcccggaccaggtggctgctgggcggaggggctcctcacttctcagacagggcggctgccgggcggaggggctcctcacttctcagatggagcggttgccaggcagagggtctcctcacttctcagacggggcggccgggcagagacgctcctcacatcccggatggggcggccgggcagaggtgctccccacatctcagacgatgggcggcagggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggtggccaggcggagacgctcctcacttcccagacggggtggcggccgggcagaggctgcaatctcggcactttgggaggccaaggcaggctgctgggaggtggaggttgtagcgagccaagatcacgccactgcactccagcctgggcatcattgagcactgagtgaacgagactccgtctgcaatcccagcacctcgggaggccgaggctggtggatcactcgcggttaggagctggagaccagcccggccaacacagcgaaaccccgtctccactaacaaaatacgaaaaccagtcaggcgtggcggcgcgcgcctgcaatcgcaggcactcggcaagctgaggcaggagaatcaggcagggaggttgcagtgagccgagatggcagcagtaccgtccagcttcggctcggcatcagagggagaccgtggaaagagagggagagggagaccatggggagagggtgagggagagggagctctaggaacattcttgcatgtgattttggtacatgtatgcacttgcttctcttgagtaaatgatctaaatgtggaattgtcacatcacaggctggcatatgtttagttgtagtagaggctgagaaagtttcacccacgtacatgccagcaaggtaacagagtgccagtcgctctgcatcctctccaacacttggaattacctgttgtttcagtgttagccgttttgatgggtgtgtagggatgcctcactgtggtttatgaaatataaatgttctctgaaggagtggagggaccatcagctgacttcttccctgggtctctgggggctctgggacagacatgggtgcatccctgggttggaactgggaagcttctgctggcaactgaggccgctgaggaggcagagcctgatgggagggggctactcacctctgccttcctttgttcactcgcagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccgtgagtagctgccctgccctcctgagattcctcggcacacccggccactgccccggctgactcctgtgtggctctccccacagaaccctactcttatgacttccctgaggacgtggcccctgccctgggcacttccttctcccacatgcttggggccaccaatcccacccagaagacaaagggtgagtgtttgaggtggggtttctggttgagcagggtgctggatctgggccggagcaagggaggatgcaaccttcctggaggccaggagccttggtgggctcagccactgaaagggagggaggcagagaagctggacctgcttggcgagagcgcaggaaggaggtggggatctgaatcctccccttccacatttctccagaaagcctgggccgtaaaatccaaatccagcgctctggtcatctgaacctctacctgctcctggactgttcgcagagtgtgtcggaaaatgactttctcatcttcaaggagagcgcctccctcatggtggacagggtcaggaatcaggagtctgcctgcagcagaggccttcctgtgctcactatctctctctgtctccttcccctcctcagaaccccactcacagcccacctcctccaagaagtcttctcagattatactcatgccatgtaggaatcatgaattcaatttatacaatcataatttttattccacaagcactgttgggacactgtgctggggctgggcgacagcaaagatggaaaggctgaggtcttactttccaggaattcatcatctagaacagtggtctccacagaaaggtagtgagataacccacaggagtgaagcagaaaaatactggtgcccctgtggaataatttaaatcagattaataatttaatatttaataatttccttttaaaacttcaacattttgtgcaggctttaaaatgtgtgtgatagactgggcatggtggctagtgcctgtaatcccaacactttgggaggccgaggcaggtggatcacttgaggtcaggagtttgagaccagcctgaccaacatgatgaaaccctgtctatactaaaaatacaaaattagccacatgtgatggcgcacgcctgtaacccagctacttgggaggatgaggcaggagaatcgcttggatccgggaggtggaggttgcagtgggctgagatcacgccattgcactccagcctgggcaactagagcaaaactctgtctcaaaaaaataaataaaataaaataaaataaaataaaatatgtgtgatagaagtttggaagccactggtttaagttcctcgccagaactttgttttgtaattgtgcttttcacaatacttcatgtaacattatagatggttttccctcccagctacattttaaagagggcagtttctgtgctctcttgggactcaaaattaagtaactcattgcactgcgaggcggcaacacacaccagttggagcagtgattgagaatcatgtgacacattcagatcccacttccacctcctcctcatggtgtgatgggggaagggggacaaggcaacatacctcagtttccttatccataaaataggggtcatcatgcccctcacagggtggagtgaagagagtctgtcaaagagaaagatgttcaacaaaggtttcttccttagctgctgctgttccttatttttattattattattattattattatttttgagatagagtctctgtcacccaggctggagtacagtggtgcgatctcagctcactgcaaactttgcctcctgggttcaagtgattcttctgcctcagcctcctgagtagctgggattataggtgcttgccaccataccaggctaatttttgtatttttagtagagatgggttttgccatgttggtcaggctggtctcgaactcctgacctcaggtgatccacctgcctaaagtgttgggattcaggcatgagccaccgcgcccagcccctagcttcttcctaacagccatttcctagtgtctcccctggtccttgcctctgtcggtctcactccagtttctctgcctcctccagggccctttgtttgctctcttaccatctcccctttggcttcagggccctttacgctgcctctcacttgccccgcacagatcttcagctttgagatcaatgtgagcgttgccattatcacctttgcctcagagcccaaagtcctcatgtctgtcctgaacgacaactcccgggatatgactgaggtgatcagcagcctggaaaatgccaactataaaggtacgggtgtcatcacgtgatggtgatgagagaggagaagatggaccctctcagggcctgcaaacaaattctggatgagttaaaaagagagtgaggcctcttggtggcacctgagtcccacgagtctggggtagtttcaacgtccagggttatggtgggggagtccagctgcccccagctcatagctcattctgagatgctgcaggtccaaagacactgtgcaggtcttcaattccttccagttgccaaaaccacactgtctggtttgcatggctgcacactgccatctccccatgtcattagccacccatacaccatgtaaagtgcctggttggcacttagcaaatggctgaagccactcaaggttttggaaacctcatctttgaatcttgggactttagtgtggtcttggattggggttatgcaatgaacatttcttttttcttcttcttttttttttttttgaggtggagtctcgcactgtcacccaggcttgagtgcagtggcacgatcttggctcactgcaacctctgcctccagggttcaggcaattctcctgcctcagcttcccgagtagctgagatttcgggcacctgccaccatgcctggctaattttttatatttttagttgagatggggtttcactatgttggtcaggctggtctcgtgatcctgactttgtgatccgcccacctcagcctcccaaagtgctgggattacaggcgtgaaccaccttgcccggccctatgcaatgaacatttctaaggtggaaaggcttttaaagtttgaacaagcaatgatgccacatctctatctgaatggcaaatgtctgagtttatcaaaacaatcgataaattgcatttccaggccgggtgcagtggctcatgcctgtagtaatcccagcactttgggaggctgagatgggcggatcacttgaggtcaggaaaccagcttggccaacatggtgaaaccccatctctactaaaaatacaaaaaattagctgggcatggtggctggcacctgtaatcccagctacttgggagactgaggcatgagaatcacttgaactggggaggtggaggttgcagtcagccaagatcacgccactatactctagcctgggtggcagagcgagactctctcaaaaaaaaaaaaaaaattgcatttccaataattgggggaatagagtgattccctacccctaggtggtaggtgggaagtttctaagagagtccttccttttggcatattccagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggtgggtatcatggtctctgagtgtgtctggaatagtggaaggggcaccaatatggggtcagaagccctgaattctgattctccctctgcctgccactttgggccccagttttgtttttgtttttagagatggggccttgctatgttgcccagctgatctcaaactcctggcttcaagcaatcctcctgcctcagcctcccaaagtgctgggattacaggcatgagccaccacacctggcccagtttcttatttataaaatagggccagtgtggtggcttatgcctgtagtcccagcactttgggaggccaaagcgggtggatcacttgaggttaggagtttgagatcagactggctaacatggtgaaaccccgtctctactaaaaatacaaaaccattagctgggtgtggtggcaggcgcctgtaatcccagctacttgggaggctgaggcaggagaattgcttgaacctgggaggcagaggttgcagtgagccaagatcatgccactgcactccagcctgggtgacagaccaagatcctaccttgtctcaaaataaaataaataaataaatagaattagtgttgatgatgatgaccgtaaccacaatgacagcaatgatgatcatgatggctgtcctcctttccttacacaatttttatggaaagctatttaagttgcctgtgtgaaagtgctctgtgttagctcttgttaccatctgggaggtaacttggagatagatgaggaaacgtggctcttgagcaggaatgtcgaagggcacggatgcaaggaacagtctgtagtggatctggccttgtcatttgcctcttgctattgtccaaattacacagttcctccaggacttagtatataaaatgaggatacccactctacctggggtttcatgagaattaaatgagttaaagtataggaagcacctggcctggtgcctggaatgtagaacatttcagtaaaagtgtgtatatatatatatgtatgtatatatatatatatgtatacatacatatatatatatatatatttatttttttgagacagggtctcactctattgcccaggctggactacagtggtgcgatctcggctcactgcaacctctgcctcccaggctgaagcaattctcgtgcctcagcctccagagtagctgggactacaggcatgtgtcaccatgcctggctaatttttatttttattttttgagatggagtttcactcttgttgcccaggctggagtgcaatggcgcgatttcggctcaccgcaacctccgcctcccaggttcaagcgattctcctgcctcctgagtagctgggattacaggcatgtgccaccacacccggctaattttgtatatttagtagaggtgcggtttctccatgttggtcaagctggtctcaaactcccaacctcaggtgatccacctgccttggcctcccaaagtgctgggattacaggcatgagccaccatgcccggccacacctggctaattttttgtggttttagtagagacagggtttcaccatgttgcccaggctggtctggaactcctgagctcaggcaatccgccttcttcggtctcccaaagtgctaggattacaggtgtgagccaccatgcccagcctaaaagtatattttgaagctctcacaggcaatgtaaatgttgaggttcccaggctaaatgctttcctactcttccagggcctggggaaatcctgatattacctagaagaattctttattctctttgttctaggaaagtccaatatgggtggctctcccaagacagctgttgaccatatcagagagatcctgaacatcaaccagaagaggaatgactatctgggtgagcccctgccactgccaccacatttgttctgctcctgcagaggtcatgagatcttcagccagggatcccagcatcttagctatggtccagagccacatggttttatttctgcgttgttctgtacaaaggcaactcatgttgaagagcctggggtcaaactactgcccatggtctcaaccttaccttctttttttttttttttttttttaagacagtgtctcactgacactcagagtatattcctggaaagatgtccacccatgccggcccagaagctggtccagaaagtaacgatgtccaccatgccaccatgaagtgcagtggtgcaatcatagcttactgcagcctcaaattcctggtttcaagtgatcccctcaactcagcttcccaaagtggtaggattacaggtatgagccactatgctcagcccgtcttcacaaattttttaaaattaatttttaaattttttttgagacagaatcttgccgtgttgcccaggctggagtgcagtgactcgatctcaactcactgcaacctccacgtcctggcttcaaatgattctcctgcctcagcctccagagtagctgggattacaggtgtgtgccaccatgcccggctcatttttgcatttttaatagagacagagtttcaccatgttggcagtctggtgtcaaacccctggcctcaagtgatccgcctgccttggtctcccaaggtgctgggattacagataggcgtgagccactgtgcctggccaatttttaattttttaattattatttttaatcaacagctttagacagagaaccttggtttcatcttcagtgggctgtggccatgggcagtttcttcatctgcaaaaggggagtagtactaggacccagctcacaagctgacaggggaagatgctcagacaaacactgcctgcctggcatagaaaaatgcccagcatatgttagccatgaccacgaccgtcgtcgttatcatcatcatcatcatcatagcatctcatgtttcaggaaactttccaggaagaagggacctcgattccctctggggaatgtccctggtggttgctctttcagcagcacagctggctaactaaggctttggcagttgcagcctctaaaggaaaaattcctcaggttcagactaaacacaaattgcactgacctttgatcagaaagtaatttcagagagagagatgctcagacagggagggcagctggttttgagccccaacctttcatcttccccttagctcctctcctttccattcacactgccccctcccccatcacctggccctcgggggtaagctgattcctctttaaaactctggcccaaggaagacaaaatttaaagcccactcccttcctccttagcatcactggaccaaggtcaaatgctacaaaaacattttattgaaaataagcaggaaaccaaacgaaaatagtcaaagaaaacgcacaaggcacgatcgttgtctagctccaactgtaactgtttctatctgggccattgccagattgcctcctggctgaagatctcttggtccacctaagcaccttgctttttacacacaacgcggggctctctgagaacaaaaatgggccacaaggggtgcaaaggctgggagaggagtagactctgtggtctgtctgagggcagttctgactggcaccacagtcggaggacaggcgcggcctgttgtgtgggtccagggcctccagtgggaaaacgtggctttaggcccttctcccagatgctaccttttacagaggaagaccagatctgaggtttagtttccatgttgtgttctgagttctttctattcattcagtcatttaaaagtacttaccaaactaccacaaacctgggtggcttagaacacagaatttctttttcttacagttctggaggttagaagtctgaaatcaaggtgttggcagggccgtgcttcctcagaaggctcttgggaagaattctttcctgccttttccggctgccggcagctccaaccttggcttgcggcagcataaacccattctctgcctctgtcttcaactcgccttcttttctgtgtgtgcctctgtgtcattacatgctgttctcttatatagataggagacccactacctgtgtctttgtgtccaaattcctttcttctttttctgttcatttgtttgagacagagtctcgctctgtcacccagaagcccaggctgcagtgcagtggcgggatcccggctcactgtaacctctgcctcctgggttcaggtgattctcgtgcctcagtctcccaagaagctgggattacaggcatgtgccaccatgcccggcaaatttttgtatttttagtagagacatggtctcgccatgttggctaggctggtcttaaactcctggcctcaaggcgatctgcctgccttcgcctcaaaaaaactgccgggattacaggcatgagtcaccaccatgcccagccagttcacttttttttttttttttttttttgagatggagtcttgctctgttgcccaggctggagtgcagtggtgcaatctcggctcactgcaacatccgcctcccggttcaagcgattctcctgcctcagcctcctgagtagctgggattacaggtgtgtgccagcatgtctggctaatttttgtatttttagtagagacagggtttcaccatgttggtcaggctggtcttgaattcctgacctcgtgatctgcccgcctcagcctcccagagtgctgggattacaggtgtgagccaccgtgcccggctcacctcttctttttttttttttgagacggggttttgctcttgttgcccaggctggagtgcaatggcgcgatcttggctcaccacaaccaccgcctcctggtgattacaggtgtgagccaccacgcctggctctggcttacctcttcttataaggacctcagtcattggattagagctcaccctaatctagtatgacttaatcttaacttgattacatctgcaaagaccctttttccaaataaagtcacagatactggggattaggactcgaacacatctttctgggggacacaattccaccattacagggaataaacaggataagaaaaccatagaacccagcaggtggtaggtgacacaagctaaggggtgttgccatgttgcccaggctggtctcaaacttctggcttcaagggatcctcccaccttgcctcccaaagtggggatgaaagtttgtctggggcattgcagttttagacaggaagaccagggaaggcctcactgagaaggtgacatttgagccaagacttaaaaaggtacgaaagtgagccatgtggaagtctgggggggaggagtgaactaggcagaggcacagctgggcaaagggcctgaggtgtgaccatgcctatggatttgaggaacttcaaagaggctgtgtgctgcaggagagtgaagggcagggagtggcaggaaatgaaggcagacaggtagcagtggggaggacgcaggggtccagctcatgtaggtcttgattggacacagtgagtttcagatgacagcctcctgtctcatggggtagccccaaagccacaggagtctggtgatttccctcttccccaccagacatctatgccatcggggtgggcaagctggatgtggactggagagaactgaatgagctagggtccaagaaggatggtgagaggcatgccttcattctgcaggacacaaaggctctgcaccaggtctttgaacatatgctgggtgagtgagctttgccctccttggtgtggggaggatggtgaggagcccgccagaggcccgtgttgggaacctggacacagtgcccctcacttgcctccttccccatctgatcctcacacccacagatgtctccaagctcacagacaccatctgcggggtggggaacatgtcagcaaacgcctctgaccaggagaggacaccctggcatgtcactattaaggtaccaggaaggaggggcagggcttggattccagaggtaaaagcggccatgggccagacatactgcaatctctgaaaatcacctgttcccctgcagcccaagagccaagagacctgccggggggccctcatctccgaccaatgggtcctgacagcagctcattgcttccgcgatggcaacgaccactccctgtggagggtcaatgtgggtaaggcaggggatgcaccagcctcctgatcctgaagccacagatcctaccacctcacccagcctctggcccctgcaggagccctggtctagcctaatctagtgtatcatttccaggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggtgcctggagtctgggatgggagggtgccctgcagggaagagtgctctggagatccctggaagagatactggggacaggctggtgtgacccttgctcttctccccaggcccatctgccttccctgcacgatggaggccaatctggctctgcggagacctcaaggcagcacctgtagggaccatggtgagtgctgggacttatggtgcttgagagctggggccggggtttgggggtgataacaaggactaggctgcagtccccaagccaggaacctggattctgggtaaaaggaccagcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 2358 - DNA, 42817 bp, Homo sapiens
  source 1..42817: mol_type = genomic DNA
tgagatataactgaagctttatctggagtgggggaatgggggtgtggtcagttggggcacccaaagacaaccatgctctcggtgaaggcgccgaggtcctggcattgtttctggttctcttcgtcttggcattcgtcctcctcgggccagtgctccacccaagtgtccttcccgatgatgtagctgaggctggagggaagaatggcaggtcaggaaggggcgtggtgtgggcgtggcgcaggggcgtgacaatggtgtgggcgtggcatgggcggggcagtcgggcggtcgcgcgcacgcgcagggaaagcactcacttgggcttctctccccagaaatcggaggagagaccccacatgaggtagtgtttcttctcctccagcttcagggcttctctgcacttgatggggctgatgaacgtgcgctgctgtccaacctgcacctcatccgagcctggagtggaggggagagggaagaagctgagtcgtggggaggaagccagggaagagccacgggaggcagcgtgctgagcctgacctgacttgatggtctgctcaatggccatgatgtactcgtcaaagtcattggacagctgaaccttgaccagtcgggtcttgtacactgtgggggagaggcagacagtttgggtggtgggctaggttgaccatgaggggcaccctggtttgcaagtgcacccgggcatgtggctctctctcccaagcagaaagttgcagaatcacagccagtcacactatggcccacccctcattacacacacaaccatagagggtcccatgtcaccatccacacacagtcgtgctcataggcatgcacagaggtcacagccacccacaatgtctagtaacatactattcatactatgcaatgagagtgactcatatgcacaaaatactgtagcctcatggccatgcacacaaccatagccacggaaaactacagtcatatacgtaacttcaggacctcacactcactgccatctacaaccacacagcctcacacaaccacagccacacacaactacaacctcacagccacccacgcaatgatgcatacaaccacatctaccttttctcacatgagcatacctaggccactcacagtcatggttccccacacaatcatggcccctcacaatacatgctctcacacacaccacagtcacccacacccacagcctgaagccacaccatgacaaccacacctaccacccaccacacaattggacacacacagctaaacatgcgtgacccccacccatcacccactcaccatagtccactcctggctcacaggccttgtccagccgttcttccagggtgaccttgtcatccgacttttgtatgaagcaattctctgcagggtggggtggagacagggtctaagtcccactccttatctggggcctactgcccatgggtgtggccagccctgggagcctaccccccttggtatcccctgggtatgggtctgggggtccctgaccatgggatagatgacctgggtaagtgtggcttgctcagacccacctgttcccggctccagggaactcaccctcagcacagcggcacagttcatcacggcagagcttgttcagctttccatcctccttttccggatggtagaaccgggtacagctttcctctgcgggcagatgtgatgtgaagatgagaggataagggcctccctccaaagaccatgcctgggaggcccagatccccagttctcagtcttcagacctggagatgctaggtcttcaacccctcagatccctcagaccccaagaccccctctactttctgatctttgggattctcagacccttgagtctcttagactctcaactcacagaagcctgggaccctcagaccccaaattcatagattcctgggacacgcaggcctccaaccctcatatatctagaatccttagacccttattttcagaaccccctgcaactcacatattcctaagaccctgagacccctgaacccatcagacccccaagtctcagatccctagaaccaactcatagatccttgggactctcagaccctgggaccttcagattactaatcctgaaatccctggcctgcttagaccatcattctcagatcccctcagaacctcagaacctcaactcatagatccttgggaccctcagacccgtgggaccttcatactacgaatgctcaaatccctggactccttagaccttcattctcagatccccacaattcatatatacctgggactctcaggcccctggaaccatcagaccccaggccctaggttggctgctcacccaggttgtaataggcgtagaccttgactgctccaggctggataagctctacattaaagtattggtgaactttgaaagctagacagtcatcctcagagtgtgagacctgagggggaaggaggagcttggtcagtggggtgatgtgggagggagtccagcattgtcttgggagctgaggcagtggtggagaaactgaaggatcaaggaggaagtggcaaagatgaatgagcaattcagcaaatccatttacttttcttcctagactcacagtgagactacctttctcagctcctctttcaattaggtgtggccaggtggctgaacagattgctatctatgcccataaaaacaacccatgcacaatcttatttccatctagaatgaatgaatcctgcagagaactacagaagatcctaaggattgcagagccacaggatggaaggtgcttggatccctgagagactacatggagcagagggacccttccttaccccccatgccaactggactttacatgagtgagaaatacaagtctgttgtgttaagaccccatattcttaggggttttgttttagtagctattgttacttaagctgactaaaatgggattgaggggccctgtgggtatcaggagttagcagggaggatatggggataggagaatgggaagaaataagagaagggagaggagaaagcccaaatcatggtagagatgaaagagtcagagaatgccagatggagagaaaataacagaagaggtggcaggtgtggtggctcatgcttggaatcccagccctttgggaggctgaggcaggaagatcgcttgaggccagtagtttgagaccaacttgagcaacatatcaagacccccatctctacaaaaaataaaacaatcagctgggtacttacacagaatatttatgaagaaacaagaacaaaaattcagctggggccaggcaccaggggcttatgcctgtaatctcagcactttaggaggctgaggtgggagaatcacttgagctcaggagtttaagaccagcctaggcagtacagtgggaccccatatctacaaactttttttttttttaattcactgggcatggtggcatgcacctgtaatcacagctactcaggaagcagaggtgggaggatcatgtaagcctgggaggtcaaggctgcagttaaaaaaaaaaaaaaaaaaaagctgggtacaaaagcataatatttatgaaaaaaaaattagctgggtgcagtgtcgcaggcctgcagttccagctcctcaggtggctgaggcaggaggatcccttgagcccaggaatttgactttgcagtgagctagtatcaagacactgtactccagtctgggtgacagagcaagaccctgtctcctgaaagaaagaaaacaacagaagagagaaatagatcaaagaaagaaacaaagcccaggattgggttagggaacgaggcaagaccttgctctctacaaagcacttaaaaaaaaaaccaaaaaaaccaaaagggctttttttcaatggttgtttaagactctgataacaagttggaggaggcaaatggtcagaagatgagatgtttatagaagatgctgggttgacccccttattttacaagctccttcccctacaactcagcagcacagaccctgtctcctctggcccagggttagtctgacccagagacaaaagctgaaaggaaaagaaagaccagccagatagaggtcagggtgcccctggaagcctcccaggggaggatgatgcagccttaccttgtccaggtagatgatgagggtgttcctatcggagaaggctttgtccagctcatacttggagatgtatctgtcaacaccattggccagctggggaaaggtggagcctgtgaaaaatccctcctggacccctctctccctgcagcctcttccagaacccaggctcctttccacttatcccagctcctgagcccttcatacctgcttcaggtcatctgtgtctggagcaaagccagtcatcatggatatgtccaatatagacatagtggcatcctggtctccccggtacctggatagtgcagaaagaagggcattgggtcccaaggaggggtcagccccaagggtctgttcctggacaaggaggtctgatcaggcactgagacttctgattcccacatagcagcacagaggggcgttacattttttaggaaacatttccccaaaggaaataaaaagcaaggtaatgtaatggtcaaggtgattaagagctcagactctgcacccaactgcatggattcaaattccagctctaaataacattggatgcattatttgaccctccatgcttcagttctagaaaacaaggcaagaatacaggcagccctcactctgcatgattcagttaaataacactagtagcccagtgacatggttctttttcagtaccttggtatattgatcacgagtagttgcatatggtataaactttgttgctaactcttcagtctagaaatcacgacataaataaaagataagcatcataattgagggccaattactgtcactcctttcaaagtccatcagtgattggtcactgagcttctgctcttcaatttatgcacagacagcaaagtgtgtagttctgttgcctccctgtctccaggtggctaactcccatgagattttacaacaatgtatcacgaaaagagggaactggccaacaaagataaaaatgcagcaaagaaatgaaaagtgataatgccagaagtgaacttcaaagacagcataaatggagttatcaaagaatagcagactatggtgatgttgaccctgctgccatttgagagataggtagtgtagaggaactcagggaaggcaaatgtattagcataaataaggaaggtcatggggacaaaaaggatgaagatgtcccagaggaagggacattatagaatacaaagtcactttaaaggaactcttggaggaattttgtgtcatggaaagctcaaaggataaaatattggaagctgatccaaacttagaaaggagcaagacaaggtactaaggcatagaaaagatgtttactccatgttgtaaattatacaaagagaagaaggcaagcatttttttgaactaaagtactctccgtaagtgtcatacaaaggaaaaaaaaaacaacaaatacaccttgcatctcaatgttctaatgttttaaattacggtgtagtcaaatactcatcttactatgaatttcatttccctgtatctttattttgttttattctattttttttttttttttttttttgagacagagtcttgctctttcgcccaggctggagtgcagtggcgtgatctcagctcactgcaagctccgcctcctgggttcacgccattcttctgcctcagcctcccaagtagctgggactacaggcacccgccaccatgcccggctaatttttttgtatttttagtagagacggtgtttcaccgtgttagccaggatggtctcgatctcctgacctcgtgatctgcccgcctcagcctcccaaagtgctgggattacaggcgcgagccgccacacccggccatttccctgtatctttataactggcagtatgataattttaaatgttgtaatagaaacatttaggctgggcatagtggctcatgcttgtgatcccaaaactttggcagcccaaggcagaggaatgctcaaggctaggagttcgagaccagcctgggcaacacagtgaggccctgcctctagaaagaataaaaaataaaaatcagccaggtgtcatggcacacgcctgtagtcccagctacttgagtggctgaggcaggaggatcgcttgagccagggagtttgaggttacagtgagctatgattgtgccactgcactccagcctggctgacagagcaagaccctatctctctaaaaagaaaaaaagaaaactttaaaggtcatggaatgattgtgtactttcctccattgattactaagatgctttgacagtctcagcttacgtggtcattgctgtggtctcacattaacatgcaaagcaaggactgtctgtgttgtctacctcatggtggatacttagaacagtatcagatacacagtgtacttggaaagtactgaatatcatggatattatttgcaagaattcttgctagagatagagggatggccaagatgaaccccggtgacctagcttcttacctggtacagatctcaaggatcatagtgttcttggcatcctgaggcctcttttctagaaacacagaagagagaaagatgggagagggtatacctgtgtgttgattcaggagcggggaagacattagaagaggggtaggaggaaggtgacagataaggccttgattccttttacctgtttccggtgctggttttatggtgaccttgaggtcgaatttattacaggtgagttgatctttggccttagcatggtacattgtcaccacctggtaagatgggagaggagacacaatgtcagcccacaggactaggactgctggggacaagaggagatggtccctctggggcagaggggcatgggccaggcaggtgtgggtttctgttccttaccgacaaggtgccttggccttttccttcagctgtgactgtgaaaccctcattttccttggtctgcagagtgaaaagagagaagagagcatgttgggaattaagccttctgctgcctgtgatggtcacctggccctccctcttgcttcccagtaaaccctggctagtgtagggggagacagccagagtgaggagggcttggctgggtgactgtacctcttctgatcgcaggaggctggcagattcccagtggatacggtgggtgatcttggagctgcggctgggcagttggagggacacatcaaggttcagttcctggtggtcaggggcgtccttttggtattgagccaaggcttggaacaccatgaaggtggcctagaacccacaagagagaaagatggtgatctgggagcctgggaaagtggctagaatccagtgggggataaagaggttcaaatcagagctgggacatcaaaatgtggcctagaacctactagagagtgcaggggtgataactggaggtcactggactctgaggacatgttcagaactctccgagagacagaaacttacaccaggacttggagatgctgagaacatgtctagaatccatcagaaagtccaaatgtaagactgaatgtctagcgaccctgaggatgcagtctagacccatcaagaggagagagtcttagaccagggcttggagacactgagaatatgtctagaacccactcatgaagaacagaatgaaaccgtagccagaggatactgagcatataatctacaacccaagagtgacactgtaacactgagaacgtgagtgacagaccaccagaaagaaaggaggccaactggagcctgaagttgctgaagcctgaagttactgaaaccatggcctagaagagggtttgcgtaatgccccagggtaactgggaacatactatagagcccgccagtgaggcaatgtgacattgggagcctggtagaactgggaacatggtctagaacccaccagcaagacagggtaagattgtgagatagaactgggaacctggtctagagcccaccaggtggagagagaggcttagacctgaacctgggccctgagaacatgatctagacacctggggcaagaagaaggctcaacacacagcttggagtacccagattgtattctagaacctatagatgggtttgcaagtaataaaaactgattctcaactccactgcaatcacactggctcgtgggaatgaagaactgcctcgctgggcctcagtgtcttctctaggaggccagtgggaagccgcaggagacagggatgcatgtgcctaggggctgtgggcccacttgcctgggtagagccatagccaccaccgtagtatctctgttcattgagccaacgcacgacgggaggcacaaagtcaaagtcttttagctgcagtagggccaagagggcataggatgtggcctccacgttgtagagctgcttaccagggtcctcccagcggttcttatctgcaaagaagataccccatccccagtgctcactgctctgtccagcctggggatggctcagagaaagctcagaaagagatgcatgctagacttcctggtgtttgggtgtcctggctgacattcgaggctctcaattacttggctcctgccttacctctcttgtttcatcaactctcacttctccctttgaaatgaatgcttaatacgcatttgttgaataaatgacgcaacaaactttctcgtgtggtttacaatgaggacctgcgaaaacttagagccgtgcatcccagctcagctcagggttatgcatcccagcttgataccttaggactatccatctcagcttggcttagggtcatctgtcccagctcagctaaaagccatgcatcccagctcagtatctcccgccctgaacttcagccatgcatctcccttcacccctccaggccaaccctcacctttggctgtggtcagaaatttgttaagaagaggccccttcagcctgcccatctgggccagagcatagccagcaatggccacagtgtaggatctctgtaggttcatgtagttggcttcaaggaagtctcctgctttagtgatgctgcctggcaggctctatgagaaagaggatcagattctccggtcatgtgggcattgctgtcacgttagtaaggatcattcgagcagcacttcctgagcatcagggatttctgtccttgggacacacctgtcttagatttgtccatttttgagaatttcccagatattttagccaccatgagctgccttgttgctgcatatctattatgtatctggagaaatccacgtaccccgtggtgtgctggtaaaagtttaacagccagctctccagtgggagggttgagggatccttggtttataatgatttacaatttctgtggtgtaaatactcccaccaggggccaatttcacggtgtcaatgcgacatcactgaacaaagtcctggggagacattctccaaattgttactcataaactagtatgcgccagattcagtataccactgtgaacacctcatccagtcatcatcatcatcgtcatcatcatctttatcttcttcatcatcatagctcacacttactttgtgtcattcagatacccacacatttaatctcataaaacctgatgagcatactgagccctgagagatgcagtaattttgcaaagaccacctaggaaataagtggcagagttaggatccaaacacagccttctggggatgggggaagacatgatttgtactgttttctcatttccatgatgtaaatacttccatcactgatttcaacctaccaatatggtgtcgttgaatgtagagttgggaagagctttgcagtaccacagtattatatagtattttcactatacagatccaacagacataagtaaccccaagagtatagattatgggagtaaggcgtttaggaagcgatgagtttgagtgtttctaacctttgtgtttaatataatttatttaactgtaacttttataactttgtttgtttggttggttggttgggttttttgttgttgcttttttttttttttgagacggagtcttgctctgtcgcccacgctggagtgcagtggcgcgatctcggctcactgcaagctccgcctctcgggttcaagtgattctcctgcctcagccttcccagtagctgggactacaggcgtccgccaccgcgcccggctaattttttgtatttttagtagagacggggtttcaccgtggtctcgatctcctgacctcgtgatccgcccacctcggcctcccaaagtgctgggattacaggcgtgagccaccgcgcctggccttttttttgagacggagtctcgctctggcccaggctggagtgcatggcgcaatctcggctcactgcaacctccgcctcccgggttcaagcgattcttgtgccttagcctcctgcgtagctgggattacaggcgcccccctccaccatgcccggctaatttttgtatttttagtagagacggggttttgccatgttggccagggtggttttgaactcctgacctcaggtgatctgccggccttggcttcccaaagtgccgggattacaggctcactgtgcctggcctaatatttagtttttaataataattgtatttaatgaccagcttgaaaaattcctggaaatttaacactgggctccagcaagctagttatagcacactttttttttttttgaaaaggagtcttgctgtgttgcccaggctggagtgcagtggcgcaatctcggctcactgcaacctccacctccctggttcaagtgattctcctgcctcagcatcttgagtagttgggattacagcacactcttgaccccaggagtctggtttcacagcctgtgctatactctgctacaatgttgctatgttgtagcagaaacaaatctcttttattcctgcccatttgcctctctgacatccactccttttgtaagaacttcttctcccttccattcacgtggccacagtggaaacagccatgtctgccccctgagacctacttcctgtccttagctgattggtccagatatagtcatctgacccaggctgagccaatcagagtcctttcctgggaatatggcggccctaaccttgatctgatattttctctaaggaaggcagccatattctgcctgaactgaattattggccaagaacggaatgaagatcacgggagagaggagcaaagcatcctggcagagtccctgaggccaccttcatctctatttgatgccttggtgcctgcacataaattccccatcaatttttgtataatctgggtcacatgtgtgttatatctgggacaactcagaggcctaaaaatacagagatcgttatttattatccccaatttacagatgcacatcctgagtgaggctcaagggtggaagtgcccatgagtcaggatttgaagtcagatttgtctgaccccacctctcctctctctctctctctctctctctacctacctccctccctccctccctccctccctccctccctctctctctctctctctctctctctctgccttggtccctcttgggtgttagaggcaacagccctgtgtttgtttttctcttcactggcccctcccctccatctcttttcctaaggggggagaagccactagctgagggtggaatcctgggcttcccacttggaaagctaaacgttaaacaacccactcaaaaccccacgatcagctaggtgcagtgactcacgcctgtaatccgagcactttgggaggctaaggtgggtggatcacttgaggtcaggagttcgaaaccagcctggccaacatggtgaaaccccatctctactaaaaatacaacaattaggctgggtgcagtggctcatgcctgtaatcccagcactttgggaggccacgccaggcagatcacctgaggtcaggagttcgagaccagcctggccaatatggtgaaacctcatgtctactaaaaagacaaaaattagccgggtatggtggcgggtgcctgtaatcccagatgctctggaggctgaaacagtaaagtcccttgaacctgggaggcaaagggtgcagtgagctgagatcatgccactgcattgcagcctgggcgacagagtgagactccatcacaaaaaataaacaaacaaacaaacaaccacaataaagcagacaaaggcattccagactctcagcggcccatctttccaagcttccctgcttcagaatcaaaaccagaggaaaaagagacagtgatgagccaacagtgttcaccgtttcctgtttggagtcacggatccctttgaaaatcacctgaaagatcctctggactaaggaaatagtcttagctctgtatcccaagttttctttaaggaagtagcaagtacgcaactgtactgatcatgtagcactgatgtagaaagcacttttggaaatgggctgaaaaccctctgaaaattgtaaggcagacagaaagaatccccacctttgatctctttgtgcctcagttttctcatctgcaaactggggataataagagtgacttacctttcaggctgctaaaaggattatgagacttaacatgtgaaactattagagggcgggtctgtattagatgagttaagtgctcaaaagatgttagctattaacatgactgcagtgatgtctgttattgcactgggagagctgcaaattccctgaaggcaacctctcactctccaaggtggctgtgctctgcatcgggtaaggtagggtagggtgggaagatggagggcacttacgttgacctgctcctcgcaaatatctttagcctcctgcagcgagatgagaacaaaggccgtgagggccatgtctttctcgttgttgttccgtaatccaccctgagatagagagcagaaagcaaggatggggtcaccggtgtgtccacacatggcagtcatccccccttgcagattcagaatcagggggtctgggcagggctgagtctcttctaggtgttaccccgctaccctaggaaggtcaaacttcttagtattaattcatgcaacaatttgttccttctgcaaatgtcaatgtacaatgtgcaatgtacaatgggtacaacggtctgatccattgtaaaaccagacacaggctctagccctcacagagcttttgtctagtagggaagatggacatggtccatccagctcctcaagagatatacactttttttttttttttttgggacagttttgctcttgttgcccaggctggagtgcaatggcgcaatctcgactccctgcaacctccgcctcctggattcaagcaattctcctgcctcagcctccgaagtagctgggattacaagcatgcaccaccacaccaagctaatttttttgtatttagtagagatggggtttcccctgttggtcaggctggtcccgaactcctgacctcaggtgatccacctgcctcggcctcccacagtgctgggattacaggcatgagccactgcgcccagccaagagatatatacttataagtggatgagttctgtgcaagggaaagaggacatcgcagcgataatgaactgtgggagtgtgacccagttggggaggtcagaaaaagtgtccctgagggagtcaactctcacagacggcagggattagcatactaggtggcagaaacagcatgtgcaaaggccctgtagaacaatagagcaaggctcctatcaatggatggagcctggaaagaaaagaaaggctggaagtctggaagcctgaaaggtgagactgaggcagtgattctccatctcaagcacacattagcatcacctggaggaatgcgggcacttttaaaaactcagattcctaggccgggcgcggtggctcatgcctgtaatcccagcactttgggaggccaaggtgggcggatcacctgaggtcaggagttcaagaccagcctggccaacatggtgaaaccccgtctctactaaaaatacaaaaatcagctgggcatggtggagcgggcacctgtaatcccagctactgaggaggttgaggtaggagaattgcttgaacctgggaggtggaggttgcagtgagccaagatcgggccattgcactccagcctgggtgacaagagcaaaactccatctcaaacacacacacacacacacacacacacacacacacacacacacacactcacacccctcagattcctgggtcctgcccctagaatttctgattcagtgagtctggggtccggtctcagaatatgttttgtttttgagacagggtctcactctgttatcagcctggagtgcagtgtcatgatcatggctcactgcagcctcgacctcctgggctcaagccatcctcctgcctcggcctcccaaagcgctgggattacaggcatgggccgtcgagcccagccacagaatgcacatttttagtaagtcatgggtgctgttgctgccgctggtctgaggatcacacttcgagaaccagtgctcgaaggagttttgtgtttaagtgccacagggggagccacgggactttctaagaactgatccagctggatttgaaaaaatcaccccaactgctatgtggtgagtgtctgagagccaacaaaagtgggaggccaccaggatgatgaccaggaggtggtttctacaaggtctccaaataaggaggggcggggagagtgttgcttggaccaggggctggccataaggatggagagaaggaggtgattcttataacatcatgggagaatgcaggtgttgatggattgaatgtgagaaagggattcccaggcaggacccctgcacttggtttaatgaaattcttaataatttctgagcgaggggccgtgtctcttcattttgcgctgggcttcgcaggtctctggtttttgcaatgctggagtgacgcctctggctcatatatctgcctgcccccaccccccagcccaatctttgcaaagggaattgggcagtgggcacatggaggtggggctctctctcgtgttcatcctgcgagactcaggagcccctctcttccattttgccctaaatcccagcctcttacaatcatttcttggtgtatcacgggcgcatcctcctggaagaccccgtcgggcttctgcttctccaggatcagccatttaacagccccgcagaggacttgggagtcgatggcgatgaggttgacagccagagagaagaccttgaccacgtaggcggtcagcctggagtgggcacagagcatgagccaatcggctctgagatccagagactgccatgtcaaccagccaatgagcgtgggggagggaccagggcctggcccagtttgcctggtttgccttcccaggccccaggacccagctgttgtatgcggtccgtgcttaaggatgcttaatgaccgccggccactcagccagcgcttgcctggactctgcaggtccagggctgtttgggcaaggctggcctaagggaccacccctggccagggtccgggccctgctgggggttgagggtggggagtatgcatggcctgagctggctgttgggactcaccaggtgctgggtgcccgtttcacgaaggccgcaaaggcagagctgggttgtctgaaggccagctgctgggtgtaccctgcagagaagagagaggaacccccaaaagagccggggctgagcagagggggcacgccagaaagggcaggggcggggtgcagagaggggacaggggctcagggtggcggaggggttctgggaggaggggaccttaaaaagggaaggactcaaagagggtgggggatcagaacgaggaggtggaaaagttctcaagaggacaagggattcagagaggagaaggatattgagggtggggggctttcagggaggggagggctctcagagagggggtggagtctcagggaagaggcatggcctggagaggacgtggggcctcagatgagagtggctgggacaggaggtggcgcctcacagaagggtgtggccttgagaagatgtggggacccaggggatgggcgtggccttgaaaagaggcagggtctcgagattctggcctgggaggagtcagggcctcagagggcgtggccttgagaagaggtgggaggccctcaggggatgggcatggccttgaggagaggcggggtctcatgaagagcctggcctgggaggagtcagggcctcagagggcgtggccttgagaagaggtggggggccctcaggggatgggcatggccttgaggagaggcggggtctcatgaagagcctggcctgggaggagtcagggcctcagagggcgtggccttgagaagaggtggggggccctcaggggatgggcatggccttgaggagaggcggggtctcatgaaaagcctggcctgggaggagtcagggcctcagagggcgtagccttgagaagaggtggggcctcaaatgaggggagtggctaggagagaaggtggagcctcaggggagggcgtggtcttgagatgaggtgggatcttaggggagggatgcgctcggaaaggggtccctggggtctccaagaggggcagggagcccacccttcttgatgagctccaaggccccctgccgcttctctaggccgaacttctcccactgctccgtttcatccaggtaatgcacagcgatgaccgtgggcgtcatgccgatcatgttctgttccccgcagcccgagggggtcacaatgaggtgcttcagccgttccgcgtcgacggcatcctctgtcatctgggccactggggtccctgcagcaggtgggaagaggacgttgctcaagccaggtgggtgacccaccttggggtggcgtgaaaagggttccagcctcccaaccagccagggccaaggggttagggacaggcgaggactggggaggatgtgactgcggggaggggaggctgcatggctgagtggctgttcgggggtctgcactgttaggagtgggaggtgcttcacaggggcaccctggtccttgggtctcatttcaccagcagtaaaataattccagtaacaatattcaggaatacttatatcacgcttaatgttactttccagactgttctaagagaataccatagagtgtctcacttaatagtcaacgaggctgggcgccgtggctgaagcctgtaatctcagcactttgggaggctggggtgggtggatcacctgaggtcaggagttcaagaccagcctgaccaatatggtgaaacaccgtctctactaaaaatacaaaaattagtgggcatggtggcgggcgcctgtagtcccagctacttgggaggctgaggcacaagaatcacttgaacccgggaggctggggttgcagtgagccgagatcacgccactgcactctagcctggcgacagagtgagactccgcctcaaaaaaaaaaaaaaaatcatcacaccaacccttggaggtagatactattattctacccctaccaaaggtgaaaaaaccaaggctcttgccccaaagccttatagcttacaggttgcaagtccctttctttctccagtcttccctcctggggcaagaaatgacctccagaatttctgctcttgtactatgttgcttgtctttttgtttgtttgtttgtttgtttttgtttgagacaaagtcttgctctgccgcccaggctggagtgcagtggcctgatctcggcttactgcaacctacgcctcccacgttcaatcgattatcctgcttcagcctcccgagtggctgggattacaggcatgtgccaccacgcccagctaacttttgtatttttagtagagacagggtttcaccatgttggccaggctggtctcaaactcctacctcaggtggtctgcctgcctcggcctcccaaagtgctgggattacaggctattgagtctcatttaagctggtttcccatctaagaagcacagaaggtctagaaaaattaaaataaactgatgtatcagcgaaagctctttgctgaactaaatgctatctggaggcttctataaaaccgatcatagcaaataatatctgtatggttaaaaaaatttttaggccgggcataatggctcatgcctgtaatcccagcactttgggaggctgaggcgggtggatcacgaggtcaggagatcgagaccatcctggctaacacggtgaaaccctgtctctactaaaaatacaaaaaaattagccgggcgtggtggcgggtggctgtagtcccagctactcgggaggctgaggcaggagaatggcgtgaacccgggaggcggagcttgcagcgagctgaggtcgcgccactgcactccagcctgggtgacagagccagactctgtctcaaaaaaaaaaaaaaaaaaaaatgtaaaagagggaaaacagatcacagatgggctgttctagctgaaggggaagagaaaggtgcgggttaaacacctccagaatgagatggaatttggctccatccatgccctcctgggacccatggggtcggggtcaagggtgtctcaccttgcaggagaattctggtctcagactcggtgtccgggacttggtcactgaggtctgcaggtgggatgtcctctttctgcactccttctgcagggtgagtgagagataccgatggctctagctccctcccgccctatcctacctcactaaacccaggtcatttaccccccttaccctgccagcccctcagcccctccccctgcagccgactcaccacggcccaggcgttctggatccagggtgcgaacagccacagttttgttcattctgattccttccggctacgcagtgttagaggtggggggagtcgttggatgaataaaagaacagacagacacacagatggtcagcagggcactgtccttaggatcaccctagcattgccgggcgcggtggctcgtgcctgtgatcctagcactttgggaggccgaggtgggtggatcacgaggtcagaagatcgagaccatcctggctaacacagtgaaaccctgtctctactaaaaatacaaaaaaattagccgggcgtggtggctggcgcctgtagtcccagctactcgggaggctgaggcaggaggatggcgtgaacccgggaggcggatattgcagtgagctgagatcgcgccactgcactccagcctggggaacagagtgagactctgtctcaaaaaaataaacaaacaaataaataaataaataaaaaatttcaaatcgagtataaaaaaattattgattggtgatggtcgacgaggtttttggcaccacctaaaattctaagcctggggtcatctcactcactttaccccaatcctggctctgcttctgaaattctgggacttccaaatttcctaagctggacactatgattcttagtgtctcagagcctggatctccaacctgagtcaatagtacgaagaccaggagccctctctgaaggacaagggtttgtgggtgccccaagcactcaccacgaccttcagggacttcctgacaccgtcactgatgaaatgatggtagacagcagccttgacttccacttcctgcaggccggtctttagcggcacgatgacatatggaacggacaacgaggacttgggggggatggttacggtctgctggtgacgcctcttggtggtggccaggctgcagaaggctggattgtggagtagttccaccctcacctgccagggagagaaaggatccgggcaagtgtgtgtgcaacaggctacctaccccctggcagcctccaagaagcctctgccaccccgggacccaccttgagctcttggttctgccggtaattgtagagaacggctcggatttccacctgctcgtttcgaacaacagagtagggtagccgcaggtcgatgaagaagtcctgcattactgtgacctcgaaggggtctgccacacagatccctgctcgggcagagacagaacacggagtgtcaaggtcggggagtggacaaggccaggctcctgggtctcagctcttagtccactccgcaggagctctccctaactcagcctgtctttgctgaagcctgtgaactaaacgctgtcaatggcgacaaatgacagatgatgatggtggtggctgggagttaccattatttattattattattattattattattattattattattaattatttgagacagagcaagactctgtcgccaggctggagtgcagtggcgccatctcggctcaacgcaacctccgcctcctgggttcaagcaattctcctgcctcagcctctcgagtagctgggactgcaggcacgcaccaccatgtccagctaatttttgtatatttagtagagatggggtttcaccatgttggccaggatggtctcgatctcttgacctcacgatccacccgcctcagcctcccaagtgctgagattacaggcgtgagccactgcgcctggccggagttaccactatttaatgatttacattctgtttgtagtttgactcagagatctacgtgtagggaggaagagaaatctccaaaatatatctgcttgtctgatatggtagccccaagctgtgggggagcgctgagcacttgaaatggggtttgcctgagtgagaaactggatttgtacttttatttgatgtacttgtatttaaatgtatttaatttaattcagacttaaactttaaacctgatgatctagctaggtgcggtggctcatgcctgtaatcacagcactttgggaggctgaggcaggaggattgcttgagcccaggagttcaaggctgcagtgagctatgatcgcaccactgtgctccagcctgggcaacagagtgagatcctgtctgtaaaaccaaacccaatgaaacaaaacaaacaactgatgctcattttaaatatatgaaacaccactgaattatatattttattattttttatttatttattttttgagatggggtctcgctctgtcacccaggctggagtgcagtggcgtgatcttggctcactacaacctctatatcctgggttcaagcaattctcctgcctcagcctcctgagtagctgggattacaggcacccacccgcatgtcctgctaattttttgtatttttagtagagacagggtttcaccatgttggccaggctgttctccacctcctgacctcaggtgatctgcctgcctgggcctcccaaagtgctgggattacaggtgtgagccaccgtgcccgacctgagttgtacattttaaaagggtgacatatagtaagtgaattaaatcttaattttttaaaaatgatgattgagtggaaaacgtttaagtatttttgcaactacttgagtatgaggatctaccttttctttctcttttcttttcttttcttttttttttttgtagagacggggctttgccatgttgcccaggctggtctcaaactccgacctcaaatgatttgccggcctcagcctctgaaagtaatgggattacaggcttgagcctttgcacccggcctgagaatctaccttttcaactgtaaattttatgaaacctaaaatacagatcaaagtatttccagtgaaaacctagcatcctgcgctgggcgcggtggctcacgcctgtaattccagcactctgggaggctgaggaaggcagattgcttgaggccaggagtttgagaccagcctggccaacatggtgacaccctgtctctactaaaaaaagaaaacttagcatcctgtttacaccactgcactccatcctaggtgacagagcaagctcctgtatcaaaaaaaaaaaagaaagaaaatctagtatcctaaatgagatgcactgaattgtaaaacacatgctggattttgaagacttagtgcaaacagaagtaaaatatatcatcagtaattttgatatactagtagattattatcaaatattaaaaggttatagtcacattattagtgggttgtggttttgcaactttttacaaaatgttgaaatgatactattttgggtatatttaaattaaatagaatgttttgtaataagttatgatatggtataattatagatatgtaatcaataataaatgatacatcatttatattatatatctaataaaatatacattatatatgttaacatgtcaacaataacaaatgacatattagtagtaaattataattatacattacaacaaaattaaattataataaattatggtttattataatgtattaaattataatgaattatggtttattataattcattaaattatattataattaaatttcttataaattataatacatattatatgtttacataatatattacatgtgtaatatgtatatattacatatatattatatatgtaatatacaatatataatatattatatatgtaatatgcaacatataacatattatatatgtgatatgcaatatatattatatgtaatataacatattacatgtaatatgtaatatatgatatatatgtaatatgatatattatatatgtaatatatgatatatatgtaatatgatatattatatatgtaatatatgatatatgtaatatgatatatgtaatatatatgttatatatgtaatatataatatatgtaatatgatatattatatatgtaatatataatatatgtaatatgatatattatatatgtaatatataatatatgtaatatatgatatattatatatgtaatatataatatatgatatattatatatgtaatatataatatatgatatattatatatgtaatatataatatatgatatattatatatgtaatatataatatatgatatattatatatgtaatatgtggtatgttatatatgtaatatgtggtatataatatattgcatatgtaatatgtgatatgtagatatgaaatatattatgtaatatataattatatattataattataaacattacaattaataaatatataaataaatattataattaaatttattataaattataataaaccatataaattatggctggatgaccgagtgagactccttctcaaaaacaaaagaaagaaagaaaagcatcaattttagagactgtacccccaccctgtctagcttttgacactgttagagtaggcagataggcggaaatgagcaggcaggggagctttctgggaaaagaagtcccagacaggctgcctactgacagcgctgctcactggcagtcagcgaaaaggacgatggctactttagctacacatggccttgtggttggggtcctctggccctgaaggggacttatcaggtcctagctggaaataactttgctagggattttccccgatgatgagcatgtgcactgctccgaaaacaccctagagttgtgttttgctcattatcatagtaaaaaacacacctctgggtggagattttcgatgctaatgagacatgccacgtgcatgctagtacctacagccacagagcctgctcgcccaaagagacctcccaaaacatgcttacaagtgacacccactcacgccccttcacgaaaaatcatgtaagagtctcataaaaagagtctaccagcagtatctgctgctggctcgttctgttgagcagccatgtctgtgtcgtctttcagagcatacggtcactttttatttatttagagaaggagttttgctcttgttgcccaggctggagtgcagtggcacaatctcagctcaccgcaacctccacctcccgggttcaaccaaatctcctgcctcagcctcccgagtagctgggattataggcgcccgccaccccctgcctggctaattgttttgtactttcagtagagacggggtttcaccacgttgaccaggctggtcttgaactcctgacctgaagtgattcccctgcctcagcctcccaaagtgctgggattataggtgtgagccatcgaggctggccctgtctctttaaataagcattgctactactatttttccagggggaccagcccagagctgtttcttccttcaataaactctgctacttaacccttgctatgtgactcttggctgaattctttcttccaagttagacaggaactaaggattcccacagttcctggtaacaacacctctgtggtaaccagggcagagaataaagtgccaagaaacatagggttgattgagtttggataaaatgagatgacactcagacaccctggggtccctgcctcccggggaccagccagcatcctctctcacctttcttgtccgacatgctcacagccagaatctcccacgtggtgatggagtctttcaaaaatatattcatgagcttcgtagagattctggatggagaagaggttggggtattaggagatgtcatctagcagggtggtagaggggaagaactggtgcagagggaccccaagggacaggctggaagggtctgggggtgcctccatgtaggtcacccaattcctgatttttctaggttgggctgtggggttgcactgtgattccagagaagaccagagatagcaggtgcatgcaaattaaacggtctgactctggggtgggttgtaccgggggtaccccggccttacccatttttcggtggctctttcaagtcctcaacgttccacagccagctctctgggaactcacttcgggaaacgatgttctcttctgcaatgatgtcctcatccaggttacctgcagggggtttagatctgcatttagaacagagcaggccagttgccatggctcatgcctgaaatcccagcacttagggaggccaaggcaggtggatcacttgaggccaggagttggagaccagcctagctaacatggtgaaacccatctctactaaaaatacaaaaattaaggctgggcacggtggctcacccctgtaatcccagcactttgggaggctgaggtgggtggatcgcttgaggtcaggactttgagaccagcctggacaacatggtgaaaccccatctctactaaaaacacaaaaattagctgggtgtggtggcgcgtgcctgtgatcccagctactgtggaggctgaggcagcagaatcacttgaacccaggaggtggaggttgcagtgagctgagatcacacgactacactccagcccaggcgacagagacagactccatctgaaaacaaaaacaaaaaacaaacaaaaagagagccgacctacttcctcagcggtcacacctttagatcctacctctgcccaggagggattcctagcagtgaaatacatcccggacatggaggacttcaggatgaattttcacgagccccagacacatctgccttgggaacttcttctccataaaaagaactaaaaattatatcccacaaatgtactggtataaggacatatacaatgcagactggattatagtcattcctttccctttgatttttaaagaaacgaaagcatttggccaggcacagtggctcacatctgtaattccagcactttgggaggccgaggcgggtggatcacttgaggtcaggagttcgagacagcctggccaatgtggcaaaaccgcgcctctactaaaaatatgaaaattagccaggcttggcagcgggcacctgtagtcccagatactcgggaggctgaggcaggagaatcgcttgaacccgggaggcagaggttgtagtgagccaagattatgccactgcactccagcctcggtgacggagtgagactccatctcaaaaaaagataataataaaagaaagcaagcatgtgcatgtggctctaaaggatcaccgtcccgagaaaccgtgtctgcttcctctgagggatttgtccattctgaacatgactaggtgagctgagaacattcccagacctggtgcagaacactgaagaagcggtggcctttaaaaaccacctaatacaaaaattagctgggtgtgatggcatgcgcctgtaatcccagctactcgggaggctgagggatgagaatctcttgaatccaggaggcggaggttacagtgagccgagactgcgcaactgcactccagcctggcgacagagcgagactccctctcaaacaaacaaacaaacaaacaaaaaacaaagaaaaaaacacaaaaaaaatctcgataggctggatgtggtgctatcatcccagcgctctgagaggccaaggtgggaggatggcttgagcccaggagtttgagaccagcctgggcaacacactgagaccctctctctacaaataataatttaaaaattagctgggcatgctggcatgcacctgtagtcctagctactcagaaggctgaggatgagacagaaggactccttgagcccaagaggttgacgctgcagtgagctgtgatcgcaccactgcactccagcctgggcgaaagagcaagatcctgcctctaaataaatatataaataaacaaaaacagcttgacactaccagcaagtaaatgaaattggactggactaggctttgactcaaactgcactttcctcaaacatgatagacaggctttaattgggttctggatctccataacaacaaagtagctggaatcccttaaaaaatatatatattttaatatttttcagccaggcacagtggctcatgcctgtaatcccaatactttgggaggcggaggcgggcagatccccgaaggttgggagttcgacaccagcctggccaacacggtgaaacctcttttctactaaaaatacaaaaattagctgggtgtggtggcaggtgcctgtaatcccagctacttgggaggctgaggcaggagaatcacttgaacacgggaggcggaggttgtagtgagccaagattgcaccactgtactgcagcctgtgtgacagagcgagactccatctcaaaaaaacaaataataataatctcagctactcaggaggctgaggcaggagaatcgcttgaacccatgaggtggaggttgcggtgagccgaggttgtgccactgtacttcagcctgggtgacagagcaagattccatctcaaaaaaaaaaaaaaaagttttcgtccgtacaaagtctcactacgctgcccagactgctctcaaactccagagctcaagcgatcccgctgcctcagcctcccaaagtgctgggatcacaggtgtgagccactaagcccagcccaaagtagatggaattcctaaaagagatacctgaatttactcacactctggaataatcaatccaagtgtcttgggatagtaacatttagccattctttttctgacccccaatgggccaaaggaattacacaattctggagaaaagtacagcccaccatccatgtggatgtaaaccatatttcagtagaccagactttttgtctaattttcccagtgaccctcacactatcgcctctttgtgaaggagatcattctaaatttgcttgaattttttcttttcattttcttttcttttctctctctttttttttttttcttttttgagacagggtcttgctctgttgcccaggctggagtgcggtggtgtgattttggctcattgacgcctccatctcctgggttcaaacgatcctcccacctcagcctcctgagtagctgggactacaggtgtgcacccccacacccggctaattattttattttatttttgtagatatggggttctgccatgttgcccaggctggtctcaaatttctggactcaagcaatccacccttctcggcctcgcaaagtgtgggcattacaggtgtgagccaccgtgcccggccaattttctttttcctttctttttttgttttgttttgttttgtttttgagacggagtcttgctctgttgcccaggctggagtgcagtggcacaatctcagctcactgcaacctaaacctaccaggttcaagcgattctcccacctcagcctcctgagtagctgggattacaggcgcctgccagctcgccaggctatttttgcatttttagtagagacggggtttcaccatgttggccagactagtcttgaactcctgacctcaagtgatccatccacctcggcctcccaaagtgctgcgattgccggtgtgagccaccatgcccggccaattttctcttattataagataaatttctctttgtttcacttaagacttatttcacgtgagatctaaagtctcacctgattcaaaaactgaatgcatgcatgaatgaagaagggctgcctgttcactcatcgagtttggcaggtctttctggaatgccacacaaattagttttctctggtgaagccaaacttggaactcaccttagctttcccattggtaattagtgtgtgaccagccccatcatctttctagacttttccctcagacctccaatgtcctgggcactggtgatgtccaattcagactgatgggtggggctgggatgaccttcccaggcaggaaactgctctgccttcaggcaagggcccttctccccatcagactaggcccttctcctccctcaggcctgggcctcctggctcctcatctgaaggcctctgtcccttccagacaggagtgtcccctcccctcggacgggagcctcctccatctcagatgggcatctacgcttctctgacttgatcctcccctcttcagacctgggtcttctctacctcacgctggcagggcatcacctcatcggcatcaccctcagacaggggcctcctctcccaacagacagaggcctcctcctaccctctcagacagcggcatcctcccccctcagacagaggcctcctccctcctcagacaggggactcctccccccgagacagaggcctcctcctaccccctcagacaggggcatcctcccccctcagacagaggcctcctcccccctcagacaggtacctcctctctcctcagacagaggcctcctccctcctcagacggggacctcctcccccctcaaggcctcctccctcctcagacagggacctcctccctcctcagacggaggtttcctccctcctcagacaggggcctcctcccccctgagacagggacctcctgccccctcagacaggggcctcctcccccctcagacagcggcctcctccagccccacccccaccagacagggcatcctccctcctcagacaggagtctcctcccccatcagacggccccctccccctgtccccaccccgtgggacctactcctggccaggcccaggtggctggcccgcgcgtgctgccgccgcagctctgtgatgtagttgcagcagtccaggaagaccttcttgcacgcctcgcccagggagatgaaacgggtccggcgctggcacgagaacctcatggggttctcccgcatgccgtcctcgcagcacttgcgcagctccttggggtacttgccgactgcgggagcacgtgttcccccaggccacaccctcagccgggggccggcagcaggagggacgcgggacggaccccagggaggacttccccgccgccagggcctcccctcctccctctctggctcctgcacggccgggctggggtctcctggggtggggctcgggggcaggagtgggtaggaaaggctcccacctttgtccattcgcttctccgtgagctgcacggaacggcgtcggcgggcggctggctgcgggcactgaagttctgcagggcaggcggaccgagaagaagatggatgaggcacctactaggtgtcctcggttcacccctcacgatcgtgtgaggtgggggtgttcctgctcccatttgatggaagagcaaactgaggctcagaggggagggatttactaggtggtggtggaggcggggcttgaacccaggcccccggtttccagagctctgctcccagcatctgggaggtggaggtgctgtctgtccctgcaccggcccctggtggcgacctcacctgccctctgggcggtctgctggccactgctgctcgtgaaggtcagccctgcgtcggagaagacaccggcgtaatccttcccactgcccggggtgcagccgatgtctgccttctccaccacgtcccagatctgcggggggcataggggtggcgggacgcagggaggccaggctgacaattgggatcccccacatatgcacctgtgtatctcttcccaaatgaccccaccctgtcccactctcatctcccccattcctgcttctgcccttcctttctctttctctttccttccttccttctctctccttccttctctttttctttctctttctcactctctctctttctttctttcgagatggagtcttgctctgtcacccaggctggagtgcagtggtgtgatctccgctcactgtaacctccaactcccaggttcaggcaattttcctgcctcagcctcccgagtatctgggactacaggtgcatgccaccatgcccagctaatttttatatatttagtagagacgggatttcaccatgttggccaggctggtctcgaactcctgacctgaaatgattcgcctgtcttggcctcccaaagtgcttggcctcccaaagggattacaggagtgagccaccatgcccggccttctttttcttttctttctgtcttctttctttcccttccttcctctccctcccttcctccctccattcctcctttcctccttcctttgctccccctttccttccctccttccctccttccttccttccttctttccttccttcattcttcactccctccctcccttcctctttatctcctttctttttctttctctctgtttctctctctcttctttttttttcctcctttctttccattctttttttttttttttaagttgggattttccactgtctcccaggctggagtgcagtggtgcaggcatagctcactgcagcctcaaattcctgggctcaagcaatcctcgcacctctgcctcctgagcagatgggactacaggcatgcgccatcatgcccagctattttaaaattttttctgtagagatggggtcttgccatgttgcccaagctggtctgaactcctggcctcaagtgatcctcccaccttgacctcccaaagtgctgggattccagacgtgagccaccgcacctggcctccattccaaatcttatctccatttcccctctgattccatctgcattcccatcctcactcctgatcccaagccaaccccatctccatcttcgtccctactccggaaaccttccccactgaatgaccctgggtgtgctgccaccagcctctcagggccccagttgaaagtgtccaattctcagccgggcgcagtggctcacgcctgtaatcccaacactttgggaggtcgaggcgggtggatcacaaggccaagagatcgagaccatcctggccaacatggtgaaacccccgtcttcactaaaaatacaaaaattagctgggcgtggtgatgggcacctgtagtcccagctactagggaagctgaggcaggagaatcgcttgaacctgggaggcagaggttgcagtgagccgagattgtgccactgcactccagcctggtgacagagagagactctgtctcaaaaacaaacaaacaaacagaaaaaaaagtccaattctcaggaccatccccaattggaacccatgtccaacctcattcccatcttcagcttcaaccatccctgtgtctggtctgctccgatctctgctttcagcgcatgccccccactgcactgccctctccagtcccacccacctcccccagccccagctccgtgcctccgcctcttctcagcagccttgggtcactggcccttaccttactctgcgtcagtttgttcttcttattcagcacgaacacgcccttgtccacggccaccagtaccacccgggccccgtggtcaccctctatcttcagggtcatctgctgcccaggtacaggctgccggtcttctgactggccgctttttaccaccagctgtggggagggtggagacgccgaaagaagtcagccctgggagagaggagtgcctgggatggagtgggtgctgggctagagtggaaagacagaaaggttggggggagccgtggggctggggagggggagagagagggagagagagagaaagggagagagggagggagagagagggagagagggcgggagagagagagaaagggagagacagggagagagacggagagacagggagagagggagagagacggagagacagagagagggagagtgaggggggagagagggaaagggaaagagggagagaaagggagagggagagagagggaaagagagagggagagagagagggaaagagagaaggagagaaagagggagagagaaggagagagagggagagagagaaagggagagagagagggagagggaaagagagagggagagaaagagaggggagagagagggaaagggaaagagacagggagagagaaaaggagagagagagggagagagaaaaggagagagatggagagaaagagagatcgagagagggagagagagaaggaaagagaaataaagagagagggaaagagagatgtagagagagggaaagagagataaaaagagagacagttgagagacagagagggaggagagaaagggagaggaagagaagagagagaaaggagagagaaaaggagaaagggagagagagagagagaggagacagggagagagagagagagagaggagtagggagagggagagggggcgagcgagcccagggcacacttaccgagcccacgcaggagtccttgacgtccacccacacggagtcggccaccacctccctctggccgctggcaccgatcagcgtgtagtacgccaccaggcggaaggaagggatgaagtcggtggtgatggacaggggcagcaccaccaggtcctggccgggctctcgcacctggcgtcccgccttcaacagcctgcccttgttcatgatctggggggacaggctggcatcaggctggggagggtgagtggcagggaacgcagggagggatccgggatgggggaaggagtcccaggggtgcggaagaaacaaggaggaggcgggggctgaggtttccaggtggccacggaccaggtaggtgtagtagcggatcttggcctcgtgggcgcggtccattcgcaggaggaagttgacgttgagggtctccccgggtctgagctctgtacgtagcactgagagatgcaggtaattgttggagttgcccacggtgctgtagggcagagcctgcatggtcctggtagcctgctctgcctccgagagctcctgcttcttcgtgcgcacctgggtggggaaagagggatgcctgctggtcgccgcccgaggatacccacacccgaatccctgagacctgggaattggtggcctttcttaacaaaaggggctttgcagatgggattaagttagggatctggagatggaatcattatcctggattatgtaggtggagctaatgtaatcataagggtctttattaagcaggggcaggggagaaaggagagacagagacagagagaaagagagacactggaagatgctatgctgctgcctttaaaggtggaggaaggggccatgagccaggcctttagggtgccctggcgacactggaaaaagcaagggagcgaactttcccccagagccaggacttctgacctctcaaactatagacccataaatgtgtgttgctttagatcactaggctgtggccatttctcatggtagccaccggaaattcacgcacatgctgagcacagggaggggtaagtggggtgcgcagcctgggagctgcagagggactgggaggccatctgcaacctccgcagctgtcatgagacttgcttccctcccagtgaggggcaacagagccacgtgcacagaagccaggagaactgagaccacctcacaacaatgggcctgtcccaaacactacacaaccctccttgtgagattcaggctccttcccccatgggagtggaaagactgtgcgtggatggagcgcctctccgtgtaagtggaaggagcagggcatgcaagaggaagattcctgtttcctcaaactgcggacccctccatgcagacggcaggaccccactgtgcaggacagaacccctctaggcaaatgagaatgtctatgcaaatggcaggaccccactgtgcaggacagaacccctctatgcagatgagagtatctctatgcaaatggcaggacccctctgcgcaggagagaacctctctatgcagatgagaatatctgtatgcaaatgacaggaccccactgtgcaaacaccagaacccctgtaccgtcttcccagtgatggggttccgaggctgggcccagacgcaccgtgatgctcaagggcttctggctggggtgtgtgttgatgctgagtttggccacgccatctccctgggttagagactgcacagtgtcctcgccctggactgccacggggactcggtaggctggagagccatcagggttcgtcacgaacacctgtgatgtggggtgcaggtgggggaagttcaggcaggctcagggctgtggccggtgtccccgaagggaggagtgggaccccttcccgccccgggtctcaccatgaggtcaaagggcattcctggtttgaagtacttgggtgtcttggtgaagtggatctggtagggagaggtcacgatggggatcccgctgcgctctgcctgcaccatgtcactgcctgaggggaccagctgtgagtgtaggcttctgggccacccctcaggattagacctcctccctcagaatggaccccaacttcagactagacctcctccctcagagtagagtccactttcatactgggcctgtgccccccatcagactggactccacctttatactggccttgcctcctccatcagactggcacagacttcatactgggcctgtgacccccatcagaccggaccccacctttatactggccctgcctcccccatcagactggacccatctttatactggccctgcctccctcatcagactggacacagacttcatactgggcctgtgcccccatcagcccggaccccacctttatactggccctgcctccccccatcaggctggaatccatcttcatactcggcctcccctctcagactgggcctaccccatcagactgaaccccactttcactctgagcctccctccttagactaggctttctcttctgacctggtctcccctctcagaccggcccacttggtggtcctgagcctggccttcagactgggcctcacctgagtgcaagatgacggtggcagacacgtacaaagacttccccaccaggtcttctgctcgggggttctgcaccccgtccagcagtaccttccggctcagcacaacctcccccgagccatcctcaatctgagaagggagaggagggctcagagaggggagcgggctcagaggtggcggggactggggcagggatcaaagcggcctccgtctatggtaccggaatgcgcttgagggattcaggcagggaaatcctctgttcgccatcctggatcccgaagatgacaaaggcagttccctccactttcttcccgtagaggaacctacgggacagacaaggagggcttcaggtccatccctcctggagaatgggatctcccccagcttctcctgcctgtgctgaagactggagcccccaacccactgctggcctctcacctggccccacctccagcccctcacctggccccacccccagccccccaccttgccccactcccaccccccacatggtcccacctccagcccctcacctggccccacccccagccccccaccttccccactcccagcccccacctgactccaccccccagccccccacctggtcccacccccagcccctcaccttgccccacccccagccccccaccttccccacccccagccccccacctgactccacccccagccccccacctggtcccatctccagccccccacctgactccacccccagtcccccacctggtcttcacctggtccctcacctggctcttacctggccccacccccagtccctcacctggcggtgatggtgacctccaggcccttctcgttatagatgtagtagaatttctctgtaggctccactatgacctcgaaactgggcagcactgggggagagatggcgttggtggggccggcgctgggccaggcgttctgggcactgactccccccagcccctcctcctcttaccgtactccttcacctcaaactcagtggagaagacctgctgtggtgagttttcatagtaggctcggatcttccactggcccatgctgtgaggagggcggatgagtggtctctcaggcctcggagcccccctgctccctctccggggataggggagccctgagccccctcctcaagaacctgacatacttgacgagttccggaatgtcccaagacaagggcaagacgccaagctggttctgagaagacaaggagtcctgcttgaccgggatgccttccgggttctgtgggaggcaggagggaaggatagaggataaagtggctcttcggaggctgggcttagcctctcagctctccccgacctgtgtctggacattctctgtgcacagtgtctactgtggttaagaacagggacccaggtgggcgcagcggctcacgcctgtcatcccagcactctgggaggctgaggcgggcagatcacctgaggtcaggagttcaagaccagcctggccaacgtgatgaaaccctgtctctactaaaaatacaaaaattagccaggcatggtggtaggcacccgtaatcccagctactcaggaggctgaggcgggagaatcgcttgaacccgggaggcggagattgcagagagccaagatcactccactgcactccagcctgggagacagagtgagagtctgtctcgaaaaaaagaacaaggaccggagtcagtcaaccttaggtttcaatctctactgtgccacttacaagctgtgtgaccctgggcaagttacctaacctctctgtgctcaatgtgcaaatcttgaaacaggagattataatggcacctactgtgttggcttgggacatagttcatatgagtaggggctcattttttcagtgtctctctgaatactaataactagtagtgtcatttcatttgctgccaacatttaaacatcatgagacatcattgcaccactgcactccagtctgggtgaaagagcgagaccccatctcaaaaaataatgtattagggcgagcgcaatggctcaagcctgtaatcccagcactttgagaggcagaagtgggaagattgctcaaggtcaagggttcaagaccagcctgggaaatgtagggagactccatctctacaaaaattttttaaaattagctggatgtggtggcgcacgtctgtggtcccagctacccaggaggctgagacaggaggacagcttgggcccaggaggtcaatgctgcagtgagctgtgattgtgccactgcactctagcctgggcaacagaatgagaccctgtctcaaaaataataataatgaatgaatgaatgaataaataagtttaaaagaaattgtacagaggtaacagggatcaggcaagtggcatatctgaaggccgtgagctggctttaggaattaaaacatataaaaatctgttttttttttgttttttttgtttttttttttgagacggagtcttgctctgtcgcccaggctggagtgtaatggcgagatctcggctcactgcaggctccgcctcccgggttcacaccattctcctgcctcagcctctcgagtagctgggactacaggtgcccgccaccacgcccagctaattttttttttgtacttttaataaagacggggtttcaccgtgttagccaggatggtctcgatctcctgacctcgtgatctgcccgcctccacctcccaaagtgctgggattataggagtgagccactgcacctggccaaaaatctgtttttctagcttctgttggaaacaaggaaatttctgtggatagtgtactctggttagcaggagacatctaattggagctgggcaactgttgtgcctttacaagagatgtgtggtctctgttccccacagaccacatcaatccctaaatctagataatttttacattttttttgtagagatgtagtctccctagctttcccaggctggtcttgaactcttggcctcgagcagtcttcccacctctgcctcccgaaatgttggaattacaggcttgagccattgcatttgccccaattattttttgagacagggtctcactctgccacccaggctggagtgcagtggtgcgatcacggctcactgcagcctggaattcctgggctcaagtgatcctcctgcctcagcctcctggggtagctgcaaccacaagcaagcaccaccacacacagctgtttttttgtttgtttttaacttttcttttttgtagagacagggtctggctgtgttgcccaggctggtcttggactcttgggctcaagcgatcctcccgccttggcctcccaaacagctgggattacaagtgtgagccactgcacctagccttgtatgatttcaacacatcctcatgataattctatgagaacaccctccttccccttctctcctcccatccttctcgcttcttccagtaagttttttattaaacccaactatataccagcattgtgctgagttcaggtgacaaaaccctcaacaaacataacaattccttcctggagggatttaggttcaatagagggcgaggcgatgggagaagcaattatcaaatgaataaatctcatttgcaggacatggcaggaaggaggagtgtgtgtagcggggaggggggacgctcagggtgggtatttgcgactttataggttactcagagagacctcattgtaaaattgagacattggtgacatttgagcaaagacttaaaggaggagagagaacaagctgtgtggatatttggaagaagagggttttcttgagaagagggcacagcccgtgccaaggcgccaaggcaggactgcacctgggtgttggaggaacagggaggatggcccgtgtggctccagaagagtgaacgagggggagagagggaggaggggagggcagggaagggacagggcaaggtgtgcagggccttgtggactgcagggaggacttgggctttgacgcataggaaggtgggagccatggagggctgtaggcagagcagggatgggccctgactcaggtgctcacaggcgtcctctggctgccgtcggtagaatagatgacatacaattatccgtcatgatcccgatattcagataaggtaactgaggctcagggaggtgaagtgatcaggggtttaactgaaagcagaatccacggacacctgcactgctccctggggtctccctggatctccaccttgtctctcagcctgtgtgtgtgtgtgtgtgtgtgtgcgcgccatatggtgtattgtgtggttgtgtgttgggttgtgtgttgtgtgtgctatgtttgtgtgcactgtgttgtgtggtcgtgtatgttgtgtggttgtgtgttgtgtggttgtgtatgttgtgtgtgtgttgtgttttgtgtgtgttgtgtgtgttgtgtgttgtgtgtgtttgtgtgtgttgtgtgatagtgttgtgtggttgtgtgttgtgtgtggtgtggttatgtatgttgtgttgtgttgtgtgtgttttgtgtgtattgcgtggttgtgtatgttgtgtattgtgttgtgtgtgttgtgtgttgtgtgtgtggtcatgcacgttgtgctgtgtgtattgtgttgtgtgttgtgttgtgtgtgttgtgtggtcgtgtatgttgtgtgtttgtgtgtgttgcattgtgtgtgtgcattgtgtgtgcacatgtgtctgcatatctctttgcctctgtgtgtgtattgtgtgctgtgtgtgtgcatgttgtgtgctgtatgtgtgtgtgttgtgtgggtgtgtgtctgcatatctctttgcctctgtgtctctgccactgcaccccttccggtgtgtctttctctgtctctctcgatctctttgcctctcctaagcctgtgcccctgcttcccctggggccccctctggctggcacctcaatgttgaccatgaccgtccggcccacgggtagcagcttgtggttgacggtgaagatccgatagagaactggggagagacaaagaggcctcgtgagaccctagcccgcccacgccggtgccccgccctctccagccgcccccagcctcacctgtggagccaggggtgtagatggtcttgtctgtctggatgaagaggtacccgctctgcaggctgaccagcaccaccttctccaccacttgggtcccgaaggtggcctgcacggtcacgaacttgttgcgccccttttctgacttgaactccctgttggctgggatctaggcgtgggcagggcattgtcaggggtctgttccaaggccccatgcccacggtccagcttccggatcttgggctgggtccctccttgcctgcccattattcttggtcttccgaggtggccgttttggggagggaggggcatgtgaaggaggtgcgaggggagaggggggaccagggagggaactcaaaaagaagagctcacaaggaggagagagcttataggaggaggggctcagaaggggcggggactcagaaagggaaggggctgacatgggaggggctcagaaagggggagggactcaggtgagggaacttagaaagtgatggagactaagaggggaggagttcagaagaggagacttcgagggggaggggcttggaaaaggaattcagtgggagggacttagagggggaggagactcagaaggggtggagtctcagagaaggggaggaacctcagaaggggtggggtctcagggaagggagggactcagaaggggaggagtctcagaaggggtggggtctcagggaaggtcagggcttagaaggggaggagattcagaaggggtgggggggggtctcagaaaagggaggggcttataaggggaggagactcagaaggggtggagtctcagagaagggaggggcttagaaggagaggcgactccgaaggggtggagtctcagggaagggcagggcttagaaagggagaagacagaaggggaggggctcaggaggagggggggagtgggcgtggctgtgggtgtcagccgggtcctgcgccagtctgcactcaccgtgaaggtgacgttgcccatgtggttggtggcaggggtcagcacagtcttctcactggacagcactagttttttgcctgggaagtcgtggacagtaacagtgactggaacatccccttgcgcgtcgtgggcctccagcaccatggtctcctcgctctccagccgcaagatgttgggggtgatgatagagtacctgtcggagtggggcacgggagtgggcttgtcattccacggatgtgagacgccagtcctcactggagtcagcgcctggcaggctgtgtgccccagcctctggtcctggagaggatccagtgactgccggcgcacttgccaatgccattatcttctctgggcactgccaccgtctcaaccacatgggcaggacagcagccaccatgactcccactctcagccagctgggcctggcctttgaaagcctgggcaacgagggggccacacatcccaccaaaccctgaaccttccaaccagcgtcagcaactcctccaagtctctggacttccagacccacaatcgcctaaacccacacatgccccaaaccctaaacctctacctctctaaacactccaaatatgtaaacactcaaactcccggacaccctcaactctacctacccaaacccacatacgccaaaacctctaaacctcaaatcttagagcaccccaaacccagcctaaacctccaacaccccagtcctaataaatacaatcaattccaaatgccccaactatacatgaacccgaagtagccaatctttaaacccacactgaaaattgcaagtccccaagctgcaaactcccaaatcttgtaaagtccaaacctccgagtctccaaacacccccaaccgcaccatcaatgaacaccacatacaccctaaaccaacagatgacctcaattctagaaacatcccaaactccaattccaccatacctggattccacaaacacccaacccataaacacccaaactctcaggcagcccaaatgtatataaactccaattccacgatacctggattccacaaacacccaaccacaaacacccaaactcacaggcagcccaaatgtatataaactccaattccatgatacctggattccacaaacacccaaccacaaacacccaaactcacaggcagcccaaatatatataatcattcccaacctgctaacccctgaatccacaaacacccaaatgcaccctgaattctacagggacctggacccccaaatgtctgcttccaccccagaaccagccctgtttgtgggtagagtcataaccactcacatgggactccccagagccagggggaggtgggttagtagcaggagcagcaggctgggacctgaggtgggtcccatggtgctgggacagtgcagggtcagagggacagagggacagagggagaggatggggaggagtg

SEQ ID NO: 2359 - DNA, 20623 bp, Homo sapiens
  source 1..20623: mol_type = genomic DNA
agaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgatcctgtctgttctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgctctggatcagaagatgcgcccgagcactgacaccatcacagtcatggtggaggtgagtccccgacctctggccttcctgatcctggccactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaagaaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccaggccatcttgatgaaatgcagttagacatccaggccaggtaatacctccctccccacctctgcccaccagcaccgggtcctgctccctactcagtatgaatgggctcctgcttccctgccctcgggccattattccccccagcccttggcccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctacgttgctgcagccatcattgagtctccaggtgggtgactttcccttattgtaaccccagacccttgcctctgacctctgagctaaccctctgtcctccggcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcataaagagtgggggccagggggccaattgcaaaatggaggctgcaaaaggctcagagctctggtctccacactattttttgagtacagtcactcagatctaagaagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagaagactgcatgtctgtccaatgcttcaaaggagggtctttctccttgaacagagtgtttacagataagacagggggtctcactctgagcatgggaacatgatggcaattaggaggcttttcttctcagaggcctcttgtggctttccacaacttattgtctcatatttttatggacagtttatacaggcaccccacaagtccttttcccaacatgcccccctccctttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatttaaataacagtctgtctaagatcatttgtttgatttgtcaattgttggtctatttgggtctgagaattccacaattttgaggaattttttgttaactatttatatattttgtagtttgaacagaggagtgtaaagcaattccagcagccgcagcagtagctgtgactgcaataaggcccataagactgttataagggtaaaaataaatctctttgttttggtaaacacttttttttaaaacatttttgtgacaatatgaatggaaggagaggctttctaaggtctattgagggaaaccagtatccaaactcctttcttagtttttatcagtaacacagatgtttttacaccgaacgtggaattaatacaggtgaaaaggtgacagttttgacaagtaatagtttgagaattaggtcgaatgtcaatatttttgaccattaacataaaaggagggttgacacaactctgaatgggcactgttttgttggaagaaaactgatacgcaaattgaagtttttaaccttttttttttaaagataatatatttttttctaaacttaaatatgagattgggccattattaactttcataatttggagtgtttagggcctattattggattaattattttgggatgtgggccagctgtactaaaattggtccaaattatgggaaaatgagcacgtttttcagtgtaagtagtgttacctttttgatagtatagtttctgttttagttttgtcttgtatttattattttgatgggtacaattaactgtaaaggtcccctcaggggaccaattaatgacaatttcataggaattattttgtagtaccatagtgtgatcagagatgtaattttttttaattaatatttttaaattatttgaccattgttaaggttgttggcacctcttttttgggggcttaaactgttaattgaattgaactctgtgaatgatccgggctccatccagaaaataaatgataggatactggtctttgattatgacctggaattttaactagtcaatgttgtcggtagccttttaggcaaccgatagttggccttatgtaaagaggggggaactgataacctatggacacatttattaacttttttttttttcctttgggtgagagggcccatgagtatttgtaggcttagggatccaaacgctattattaacataaacttcaactgggggttttaaccatgtgacaggcctaattaaaggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgtttttttattttttaattttttatcctttgatgaggatgtagtctttaggctggtactggaaattttaggagtggcgtctgtgttaagagactttttacaatttttaaagagcaggttagtgttttaagaaaaacttgtgttttattttaatgtttagtttatagaaaactggatgatatctttttaactttagtaaatacgtttacacacggaattttttacaattatcattttaaaacttgtttagatctttaaaacaaaattaaacaaccttttttgtataaattttttataactttttttatgacttttacagacaatttttaacatgtcttaactttttatgttttataatttttttactaaaggtacatttttataactttttaaatttttttacttttttgtatttttttgatttttgtcttagtcttttttttacttttatttttttaaatgtgtaataattagatgagtgttggtaacaatggatgtatgtacatattttagtttttaaaatttagggatgtgtttaacatctgtttgccagaactgactaggttccaattctttacggttaacacctattgaaggagggtatgtgcctgtgagctggtaatctgggcattgtgggataatttgtttagccagcctctgtgtaagttgaaattatttagataagtttctccaattttggtggaataatcgatgtgattgggtggcttggtcaagcagtgatgtcataacctgaaggtctgcttgattattgccgtaagccaatgggccaggcagagagctgtgggctcgaatgtgtgtaataaaagtaggatgtgtaccttggtctagtaattgttgaagttgaagaaaaagaccacacagagtgggctccagagcaaacttaaggctgtaatagtttttaaataaatacacagaataaccttagctctctgaatgttagtaaattcagatcaagtgattggattatgtggtctccaccagactgttgctttttcatgtttaccagacccaccagtaaaaacagctatggctccttccaaaggggcatcacaagtaatttttggaagaacctatgtagttaattttaagaattgaaaagtttttaggataatgattattaatacatccaacaaattttgttaaattaatctgtcatgtaactgagttaataaatgcctgtttaacctgatttttatttattggaactataatttttattgggctcagtgccacaaaatttaataattcatatatgagcctgtccaattagaattgccatctgatttaagtatactgtaagtgcttttatggtattatgtggcaaaaaggaccatttaactaaatcatcattttgaacaataacccccattattgtgtggttagtgtgaagtagggaacacaatgaattataaaggcaagtctgagtcaatcctactgacctgggcttgctgaattttgttttcaattactgataactctttcatggcctcgggtgttagttctctgttactgcgtaagttggtatttcccctcaatattgagaagagattagacatagcataagtaggaattgctaaattgggccaaatccaattaatatcttctaacaatttttgaaaattatttaaggttttgaaagaatctcttctaatttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggatagttctgcctacaaaagtttgacaaactgtgggactatttaacataccctggggcaaaactttccaatgatatttggctgcaggttttttgttattaacggcaggaatggtaaaggcaaattttttgaaatctgcctctgctaaaggaattgtaaaaaagcagtcttttaaatctataataacaagcggtcagtctttagggagcacagtgggggatgggagcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttcaacccagacggggcgccgggtcatccattttaagggaaattgctccttcactgtaataactgtagggtgaacctgaattgccccatctccataatgaactgtgggtcgggcaataatgggcacggtgagccaagtctcgggctccctccccctgcacccactcggctgaggaggaggtggccattctggacatttctctacaggaaccgtgggctgaacaattttttgagtaggtttagggagactggggagattggcataaatcatcttcagactctcctttttgttagtactcggtagaggtggttcagagttctgattatcaaactcctctctctcctcctctgactcagcctcattatctgtctgaaaaggctccagtgctgcatgcaccaatgaccaaagcgaccaaacaggcaaaggaatttcctttccttctctatatgctcttttaaggtcctttccaactccttcttaatgttttaatttcaaagtttcctgttttgggaaccaagggcaaaattgttccatagcatgaaacaaatccataagattttccgtatcaacttttaccccaccatgcatgcttgaagagctgccgtaggaagctcaaatacgtggtgtacttactttcagtttttcccattgtgtccctagctttctctgggcgccccgcttacctgtagaggttaaaacttttatgtccttgggagtcctttgttcgttggtcctctgtttcacatgcttgagcgtttcctcaccagattcttttgggccccacgttgggcgccagaatgttggggaccagcctcaacaccacctgtagggtacctgaagtctggtggtgacaaaggaatgagaagagacaggttaagagttcataaagagtggaggccagggggccaattgcaaaatggaggctgcaaaaggctcagagctctggtctccacactatttattgagtacaataacttagatctaagaagcagatgttcagggcaaaacagtgaaagggtagcagtgcgtcacaggcataatctacagcagaagcgctttaaatgaatctcctttgtgctcaaacagcatatctttaacttatcggagagtagctagtgggagtgggcttaactaggagcctgcacgtctgtccacattccaatgcttcaaaggagggtctttctccttgaatacagtgtttacagataagagagagcaggtctcgctctgagcatggcaattaggaggcttttctcctcagaggcctcttgtggctttccacaacttattgtcccatatttttatggccagtttatacaggcaccccacaagtccttttcccaacacagacaggaatacggcagcctgtgccctgggagctcactgtcttgtgggagggaaccactcaagccactccccacttgtcctcctgtccctctcttcttgggctctgtcccccacctctctctgtcctttgtcttgcaggtggggagatggaggaggcagagctcacatcctggtattttgtgtcatctcccttctccttggatcttagcaagaccaagcgacaccttgtgcctggggcccccttcctgctgcaggtttcttccagaggggaaggatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtaggactcctcggacccctgggagatggtgggggaaggggaggagggtgagctggggtcccaaggatccatggcctgacttggggggaaggtggggtacttggctctgagctactaccctattcgcacctgaccccctctccaggtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatggtgtgcatgagctggggagtcacggagggctggggtgcagggaagagccctctgggtggggctgggggggttcaaggctgaggctgtcccatgaagaggcaaccactcttgtccctcccattcttggcccagatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaaggtgaccggggtcaggagagatggcacttgtgccgagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcattcctgcctttcttgcaggtctttgaagctatgaacagctatgacctcggctgtggtcctgggggtggggacagtgcccttcaggtgttccaggcagcgggcctggccttttctgatggagaccagtggaccttatccagaaagagtgagaacagagaaggaaggggagtgggtggcgggaagataaggaaggaggaagggcctgaggggaccagctggaagagtccgggcaggaagggctgggcaggggaaggggaggaggggaggaggccgagtgcctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttgggctctccacctgggatccgggttgggggtctgcctctctgcccctcggctccttgctgaacccacgtgtggtatttggggccagagatccgaattccgggattacgagtggaaggtgggcagctctctccagcagcctctcttatgttgctggtctcaaggggtcggggcgggggctgaggtgtatgtcctttttgtcctctcatgctcacccccacctggccctgcagtgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgaggtgaggggctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccatgggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgaggtgaatggagcacccctgaatataagtccccgggcccccagctttgtcctccaccctcagcactctctctgctggccaggccaggggcccaacacccaaaccaatgccttggtctgttcccatcttctacaattctgatccaactctgtccctggagttgaaactcaaagttctgggggagtctgcgctagcagggcaggctgtagtcctgtgtgacctcacaaccatgttttccctgagacagaaggaaggggccatccatagagaggagctggtctatgaactcaaccccttgggtgagtgaccctctacctccagccattggtttcctaagtgggtacaggtggtgggggatgtggacagcaggacaggctgccaacttcccccatttccccagaccaccgaggccggaccttggaaatacctggcaactctgatcccaatatgatccctgatggggactttaacagctacgtcagggttacaggtgggagtgccctttagtcccttcccagtggccaccttcggattcatgtgggacttgtggatccctgcttggtcccactccccgtgagcctctgacacagagtcctcagacctccaccctctccctcccatgtagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacggggcagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggaggtgaggggtgaggggctctggcagtgagcctgaggcccaggggaccttaggatccctgagtgtgcccagagggagaggctggatgaagactcagaggaggaatgaagttataagcaggggtgggttgggggagactcaggagagcccagcagggggtggctaagggccaggggaccaggctcttctccctgccttcctgtttactcgtggtctcccttcactttcagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggcgggggtgggtagtcctcagaccaagggcttgcttgagtcctggctcaacctccctaggacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaccctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagagggggtggggctgttttgaggaaggagataagttattggagccgcaaaaacaggtttgcttgtgcccttctaacatcgccttcccttttctgttgctgaagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatcctgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggccgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 2360 - DNA, 20623 bp, Homo sapiens; identical to SEQ ID NO: 2359
  source 1..20623: mol_type = genomic DNA

SEQ ID NO: 2361 - DNA, 20625 bp, Homo sapiens
  source 1..20625: mol_type = genomic DNA
agaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgatcctgtctgttctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgctctggatcagaagatgcgcccgagcactgacaccatcacagtcatggtggaggtgagtccccgacctctggccttcctgatcctggccactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaagaaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccaggccatcttgatgaaatgcagttagacatccaggccaggtaatacctccctccccacctctgcccaccagcaccgggtcctgctccctactcagtatgaatgggctcctgcttccctgccctcgggccattattccccccagcccttggcccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctacgttgctgcagccatcattgagtctccaggtgggtgactttcccttattgtaaccccagacccttgcctctgacctctgagctaaccctctgtcctccggcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcataaagagtgggggccagggggccaattgcaaaatggaggctgcaaaaggctcagagctctggtctccacactattttttgagtacagtcactcagatctaagaagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagaagactgcatgtctgtccaatgcttcaaaggagggtctttctccttgaacagagtgtttacagataagacagggggtctcactctgagcatgggaacatgatggcaattaggaggcttttcttctcagaggcctcttgtggctttccacaacttattgtctcatatttttatggacagtttatacaggcaccccacaagtccttttcccaacatgcccccctccctttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatttaaataacagtctgtctaagatcatttgtttgatttgtcaattgttggtctatttgggtctgagaattccacaattttgaggaattttttgttaactatttatatattttgtagtttgaacagaggagtgtaaagcaattccagcagccgcagcagtagctgtgactgcaataaggcccataagactgttataagggtaaaaataaatctctttgttttggtaaacacttttttttaaaacatttttgtgacaatatgaatggaaggagaggctttctaaggtctattgagggaaaccagtatccaaactcctttcttagtttttatcagtaacacagatgtttttacaccgaacgtggaattaatacaggtgaaaaggtgacagttttgacaagtaatagtttgagaattaggtcgaatgtcaatatttttgaccattaacataaaaggagggttgacacaactctgaatgggcactgttttgttggaagaaaactgatacgcaaattgaagtttttaaccttttttttttaaagataatatatttttttctaaacttaaatatgagattgggccattattaactttcataatttggagtgtttagggcctattattggattaattattttgggatgtgggccagctgtactaaaattggtccaaattatgggaaaatgagcacgtttttcagtgtaagtagtgttacctttttgatagtatagtttctgttttagttttgtcttgtatttattattttgatgggtacaattaactgtaaaggtcccctcaggggaccaattaatgacaatttcataggaattattttgtagtaccatagtgtgatcagagatgtaattttttttaattaatatttttaaattatttgaccattgttaaggttgttggcacctcttttttgggggcttaaactgttaattgaattgaactctgtgaatgatccgggctccatccagaaaataaatgataggatactggtctttgattatgacctggaattttaactagtcaatgttgtcggtagccttttaggcaaccgatagttggccttatgtaaagaggggggaactgataacctatggacacatttattaacttttttttttttcctttgggtgagagggcccatgagtatttgtaggcttagggatccaaacgctattattaacataaacttcaactgggggttttaaccatgtgacaggcctaattaaaggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgtttttttattttttaattttttatcctttgatgaggatgtagtctttaggctggtactggaaattttaggagtggcgtctgtgttaagagactttttacaatttttaaagagcaggttagtgttttaagaaaaacttgtgttttattttaatgtttagtttatagaaaactggatgatatctttttaactttagtaaatacgtttacacacggaattttttacaattatcattttaaaacttgtttagatctttaaaacaaaattaaacaaccttttttgtataaattttttataactttttttatgacttttacagacaatttttaacatgtcttaactttttatgttttataatttttttactaaaggtacatttttataactttttaaatttttttacttttttgtatttttttgatttttgtcttagtcttttttttacttttatttttttaaatgtgtaataattagatgagtgttggtaacaatggatgtatgtacatattttagtttttaaaatttagggatgtgtttaacatctgtttgccagaactgactaggttccaattctttacggttaacacctattgaaggagggtatgtgcctgtgagctggtaatctgggcattgtgggataatttgtttagccagcctctgtgtaagttgaaattatttagataagtttctccaattttggtggaataatcgatgtgattgggtggcttggtcaagcagtgatgtcataacctgaaggtctgcttgattattgccgtaagccaatgggccaggcagagagctgtgggctcgaatgtgtgtaataaaagtaggatgtgtaccttggtctagtaattgttgaagttgaagaaaaagaccacacagagtgggctccagagcaaacttaaggctgtaatagtttttaaataaatacacagaataaccttagctctctgaatgttagtaaattcagatcaagtgattggattatgtggtctccaccagactgttgctttttcatgtttaccagacccaccagtaaaaacagctatggctccttccaaaggggcatcacaagtaatttttggaagaacctatgtagttaattttaagaattgaaaagtttttaggataatgattattaatacatccaacaaattttgttaaattaatctgtcatgtaactgagttaataaatgcctgtttaacctgatttttatttattggaactataatttttattgggctcagtgccacaaaatttaataattcatatatgagcctgtccaattagaattgccatctgatttaagtatactgtaagtgcttttatggtattatgtggcaaaaaggaccatttaactaaatcatcattttgaacaataacccccattattgtgtggttagtgtgaagtagggaacacaatgaattataaaggcaagtctgagtcaatcctactgacctgggcttgctgaattttgttttcaattactgataactctttcatggcctcgggtgttagttctctgttactgcgtaagttggtatttcccctcaatattgagaagagattagacatagcataagtaggaattgctaaattgggccaaatccaattaatatcttctaacaatttttgaaaattatttaaggttttgaaagaatctcttctaatttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggatagttctgcctacaaaagtttgacaaactgtgggactatttaacataccctggggcaaaactttccaatgatatttggctgcaggttttttgttattaacggcaggaatggtaaaggcaaattttttgaaatctgcctctgctaaaggaattgtaaaaaagcagtcttttaaatctataataacaagcggtcagtctttagggagcacagtgggggatgggagcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttcaacccagacggggcgccgggtcatccattttaagggaaattgctccttcactgtaataactgtagggtgaacctgaattgccccatctccataatgaactgtgggtcgggcaataatgggcacggtgagccaagtctcgggctccctccccctgcacccactcggctgaggaggaggtggccattctggacatttctctacaggaaccgtgggctgaacaattttttgagtaggtttagggagactggggagattggcataaatcatcttcagactctcctttttgttagtactcggtagaggtggttcagagttctgattatcaaactcctctctctcctcctctgactcagcctcattatctgtctgaaaaggctccagtgctgcatgcaccaatgaccaaagcgaccaaacaggcaaaggaatttcctttccttctctatatgctcttttaaggtcctttccaactccttcttaatgttttaatttcaaagtttcctgttttgggaaccaagggcaaaattgttccatagcatgaaacaaatccataagattttccgtatcaacttttaccccaccatgcatgcttgaagagctgccgtaggaagctcaaatacgtggtgtacttactttcagtttttcccattgtgtccctagctttctctgggcgccccgcttacctgtagaggttaaaacttttatgtccttgggagtcctttgttcgttggtcctctgtttcacatgcttgagcgtttcctcaccagattcttttgggccccacgttgggcgccagaatgttggggaccagcctcaacaccacctgtagggtacctgaagtctggtggtgacaaaggaatgagaagagacaggttaagagttcataaagagtggaggccagggggccaattgcaaaatggaggctgcaaaaggctcagagctctggtctccacactatttattgagtacaataacttagatctaagaagcagatgttcagggcaaaacagtgaaagggtagcagtgcgtcacaggcataatctacagcagaagcgctttaaatgaatctcctttgtgctcaaacagcatatctttaacttatcggagagtagctagtgggagtgggcttaactaggagcctgcacgtctgtccacattccaatgcttcaaaggagggtctttctccttgaatacagtgtttacagataagagagagcaggtctcgctctgagcatggcaattaggaggcttttctcctcagaggcctcttgtggctttccacaacttattgtcccatatttttatggccagtttatacaggcaccccacaagtccttttcccaacacagacaggaatacggcagcctgtgccctgggagctcactgtcttgtgggagggaaccactcaagccactccccacttgtcctcctgtccctctcttcttgggctctgtcccccacctctctctgtcctttgtcttgcaggtggggagatggaggaggcagagctcacatcctggtattttgtgtcatctcccttctccttggatcttagcaagaccaagcgacaccttgtgcctggggcccccttcctgctgcaggtttcttccagaggggaaggatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtaggactcctcggacccctgggagatggtgggggaaggggaggagggtgagctggggtcccaaggatccatggcctgacttggggggaaggtggggtacttggctctgagctactaccctattcgcacctgaccccctctccaggtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatggtgtgcatgagctggggagtcacggagggctggggtgcagggaagagccctctgggtggggctgggggggttcaaggctgaggctgtcccatgaagaggcaaccactcttgtccctcccattcttggcccagatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaaggtgaccggggtcaggagagatggcacttgtgccgagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcattcctgcctttcttgcaggtctttgaagctatgaacagctatgacctcggctgtggtcctgggggtggggacagtgcccttcaggtgttccaggcagcgggcctggccttttctgatggagaccagtggaccttatccagaaagagtgagaacagagaaggaaggggagtgggtggcgggaagataaggaaggaggaagggcctgaggggaccagctggaagagtccgggcaggaagggctgggcaggggaaggggaggaggggaggaggccgagtgcctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttgggctctccacctgggatccgggttgggggtctgcctctctgcccctcggctccttgctgaacccacgtgtggtatttggggccagagatccgaattccgggattacgagtggaaggtgggcagctctctccagcagcctctcttatgttgctggtctcaaggggtcggggcgggggctgaggtgtatgtcctttttgtcctctcatgctcacccccacctggccctgcagtgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgaggtgaggggctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccataggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgaggtgaatggagcacccctgaatataagtccccgggcccccagctttgtcctccaccctcagcactctctctgctggccaggccaggggcccaacacccaaaccaatgccttggtctgttcccatcttctacaattctgatccaactctgtccctggagttgaaactcaaagttctgggggagtctgcgctagcagggcaggctgtagtcctgtgtgacctcacaaccatgttttccctgagacagaaggaaggggccatccatagagaggagctggtctatgaactcaaccccttgggtgagtgaccctctacctccagccattggtttcctaagtgggtacaggtggtgggggatgtggacagcaggacaggctgccaacttcccccatttccccagaccaccgaggccggaccttggaaatacctggcaactctgatcccaatatgatccctgatggggactttaacagctacgtcagggttacaggtgggagtgccctttagtcccttcccagtggccaccttcggattcatgtgggacttgtggatccctgcttggtcccactccccgtgagcctctgacacagagtcctcagacctccaccctctccctcccatgtagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacgggacagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggaggtgaggggtgaggcgctcctggcagtgagcctgaggcccaggggaccttaggatccctgagtgtgcccagagggagaggctggatgaagactcagaggaggaatgaagttataagcaggggtgggttgggggagactcaggagagcccagcagggggtggctaagggccaggggaccaggctcttctccctgccttcctgtttactcgtggtctcccttcactttcagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagtaggggccgtccccgggctctggcgggggtgggtagtcctcagaccaagggcttgcttgagtcctggctcaacctccctaggacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaccctcccacccgtggaatccccgcagcacttcttcctggggtcttcgggggaagactgacttcctggctgtgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttattggagccgcaaaaacaggtttgcttgtgcccttctaacatcgccttcccttttctgttgctgaagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatcctgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggccgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 2362 - DNA, 97941 bp, Homo sapiens
  source 1..97941: mol_type = genomic DNA
ttgaaagcaaactcaggctttaatgatcagtttcctgttccttggtattttctttcaagcaaaggccatgtttttgtaatactccctttcaatggactgttctttcggccccagcaaacattcctgagtggtaggtttgaggaggtgttccaatttattgtttccggtgtccaataaccttggaggagtatctgtcttcatgccctccaaggccatgttatttcagaaagttacagcatttgaaatcattctctaataaaagcaagtgccactaattctaagtaaagtgagctttacaaataagaccagctatgaatgtttaaaaaaagaagaaaacaaaaaaacgaacttcaacaacaggagtccataagtgcaaactgtatgcagctgaacttcaggaattttagcatccatttaaaaagatatcttcggcaaattcatctaaattagctaaaaatgcttgacacgatgaacatgttgtgtctctaggccagtattcaatccaggtcaaggaatctaaagggtagatgtacctaccaagaaacaaagtgtttgtgaggtggccacaaaacagaaaagctgaatttgatttctttatttttttttgagacggagtcttgctcagtcgcccatgctggagtgcagtggcgtgatctcagctcactgcaagctctgcctctcgggttcacgccattctcctgcctcagcctcccgagtagctgggactacaggtgcctgccaccacgcccggctattttttttgtatttttagtagagacggggtttcaccgtgttagccacgatggtctcgatctcctgaccttgtgatctgcccgtcttggcctcccatagtgctgggattacaggtgtgagccaccgtgcccagcctgatttattttataagagcccagctgtggtcaggtccccaggggtcaggctgtccgccaaactcttctgtaccggcctctcctggggagggttcacaaacccttaaggaattgtaaagctgcctggggctcccatattaaaggcagaaagtacatctatttcaatgactagtttctaaaagcagataatacaatacatatttacacattttcctctttacaaacagtctgagaactatcaagggagctggtgtggtggttaggggaggtccggtgagtactttcagattcatcatcaggtccagacactcagatggttaatcaggcagctaagtcctcagctgccacgatggttttaaatcattctttgcttgacattaatattatttagttcaaaatggtttgttggttaagagcagggccataagaaacacgtagtgtatttaagaataaattatactcagttttggagggaagatcagtgactgaaaaatattggtgacttacctgaaactgaaattgtattttatctggagggcttctttacccataattaagtactgtcttccttttaccagctcagcgttagtacaggttacctttttaatgaaggtaatctcagagtctttctcagcaacagcttcccctgagagacatgcaagtcaagtaaggttataccattcatgttttaatgtcacaattataaactctcaagttttctggttcctcgtggctattgagaggttcatggctagtggacagccgtgatatccatgtggttaaggcttcagtctctggagccagactgcctgggttaaactctaagcatgctgcttcctggctatgtgactctgggaaaatgatttatgttatctgtataaggccttagaccctcatcttaagactgggcatgataataaaacctaccttgtagaaccatcgtgagattaaatgagttaatacatgaaaagtgcctggaacatagtaggaactatgtaagtacttattattactcttatataaccagaattaaaagaacctctctacagttgaacaacattaatctccacattatatagtaaaatataaaattatttggtatttggcaactgttaactttgtggaaaagtacaaaatgtgaaagacttggaaaacttcaaagatagtaattttgggattctcaaagaactcacaagtagccagttcccctacctggaatgcattcctccccatgttggcctcttgaatttcatttatcttgaaagtctccttcaattctcacagtatccagtaaaatattcctggatgctctttgttttaaatatctttctgtctcctctttacctcttttacacttgaatttctgtcacaattttttgtcccacatctgtccttctagctagactagaaacttcttaaggcatggactgtgtctgatttatcgctatatatacagggctgatatttaactattaagttctggcagagtcatcttaattgttaagtcctgaaaaacttctgaaccaattggcaaatagtgtataatagaaactgtgtaaatggtaaactttcattagtgatataaatttcagtgtacacccattagttcaagctgatttcttaggctgccctgatggtgtagattcctattacgtcaatatctgagcaacattaccagtactatctgccatttcagcccctgtcatagtaagcagtgtagctgtgtggggccttattattttttaagcttctcatcatggaaaatttaaagtatattcagaagagagaacaggcaactaccctgggcttcaacaataactaaacttttattcttctatatccttacctattctaagcactctgtgctttggagaaataccaatttatccttatcctcaaactacagtttgcccttgattctaaatggcttatggtcactgtgccacaattcttctgtaagtagtgtgtggtatttttatatttataaaaattcaaaatttatgtgttaaaaatgggcccagaatgaggagatgaagtatgccaatgtttcttaacatttccttttaaatatcataaaatgcatctttggatctacaggagaacaaagaagaaatgatactaataaaaaaattgtagcttgggaaccatccgatgctatgaaaaattcagaacagtctaaaatgtcttttgatactatgcaagaatcagtatcaaataaaacaaataatttgtatttctggaatgaaaagcactttgttatttcagtaaaaagagaatggcttattactgcttgtaatatgaacattggatgaaaatgttgctcaaaagttggactgtggcaacatcaaagttctaaacacttatttcattagaatggcaactagcctgcaaattaaaaaattgtgaccatcaatgaagaaaaaaataaaataacttcacaaataagtttcatacaatgaaactttcaaaataacaaaaatttaaaaaaaattatcaaagtgttgataaagcaaatacaaaattgaaaaatattactagaattttaaactctagggtatggttagtaataatcaagctgggaggctgaggagagaggatcccttgagcctaggagtttgagaccagcctgaacaacatagtgagaccccgtctcaaaagaaaaaaaatcaagcattttaggacttgaaatatttgatagaatttcaaaagagaaaaaaatttagtataaacatattattgcaatttagctttatggtcctacttattgcaaaatttatatcaatcgaaatgaggccaggcacggtggctcacacacgtaatcccagcatttcaggaggctgaggcgagtggatcacttgagcctaggagttcaggaccagcctggccaacatgtaagaccccatctccgctaagatacaaaaataagtcaggcgtggtggtgcatgtctgtaatcccagctactcaggaggctgaggcaggagaatcacttgaacctgggaaacagagtttgcagtgagccaagatcgtgccactgcgctccagcctgggtgacagagtgaaacgtcatttcaaaaaaaaaaatgtaatcccattcacaatagccacacacacacaaaaatgcctaggaatacagctaactagggaggtgaatgatctctacaatgagaattacaaaacactgctcaaagaaatcagagatgacacaaacaaatggaaaaacattccacgctcatggataggaagaattaatattgttaaaatggccatactgtccaaagcaatttacagatttaatgctattcctatcatttttcataaaattagaaaaaaacattttaatattcatatggaacaaagaaagaacttgaatagccaaaggaattctaagcaaaaagaacaaagctagatgcctcctactacctgatttcaaactatattacaaggctacagtaaccaaagcaacatgttactgatacaaaaaaagacacgtagaccaatggaacaggttacagcacccagaaataaagccactatcctaagtgaattaacacagtaacagaaaaccaaatatcacatattttcacttataagtgggaactaaacagtgagtacacatggacacaaagaagggaacactagacagcagagcctacttgagggtagagggtgaggattgaaaaattacctattgggtactatgcttattacctgggtgacaaaatgatctatataccaaacccccaaaacatgcaatttacccatgtagcaaatttgcacacgtatcccctgaacctaaaataaaagttgtaaagaaaaagaaattggacaattacgcaattgaaaaaaacattttgctgaagttttagaaaaatgaattcaatgagaaatatttatacgaacatctttaaaaaatgtttctccccaagtagaatataagctttaaaaaggcaagagctctgtcttatttgagttgtatcttctgtgtttaatataatgcctggcacatagtcagtactaaatagttgctgaatgaaggaacgaatgaacgaatgaattctcaccagttttgtagatatccagaagggttgccttgtacttgacaaaaacattttctacagtgatggatgtgatgctaactttataagctggcaaaagacaaacaacaatgaaacaattcagtcttaatactattaatgctatgtccagtagaagccagaatttgtcaaacacgagaaatgaagcatggcaaactattatagttcttatttcctccaagaagccttccccaatcccctcagtctgattcaatctctcaatctattagaatcattagccctggccaatgttatagaacaggctgattagaataagagacatatttaataaaataacagaagcacataaaacaaacaaacaagataaacctttgttagatgttaagttcagaggctgatcctttaagatgagtggagtcatgcccatgggcatcttttgaagagccccttcattctcttctccatggccacagaggaggccttatctctcattcaggtctaccatgtgagctttcttggttccttgctttgcttcctcatatagttccactggctttaatccttggtttttaggatgattctgttttctcactcacccttgcttggcaactacctaacaagagctgcctacaatcctgttttcccttcattcagatatcaatgtttgatgcataatgtgcttgacctcaggtctggaaagaccagcttgaagggacccattctttctatgtggcctcaggagagatttattttatttttgcttttgatctattttttgttttgaaattagtgacctaaaagatttgttcattctagatatccctcaagtctttaagtctatcccagatatagattgactgattgagaggtagctaggtgaactcatcatggcagaaccaggggctatgtaaattagtggcttaaaatgcatgaaaagtgttctgactttcagattcataagtctttataatggacatgggcaatgtacttactatgtgggcctgggtacagagagagaactacttaattttgtttctattctgttattctggcttgtagtccagaaaaagccagcgaagtcttttcttgaaacaacacaataaacccaaattgcatttattctctgtgttaaaatagatttctgatattttagatttaaaatagttctaaaatggagggaagaaataatttagtggaacttttgtttgttaaaacaatatagtattctcaagtcttcatgtatttaacaaactgcagtgggcctaggctgagtcaggcagctttttagcttttttttttttccaaaatcaatataaattcaaagaaagaaaagttattaaccatataaaacttattctgttgcctgaattactattaagagaattcagtagacttcgatggaaaaaatactggagatcaggatgcatcttaattctattacttgctttctgcatgaccttgagcaaattatttaatctccctgagcctcagtttcttcactggtaaatagtgataatactctgttacattttttttttgacagggtctcactctgtcactcaggctggagtgcaatggcttactgcaatctccacctcccaggctcaagcgatcctcctacctcagcttcccaagtagctaggactacagacatgagccatcaacgcacagctaatttttgtattttttgtagagacaaggttttgccatgttgcccaggctggtctagaacccctgagctcaaagtgatccacctgcctcagcctcccaaagtgctgggactacaggcatgagccaccgcacccagccctcatgaagttcttacgagaccctttccgtaagaatgagaaccctttccattgcaatgagaaactgtttatggaagctgttgctaaacacaaagtaccaaattggctgtgtttatttttttaatttataaataacacccttcaaatttctttctttctttctttctttctttctttctttttttttttgagacagagtcttgctggtgttgcccagactggagcgcagtagcacgatcttggctcactgcaacctcctcctcctgggttcaagtgattctcccgcctcaccctgctgagtagctggaattacaggcacgcaccactatgcttggctaatttttgtatttttagtagagacagggttttgccatgtttgccccaggctggtctcaaactcctgacctcaggtgatccacccacctcggcctcccaaagtgctggtattacaggcatgagccactgcgcccggctccacccttccaatttcaaaatgaaaaaatgatttgagatagtgtacaatatgctctctctctctcaaaaaatgccagcaataaacatcaaaaactgaatagataacaaaggagctaattttatcaggaactgagacaaggctacaactgtacttgaacactaatttagctctaagcgctggacaactagaagcactgagatttgctttttcaaatggagagtgtctcaaacatggattgcaatcttgaatatattaaaaattatttggtatttatatttttaccctgaagatatttttttaaaaaccaagccccctaaatcacctttgcctctgcctctggtctatcaattggaagagtacagaactgaaatcttatacctctgtggcttctcaaaagttccctttgactatgttttagtgcctgtaattgaaaaagctctattgtgggaaagtatcctggctgggtatacatgtcacttctattatttataatgaaaatcacatttctttgctgaggaataaaaactttgcatgttaatgctaaaaatcgatggcattttccttcaggggatcacatggaatgttgtattcatataatcactatataaagtttttgatctttctaactgaacacatattcataaaatttcatgtttaaaggagctatattgaacttttgaactcaccatatgcaatctctggtttacatgctgtttgttttcttgtctctgcagagattgtcagatccaattcttcctgcatttgcccacaatcagctggattttgtgaaaattggtaaaaataaggttaatggaaagaagtagacactctttccaggagtaaacacggtttctcatgagcccagagacaacccaatataaccttacaaatgtcagatttctaagacctgcccattttcttttctttcataaagtgaaatattacataaagaaaacaaaacaaacaaaaacaaaaaacaaaatcttgagcatgtcacaagcttgtctaacccatggcccgtgggcagcacacagcccagggcagcttcgaatgcggcacaacacaaattcgtaaactttcttaaaatattatgaaatttttcttgtgatttttgttttagctcattagctattgttagtgttagcgtattttatgtatggcccaagacaattcttcttccaatgtggcccactgaagccaaaagattggacacccctggcataagacttattgttagactgggtggctactccacattcaggtctttagaaatgtatgtggttcccttgatgaaagggggaaattttccattttgagtataatcagaagtcctttgaaggacccaaaatgataatgtgactgatttatagctataaaatggcacaataagtacctagaaaatgtgtagatattgaggattttgaaaaaaccaaaactaactgagaccctcatggagccagctgttgattattggtgagttctggatcttttccttggccaagaaggctttcttcaatttaggaaagactaaatggaactggacaataaaccgaattccattaactgggaagtataagagaaaaggaacagaagctagtggttcagtgctgagcctcttgtcttatatgataaaaagactaggtgaaagtaaaatctcacatcatgttgcccctataatattcaacaaccctctcgatggtgtttccctgcctctgtacagcatgaactatcaggttgttcaggaactgtgaaaatgtagttttacaatgctcaaggaatcattagctttcaattagctgagatagcatttctacttctgagaaagaacagtttaccaaacagtgtcccccagattaacctcaggttatgaacgactgctttaaataagcatgcagcctaaatatgttaaataaagtttaccttctacacacttgcacgcggctccttcacagactttctgaattttgatattggaagtgctataaaacatggtacactgtttatctgtggcaacaaaagtgtggttaagagaagtggtttgattgaagaacaacacatttactaattggcaagtgtcttacatggagcctcagagattgcttattttaaacccttctttttatagctaaggcccagggaggtaaaattatgaattggctgtcctgggaagggttccgctaccctcagaaagatctcccctttttcacttagttctgtgcttgaaacactcgtttctcagaaataaaacatttgatgcttctctaagtaagaggaaaataaattatgttgcatgaggatcttttgaaagagttggaattgtttagggtggacaagggaagaaaagcatatatctatgtatctctatatatctatctcaaggggaagagggactatgtatgttctatgtgatttcagaatataaaactagaatgaatgggtgtcagagttttggttcacttcaagaattttctaacaagtagaactgcccaaggtggagtcatctgtcttgtgatccaataagctctccaaccacataacattctcaaaaatggctgaatagtcaaatgtgggatcacccattcataaatatttattgagttcacattctatacccgacgctgcgttagatactagggacacaagaatgaaaacaccctggggttgatgaaaaagacatacaaataattgaatgcaatgtgacagctgctataatagagctatctgcaaagtgtaacaagaatatagatgggctagaagttgttctggggggattgagttgatttctctcaaaaggagagatatgatttatctgtgaacaccatagataaacctgaggcaaagaatattgaagttggaggcactataatccagttattttaaatatgaagaaactgaggactgaggtgaaacggtctgctcaatgtcaagaagtagtttatgtacaatattttgtatgcagtagttttgaatgttcaaattgggactttcatgaagagtggtccctaagagaggcaatacataaaatttacaggactctagtggatttctaaatgttctggaaagaatacaaagtattcttctgaagaaatgttagcatggagttgattacctggtctgtggtattcgtacactgtgaaagtggcaggactgagaaacccaacttcaaagagttcaaatatccggaatcgtacacaaaggaaatcactggagggaatctgtttaacaaattcaaggatttaaggaaattatggagagatgatatttataatcttttagcctgtatattttgaatagtaatagtaaaggaaaaatggttgcaggtggagcttaccgaattcagttgcagaataacatgtccatctttgatttggtaatcagtgaatagttgatccaccccttccacaagctaagggggaaaagagagaagcttgaatttcatttcattatctttttgtttaaatgcattcacctgttgatgagatagcacaatgcagggatgtgatctgtaattcaaagaaattgaagagcagttcctcttcttgaaaaagtctgaacacattagcatataaactcatattttacagagcatgctagtgtatgcttctgcttcactttgataaatcaaaacttaggttaattatgttttgaaaagaatattctggccaggcctggtggctcacgcctgtaatcccagcagtttgggaggccaaagccagtggatcaccctgatgtcaggagttcgagaccagcctgactgacatggagaaacctcgtctctactaaacatacaaaaaaattagccaggtgtggtggtgcatgcctgtaatcccagctactcgggaggctgaggcaggagaatcacttgaacccgagaggtgcggttgcaatgagccaagactgcatcacactccagcctgggcaacaagagtgaaaatccacctccaaaaaaaaaaaaatattctgggtgattctataaaagtggtatattcaaatgaaagaaagtaaaattgtctataaaataattcagaaaagaaaatgaagcattcacaacacgatttaaaagaaaacacatacggcttttaagtcttcttcatttgcactgattccagtaggcaaggagatgtccatcaccgcatgagaggatccagatgatgattcttccctgctgggcttgtagctaaaataaaaaagaggttagaaaatataataaataagtgaataagagtctttaagaaaggacactcttccttagtagaccttaatttttaaatttgggtctccatttatttgcttttctacaatgtatgggttaaaatctctgactttagagttgcaagagatctttgagtcatctattctctttcctcacttgatcaataatctcaacagaccactctactggaacacagaagtcatccacaccaagctaactagctggggaaactcaggatgagagtaaggcactggttcaaggtcacatggctaattcatgcagagctacagaagaatccaggtctttggattctcacgttagttcattttctaatgaagcatattccaaggaaaaaatcagttgtatgttgaaaagagattcaataaacatgtccaggaaaagctggaagaaaatacactaaggcaaggcacggtggcttacgcctataatcccagcactttgggaggccaaggcaggcagatcacttgaggtcaggagttcaagaccagcctggctaacacggtgaaactccgtctttactaaaaatacaaaaaaaattagccgggcttggtgggacacacctgtaatcctaactacaggagaattgcttgaacctgggaggcggaggttgcagtgcgccgagatcgcagcactgcacttcagcctggacgacagagtgagaatccctctttaaaagcaaacaaacaaacaaacaaacccacaaatattagtagctactttggatggtgagattataagcaattatctcttttctttttcatgcttttctctattttctatatttcccataatagctactttatatagaaaatgtttcaaggactgtcctttcagtaggaattctgctagtaggaatttaagcggaaatgcaaaaagggcacaatgggagggttttgtttttgtttttgttttgtaagagagaaaagaatactgaaatggagaatcaggaaacttgggttttattccagttctgagattcccacaaatcatttcccctttctaagctcattttcttatttgtaaaattaactgtgaagaagtataagtttgtgttttaaatttatctttataattcccaggctttggttttgggtggcagaggcttagagctaccattaagagatgttagaagacataaaagagacaggctggcggggctgaggctggggcagagacagacggagtgtgattctgtaaaagttgatttcaggttccagcctcacctcaagatgcttgaaaggcagctggatgtttgagagtgaagcttgggagagcagtcaggattaaaggaagaaattaaaagacagcttcataaggggtaaaatgaattgatctcacctacaggtatgaatgttggtggaagaggagatactaagcaagttagtgaggggtcagggcatatcttttcctcaatgacacctcatagagcatatataatgcagtcccagctgggtgcggtggctcacacctgtcatcccagcactttgagaggctgagtcagatcagctgaagccaggagttcgagaccagcctggccaacatggtgaaaccacttctctactaaaaatacaaaaattagctggctgtggtagctcacacctgtaatcccagctacttaagaggctgaggcacgagaatggcttgaggctgggaggcagaggttgcagtgagctgagatcgcaccactgcactctagtctgggcaactgagcaagactctgcctcaaaaataaataaataaataaataaataaataaataaataaataaaagcagtccccattagaagtcatagatgtaatatttgccacaataaagaaaagtattctaaaatctctgactcataaaaatttaaccctattcttcaccaaattaacaatttagaacagaatataaaacacttggaactctaatgtgacatccgaacatctccctaattggatgggtagaagcagagcactcttgctcacagatgcaaacactttgtcagcaggatggaaaagggcctcccgagtggagagtgtctatgaaaaggttgctggagccttgatgactggttgccatggagactgtttcaatggtggaacagaaatcctcctttcaagaagccctttgcctgctgccaaaaccagcaatcttccccaaaggcattttgttgtgagggaaatgaaatccttttttcttttcttaggaatacaacagagaggttgtaaaaaggtaaatacacgaaagagaccctctgaacacagaaacttcatgctggcattttttaatcaggagagagaatatttgaaggcaaagaagttcctacatgaataagtactacacagttccttttggaatttacccaacctaacttcagtgtcaacagagccaaaagcatattccacccgcctttctggaacattttgtccccaatttgtaaaaaccaaaggatagactattcaagattgcatttctccttgctttcttttgtatattgataatctggaattaggcctcctgacaatgaagtcaaatgaatgaatttttgataacagcttttttctgtacggcagaattgtggataattagaactggcagaaaacttgagataaggtagtgcaatatctttgctttatagaagaggattggagaagtaaactgatttcctgaaggtcactggagttcttactggtagaggctatcccacaggtgtctcaccctatcagagagctcttctttattgcaagtctagatgcctccctgtagggtcccaggcactgattcgagctctgcccagaagtttgcttacacttccctttgacaactgttacaaatttaaaggtaattgtgatcatgctcctccccagctggtaggtgcccaagggtaggaatggcatttagggggaaagaagctgcctgggaaagggcgaccttactggaaagacattagggaatgaggaaagatgtttgagcgggaacagagagcagggactggccacagaaggaagtaggaaatgctggaaggaagaaatgctgatgaggaaggaaatagggctgaatagtgaaggaatcctaagaagcgattgggcttgggacatagagaagactgggaaacagctgggagggaggcagggagaaactatgtgctgttccttgggattagtggtcttagattacactgattgaaagaggtggtttaggctgagcgtggtggctcaggcttgtaatcccagcactttgggaggctaaggtgggcagaccagctgaggttaggagttcaagaccagcctggccaacatgctgaaaccccatctctactaaaaataaaaaaattagccaggcatggtggcatgtgcctgtaatcccagctactcgggaggctgaggaaggagaatcacctgaacctgggaggtggaggttgtagtgagccgagatcacgccactgcactccagcctgggagacagagtgaaactccatctcaaaaaaaaaaaaaaaaaagatgtggtttagatactggattgaacatcagaggttggggatttgagcccctagctctgcctctaactctgtgagcatttggcaggcgactttatctctttgggtcttagtttcttcatttccaaaacaagaggattatgatatcatccctaaggtccttctcagctctcatcttttgcacaacactattgaatttccaagttatccacactgggtgcatgattataagtaaaatcagcaaaatgccatccacagatatcactgttattgacaatacaagagttaagaaaatagaacacaatagaaaggactgagggacgatggaaagaacagggaagaagtctgtgtttcagtcctggctctaccactctctgatcacactgtgtgatcaccaaagccaaaagtatatacatattttcaaatacctacatattcttttctttttctttttttttttatttggagacaaggtctcaatttttcgtccaggttggagtgcagtggcgtggtcacagctcactgcagcctcaacctcctgggctcaagcaatcctcctgcctcagcctcctgagtagctgggactacaagtgtgtgccaccatgtctggctaatttttaaaatttgctgtagagatggggtctggctatggtgcccaggctgttcttgaactcctgggctcaagcaattctctctccttggcctcccaaagtgttgggattacagtatgagccactgtacccggcaaaaaacctacactttcataaatgttttaggatggtggctgtggtaagcagaataatggcccccaagggtgtccatgtcctaatcccctgaacctgtgaatatgttaccttatgtggcaaagagaactttacagatgtgattaaattaaggatttgagatagggggttatttgtgcaggcctaatgtaaagacaagaatctttatgaggaaaggaagcaggagagtcagagaaggaggtgtgatgatggaagcagaggtcacagtcagattggaagatgctgtgacactggtattgaagacagagaggggccacaagccaaagaacacaggtagcctctagaatctggaataggcaaagaaattctagagcttccagaaggaatacagccctacccagctccttgattttgggacttctcacctctagaattgcaagatagtaaaactgtgttggtttaaaccattacatttgcaataaattgttacctagcaataacaggaaactaatacagtggccaattgaggcctcggtatttagttgggagagggtttaacatcagtggttctcaaccctggctaccattagaatgacctctggagcccgggacatttggacagctctaagagctctccagctgacttcaatgtgcagcttgagttgagaatctagctgataatggattttgttaggtaaatgtgatttttctaagtaagagagtaggggctgtttttgagagaatcttttatatttttttcctaattttttaaatcacatttctatccctctgaaagagaaaaaattaatattacactgtttgaatcagaagacaaaacagacagagaaaactattatgagcaaaaccaaggctgttttttatggtaagtagcaatttaagaatatatatgttctgcatttttaaacaattgaacaattttgtatcttctggacataccaaaatttgaaaatatgtaaagaaacaatacgttaacaaaaatgagaacttggagtctatgctcccctttgtggaaataggctcacctggcacatgctactatgcgtttgtaatcagagtttccgtagcctctgtagtgggatgctggcacataagacaagaaaacaaacagacaaatataagagtaaactgttttcagctgctttggaacctgtcagaacagaatcattaatgagcaaatctttgaacacacttaaaaatgatttgtgatttggaagtttagatactttcagtggttctaatggaaattcatggctattgacaataccaggaagtctttaaataattaacagttcattgctctcaaataacttataatttaatgaagaaattattaaagataaatatgtattggtaatatgtttgggggatgttggagggaggaagaacagatgccttaatttgctggtagttgggaagtttcctgtaggaacaggcttctgagcaatagatggaaaatatcagggcagaggcagcaacattcattctgaccctggaggcaatggggagaccaggaggactggagtgtgcaagtggacttgcttttggaccaggaagggagaaccaaccagcagagggatgtgagggccttgggttaaataaaagggtcaggggtacatttaaagaaaggatggtacaggagagactaaaaaagaaaggggtacaggagagactaagttaaagatggaggcagagaaatgtttattttctgggccccttggaatacagaaaggctaagggatggaaaactaacagggtgataagagaattcaaggtcccagattggaaggctaacacaaaagtaacagaaattcctggttctggaattagaccttaatgtggctttacaactagttacactctttaaaaataacatagtcaaaacaatttattgatcaatagcaaatacatttagcttagtcattgttatttaatattagcttccgactatattaaagagttatctattgtaaaaaatggaagtaatatttacttggatgtcaacctgctaaagtatttggttaagaaatttcactttttgagtaagcacatttttactaatcagagaagctctctatttatacacatgctttatttttagccaaaattacagcgtaaatcctgctgtttttaccttcaatatcctgagtatcgattttcaaataaaagctgcaaacttcctcagaggtactggttttgtgaactacagttgttacctacattggggacaagtaagcaagaagattctatttaaagtgggaaagtgacaaaggtattatggcaacactgctgctgcagatgggatgctcgaaggatcattttcataatccagcacaaatggtgtacattagtgactcatttttccagcagctggactttaagcaaactccataatctaaacctgagaggcccaaagtaagcaaaaaatgacttctggccggtcagaagcttggtctaaattccatgcagtcaaatctgggcacctcactctacaggagagttcccaaggttcttgttttgaacctttccactttaattttacacacaacagcacaaggctaagaagtgtgggtttcttccagccacacgccatcatggcaaacaacaaattataggtgtgtatgaatgggcagaggtgctgccagaagtagatatattgacaccaaccagaagtggcagaaaagtggacaatctctcctcccccatataaacttacaacagtccttgaaggaatgaatgcactaaagataagagcgtgattaaaattattaataggatgttaatttatgctcagaacatgcaatttaagaatgcatgaaaatacttaaacagcctagaaaaatttgcacctgccagctgggcgtggtggctcgcgcccataatcccagcacattgggaggtcaaggtggacggatcacttgaggtcaggagtttgagaccagcctggtcaacatggtgaaactccgtctctactaaaaatacaaaaattagccaggcgtagtggcatgtgcctgtaatcccacctacttgggaggctgaggcaggagaattgcttgaacctgggaggcggaggttgcagtgagccaagattgcaccactgcactctagcctgggtgacagagcaagactccatctcaaaaaaaaaaaaaaaaagaaaaaaaattgcaactgccaagtggctaaaatgaagaaataagtctttatgaataacacataaatcccccaaaatcctggataaatgagatgggatagaaaacatatatatatacaatgcacatatgtacacagatatatgtatatacacatatgccatatgcgtatacacatatataatcataaaattatatatctctataaatatatataatttctataagtatacagaatgtatacatataaggattaaatttttttgtgtgtgtgagacggagtcttgctctgttgccaggctgcagtgcagttgtgccatctcggctcactgcaacctctgcctcccaggttcaagtgattctcctgcctcagcctctgagtagctgggaatacaggcgcacgccaccatgcccggctaattttttgtatttttagtacagacggggtttcaccgtgttagccagggtggtcttgatctcctgacctcgtggtctgcccgcctaggcctcccaaagtgctgggattaaaggcgtgagccaccatgcctgaccaacattgttattttcaaaaaaattgtgaggatagttacaaagattgctagaaagatttacataagtgaatcccactttagtcatggttacccaagcccagatttctgtgactttgtggcaaagctcctaacttttatgttacctagtacaaatggacacataactcgttattggatatcaattaaatacttacatgtactgtagccaagccactgccaaatcctgtactgacaatgaggtcatcattgagaagcacctggaaagataatagagaaacaaaccatgctttctttcatcatttgatagggagggaggatagagctatgaaaagtgggttgacatgtaccagcctcctctctcagagctcttctgagagtaactggatgagacactgaaaatcctatgcccatggcaggtgctaaacaaggctggtatttcccctttcccttctacatgtaaataagatgtctgagatctcctgagtgaaccaacaaaagcaacatgtcagaggtcacttctggttacattttcatttacatatggctatggtaaatctggatcttcatctccttttgccaactgaataaattcctttctgtgcctagctcaggaatcagcatcctgtgtgccaatggagatcgttttcattagaacccagagcagggaacctccacataacttgaaagcgggtgcatctatctttggtcctctctgagctcctcctttgcaccccttttccatctcttgatgatttatcttttccacttgtcaccgcctttgtttgcagaaacccctggtaccccaccccaaaccactagcaccccactcaagcctgccaaatccttagttgctgctgctcttcttcccactctgctaggaggaaactgaagacataaacggagttaagtcattctcctctccagagaaactctgtcatccaaatgctccctaatttgtggaaagtacaggagagataattttgagcccgaggggttggcacttcctttactccaagcctcccctttcctttgcttagcacaataatgcaagatggattgggcatatgttaaagtttctcaatccttccttcaaattttagtaaatgtaggaaagtaggtcaacattcttgttctccctgatagaatatagcagcatttgttggaaaacaggtgtcttgagatactgcatgtgaaaagcatgcatgacaaataagtttgggaaatgctgtgcactgtgccctgcctctgccccttttcacacccagagtcaccacacttaatcacatacatgttacagaacaggggaattctggattaaagaacttgtttaacttaatttaaattaatttgtttaacttaattaatgcacactcaaccacctaacactctttcatggaacacatttcaggaaatgctggagtagaaaattccacactggataataacagcccaggttttacatggaagcagcatcctgggctggggtttaaattttgttaggatgacaagaggcctcttacagcattatccctatagagaagaataatttcagctacctcaggtagctggaaggtcaagagatccttcttagagcttagactcagaacatgaatctccggtgaactctaaatgatcccagggaaaggagacatattcccaaactagggaccacaagcacaaatgcctgcagaggcccgggcacaaagcaggtatgaacataaatgcacatgcatacgtcctgtgactggtggggactgcagtaaattgtagaagccatgccaatgcctggtgctttgctttcaggtcttttggtttatcaagggaagttgggaatcaggtttttatttgaaatatctggatccttaaatgttggcatatatctatgtctatgtttatatccatattcttttttttcagtatgggccaccagtttgcaatttttgcattaaattttatttctctgctgggcatggtggctcacacctgtaatcccagcactttgggaggccaaggtgggtggatcaccagaggtcaggagtttgagaccagcctggccaaatggtgaaaccccatatctaccaaaaatacaaaaaatgagccaggtgtggtggcaggcgcctataatcccgcctgctttggaggctgaggcaggagaattgcttgaacccaggaggttgcagtgagccgaggttgcgccattgcactccagcctgggcaacaagagcgaaactccatctcaaaaaaaaaaaattatttctcatgcttgtttacttttaacaaacaccaatttgtgaaggatgtcaacaatgaggattatttccaattactgtacatttaaatatactttaaaataatgcaaacacagtaattagaaaaatatgtatcagcagctatatgtgggcagctaatattaatatagaacccagtttttccaacatgtcttgttctttgtgaaattttcataagccatcaaagttaccacctttaaaaatccagcagtagcaaaggacatggggcaaggagctggggaccctaaaggccaactccaacctggccacagtctgcatgtatgaccagggccagaagggaccaccagcagcctcccagacatgccttccctcctacgctcactgtactgctctgtgcgctgttatctatgtctggaatgttcttcctttttcttcacttggctaactcattctgattttttcagatttaacccacacatctggacacatctgacaaactccctccatctttcagccaggatcaggagggcccctctgtacttccatgtacctatcaagactcttatttttcactatctgcttaaatgacaatctccctgcactacgctgattgtttgtgttttatttttgaatcctcagtgcccaggatatagcaggcatccctgtttaggacatagctgacactcaatatatgtttaagtagtgaagagatagatttataaaataaagagtggaacagatgatttcaatggtctcagccaattgtaaaatactacagaaagttcttcatttacctctactggcctcccaaggaaattcttgtctgtcattttataattatgtaaggcacctttatgcttgtaagaaacatcgatgtccatactcaagcggagttgtttaaccaggagtgaatattccgtcaggccctcaatggcattgattgtgtcctgtcagcaatcagcaaggcacaaaaatatgtttagtttatttatgtactccctatttacaaatgccctttttatgagagggtagggcagcattgtctggagatgaaactccagctgactcagtaagactggttaagagccccattgtggaggtggaagaaaggtctctccctcctcaataaagatgctgttagcagggacaggaaggaagtgtggcctcagatctgggtcctctatatattctgcaaatgtaacctcaggcaagtcactgtttgcagaattcatctgagtctttgaacaattatctcttcctcatcctttagtctgaccttaagtatctccacaacaaggccataaactcccctttcccgttattctctgttttaaggttccctttttgccctttctagcattcatctcaatttgtaatgcttttatttatagtttattgttggcctaccccactgcaatataagatttgtgaggcaagtaggtaatatatttttcttggtgcctgctgtggtttgaatgtgtcccccaaagttcatgtgttggaaagcttggtccccaatgtggcagtgttaggaggtgaggcctaatgggaggtgtttgggtcatggggcgtaccactttcataaatggattaatgctgcttattatagaagtgaatttgttataaaaagatgagtttatactccactcccaccaaccctccactctgccttctctttgcccttccaccatggaataatgcaacaagaatgccttcaccaggtgcagcccccctgatcttggacttcctaggacccagaaccatgaggtaataaatttctgtccattgtaaattatccagtgtgtcgttttttctgttacagcaacacacaatggactaaggcaatgtccattgcatttagcaggtacataaatatttgttgaaggaataaatgaataaactttatctttctggacctcatctttctcatctataaaactgagaaacatgactagatcagagatgttaaacaatgtggccattccctctgcctatatctgtggcggcaaatgctaatcaatagggcagtcttttctgctaaccctataattgtacccaaaataaaacacattacatggtcagtaaattaatactgaaggccctctctacatctaaattacatatatataaatatacacactccatcattatctaaacatccaggcaacagggaagatattaacattcgatctaaactttgaatataaacatgtattatacgactacataataattagttgtaataaaaatacatactcaaatgagtttacattaaatagctagatagattaacatgtaacaatcagtatttctcccactttttatttatttcgttgtggagaaggagcatcagtacctttgtctacatggcaaccactatttattacataggatatgatataattgccaataaccttactagcctttcatggtgatttagaatcatgaaggaagtactgggcttaaagtcaggagacatgagttctgattctggctctgccatgaattccctgagtaaaactccctgggctaatttcctcttctgtataataagagtgttgacgcagataacctgtaggggtccttcaattctaggcattattcatatctattgcatgctcatttggtggacaaaggcatggaggccagatgagtgtggtgggggagaaaataaaaatgtctacagggagatgaaacaagacaaagaaatgttacctgggttgaataaaagccacctccatacctctgctcttctgatagccatttgatgactgggttaacataatttatatctttcaagttcagactggtgagtaaagcataggcagttgtttctaccatacgtgccgtaccagtgttaggtacagagctgtctttatgctgaagattgtctttccaaaaacgataaatgggtggattacctgaacatcaacaaattccattcattaatatgattaaaaatgtgaatttgacataataattctaccaggtgtattatggccttccagtttctagaagctacttactttttcttgttagaggaacttcctgaagatgaccaatgcaaaacgagatcccttaatatggtattacttgtctttacacattgagcatccctaatctgaaaatctgaaatatgaaatgcccccaaaatctgaaagtttttgagctctgacatgatgccacaggtgggtaatttcacccctgacctcatgtgatgggtcacaatcaaaatgcagtcaaaactttgtttcatgcacaaaattattgaaaatagtgtgtaaaattactttcaagctgtgtgtaaagtatatatgaaacataaatgaatttcatgtttagacttgagtcccatccccaagatatatcattatgtatatgtaaatattccaaaatctgaaaaaaatctgaaatctgaaatacttctggtcccaagcagttcagatcaggaacactcaacctattttttgttttttttgtttgtgtgttttgagacaggatcttgctggcacccaggctggagtgcagtggtgtgattgtagctcactgcagcctcaatctcttgggctcagtgattctcccacctcagcttcctgagtggctgggactataggggtgtgccaccatgccaggttatgttatccagcctggtctcaaactactgggctcaagcaatcctcctaccttggccttccaaagtactgggattacaggcataagccactgcacccggcctcaatctgtattttaaaatcaacatagtacacatgtactaggaaggggcagtttagtagagtcgaaagtgcaataaactggtattgcacccagcttctagtctttcttttgttgctaacttaccatgtcactttgggcaaattcctttagttctgtgtgactcaatttcctaatacctatagtatagataatactttcttccatgcagtgaaactcaaatgaaatactaaagtaaaagattttgtaaactagaaagcaccatgcatatataagggattattattattattattattactgacactaaaaaataaactggagaacctttttcctgataggaaaatttacatcctggaaattatgagattaaacctaaagccttagttcagtctttcattatttctttccaatttaaagcactcaagacaatttcgtacatgcagcacttttcataaattaggctgtaaattatatttgttatttaaacctgtaaacctcaaatcctttttggaacaaactatttgttttaaaaaaagtaatgcatatttggaaatcatatttgaaggttagtaaaaattttgatgtgtatgtttataattcataactacattatttgcatgaccttgaaaatgatattgacccttcctctcagagtctcagatttgctgtatttaaaatgaagagttgagtttaggattttaaagaaacccaactggaacaactcttggattattaagttcccttctagatcttaaattttatgattttatgacccatatctcacaatacccaagacatttcttttgtgttatttttgaagtatcgtacaagtggttttgaggcatatgttaaaatatagtaattttaaaatgatggcacaaatcatattttgtagatggtcataaacctcagtaagatttataaagccttagctagaagaggactccaaagtgcccaaccatgctaataatcactgctactctctttctattttttgtctcttgacctataggaagcagtatctttattcttcaaaaccaaacacatacttttatagcaaacctggtaaaatataagccaggtcatgcactcctttgctcaaaatcccccagtggctccccttttcactctcaaagctgaaattaaagttctagggctccttctggtccccacagcacattgctgtggataagacatgggcactccttgctctaggtggaagcagccctaaactagggtatgtggccgggggagtggagcacaggctagatttcagcctcgattcacttgattgcttaggtactttgtccacggcacaactgtttacagaagccctgaagagtctctctaatgccttaaatgaccttcccttgctccctcactttttccttacctgacctcacttcctactcctcttctcactcctctgcagtcacactggcctccttgccattcttggagcaccaggcatgcccatgcctcagggcatttgcacgtgctgttctccaccaggtacttccttctagatagccacaggaattgcttcttcacctcctttcagctcttgactcaaacaccatcctcttagtgaaacttaagcccagtcagcttgtctaaaattacaatgcatcctctcaccttattttctttccctgctctatttttcttcatatcagccatcaccatctattcataaagctttatttatttatcatgtttgtgtctccccagttagaatttaagtttcatgatggcctggattttggggagcctgttttgtttattcctttattcccagagactggaatagtgccaggtatatagggggtgtccagggtgtacataggatactcaatgcatatttattgaataaaggaataaatagaggacaggtgtggtggctcatgcctgtgatcctagcactttggaaggctgaggcagtaggagtgcttgagcccaggcatttgagatcatccggggaaacacagtgagactcgtatctgcaaaatataaaaaaaagtaactgggttcagtggtgggcacctgtagtcccagctactgaggtgggaagatcacttgagcccaggagatcgaggctgcagtgagccacgatcatgccactgcactccagcctgggtgacagagcgagaacctgtcttaaaaaaaagaataaatatttgctgaatgaatgcatgaataaatgaatgaataacggcacacattacatcgtattgtgacggtttgttccttgaggacaggaattgcatcttactcaagttcacatgtcaccacccacttcccagactagcagactttatgtcttagtgaacactcactgaatacatgtatggaacaagttatacctttaaccaaagcttctctcttcaaagctgaaacaattgaacgaaactgtgggtgagttttatctcccagggaaagagcatacgcagaaatggccaatgtaaaggtgctctgggctggcagtgtattttcaagcagaaagttgtcagctttaattagagctgtgtcgattttctggaaacaagagaagatacttcagtttctatgtcaagcaaccacctatcaattgatatgaactaccctcagatcccactatcctggagcaagcaatatgggggtgaaaagaggactgacctaatggaaatggatggcttctcagtgaagcaaatccctccgagagaaggagcagagcataatcttggaagggacaatgaggttgtccaaatcaggttaagctttttgcctctgaattctcactttccttttagaggttttgtgcctttagtttctgagtacaccgtcagacctagcctccaggaagaaaaggcaccgagcatagacacaatttctttttttttctttttttttgagacggagtctcgctctgtcgcccaggctggagtgcagtgctgcgatctcggctcactgcaagctccgcctcccaggttcacgccattctcctgcctcagcctccggagtagctgggactacaggcgccccgccaccacgcccggctaattttttttttttgtatttttggtagagacggggtttcaccgtgttcgccaggatggtctcaatctcctgaccttgtgatccgcccgcctcggcctcccaagtgctgggattacaggcgtgagccactgcacccggcccatagacacaacttttattgttccctctcagcgtagttgcaacaggcacacaggttcaaaaggagttacacttaaaaaaataaataaataaaacaataagtagcagaaagaaaccctaactgccacagtacttttagatcctaagaatgcctgggtaaatagtcccgatcactagtcctgacgccaccaaaatggttgtgttgggcaagtgggccagcagaaagcctgctgcgatgctgctaacatcctgcctgcctcctctcccagctccacatgcatctctcacccatgtggccactaggtgcctgggaactagtcttcattgattattttgtcttgttaagcttctgaaacaaactgaaaacaaatggttttgttttgtgcttccagttttgcaaatccacttgagattttccatctcaaccttggaaatcttctatgttgatttacttaggtggctcatcacttttctcccgtttccaagcaaatgttgtttggaaggatttggaggatacacatttgctgttgtgtatcctcagtacttgcatgatacagaatgctttcactataggataacagtaacatataaagcaggatttagcaaagataagacagagaagctgggggcactggatcattcttccatcccagtcccagctatcagttttagacccagctctacaatttattagcctgtgacactgggaaactgaattcaccttacttagtcctcagctttctcaactgccgatgagtaggttggactaggtggtctctaatatctatcattgttctgaaatctttcaattctggagtttaagttattttcaagttattggaaagaaggaaaagaagcttttgaaacaaaaggtcttctgattggtggcccctccagtatatagtacagaaatagatgatgggtgtgagagaaagaaaactcttacttaccaccagggggcatatatcgaaagcctttctaattccaatcacagtaaaggctgtaagatataagctgttctctcgggcttcaacaggcaaggtaccctaaaaagaagcaatgttttaaaaggggagtgaaatggtgtctttaaggcgaaatgacctgattctactctgttttttgtttgtttgtttgagatggagtctcactctgtcacccaagctggagtgcaatggcttgatcttggctcactgcaacctccgcctcccgggttcaagccatcctccggcctcagccttctgagtagctggtactacaggcgtgcactaccacgcacggctaatttttgtatttttagtagagacggggtttcaccatattgaccaggctggttttgaactcctgacctcatgatccgcccgccttggcctcccaaagtgctgcaattacaggcgtgagccaccgcacctggcctctactctgtgttttaagccttatctcccactctttcccttcctgcttcccatttctcaataagccctgggtctatctcgcttgagtgctttcacttgcccatctacctccaccccgttaaacgagaggtctaagatatcacttctctgatctctagtgaactgtctgaagatcgcttcacttcagatattatgggaaagacctttgtatattttgcttgttcacaaaggaatttcttgcagaattacatttttttcttcttcttcttcatcctcccataatcagatgagaataaaactcaaactaaataaaactattgctaatttgtgcatttggtttccttacctgtaattttattggttgatactgtgaattttccttgaaagatccattatctaattgataattctcaactagccacaataaagaattacaaattgaattttggttctgctctacgtatttatttacttgtccaagtactcttaaagcaaaagctgttaacctttaagacaaaatcaaataaataaatatttagaacgctgaatcccttttgactttcaattaatttatacaactttattctttaaaagaaaataacattttaaaacatgcaattccaaagtaagtcatcattttacaaaggaagggaagatttttggaatacctccaaaacattcggtaaacaaatgtgaacagcacatcttctgtgattacaacattgtccgctagcacacaagctaaaaattgattcctgatgataagaattacactctaaagttaaagataacagagataaaataaatagttttgagtcaaggcattgacctatgaacatgagacatgaaagagtaaatcacaaaattctagattgtaaaatttgtgcattccatggaatctaaattcctatctgaggccccaagtcccctttcccaatgtccctggagtgtttatctcacttgtccttgagtgctgccattgacacagaacttactaccccacaggaaattttaatgatcattattacttagtcaaaaagcaatttcaagtctctactaatacccatcgaagagtatcagagaggattgggttcatccccccataacatctcttcactctctcagtcgcccaggaggctccactccccaggtcctcaaatgtctgagactcagaccacttgacttgctctcccacttcccccacttaaaaaatttgtgtttctttttcattttcattttttaaatgtattttaagcatttttttaaagaggtaaaaccctcacatgattcaaaaatccaaaagtgaagcctgggcgtcatagtgagacattgtctctacaaaaaatgcaaaacattagccagatgtggtggcaggcacctatagtctcagctacttggaaggctgaggtgggagaattgcttgagcccaggaggtagaggctgcagtaagctgagatcctgccactgcatccagcctgagtgagagaacttaaaaaaaaaaaaatccaaaagcacaaagggatattttatgaaaagtctccttctagcagtccctgtccccctccacctcccaacagaagatgaccattgtttcttgtgctttcttccaaatagtagatacaagatatagccttcccatctacctttccatcccaaccacaccaaaatggtgggagaatgtttacattatcctgtacttggctttttttccatttagtaatatgccttagagatctatattaatacataaagtttccttgttcttttacaagtgattttatacattaaattatagtattttggtacagatgcaccaaagctatttaagccatttccctttctgtagacatttaggttgttctcagtctttgctctaattgatttaattattttaaagattttttttttgatattaatcggaacttgcccctccacaactaggtgccttttcctaattctttctctagaaacatcagaaatttattttctactctattgacttttagggggtaagagttgagagctcctctctttttaatcctcccacactgctctcaaggatgagaaatacttctacggattgctcaggttcaaggacactcacattttcaaagattggcccacattttacattgggtctctcttgggattttggcttttggaagtctctcttcttttagcaggctagaaaggcatatgagtgcagttatacggccaggctgcctctccacttatctatacatctgtatatataaagatgctttagttacatctttgaaaaaaggcaatggcaataaatagaaacaacggactcatcctttgggatcaattataaagattaaatatatgaacatacttaaaatagttctggattatagtaagtattcaataggtataagctcttactttttttttttttttttttttttttcagacggactctctctctgttgcccaggctggagtgcaatggcgcaatcttggctcactacagcttccacctcccaggttcaagcgattctcctgcctcagcctcctgagtaggtgggactacaggcacgtgccaccatgccaagctaatttttgtatttttagtagagacagggtttcaccatgttggccaggctggtctcaaactcctgacctcaggtgatccacccgcctcagcctcccaaagtgctgggattataggtgtgagccactgcacctggtttttataagctcttactcctatctctctttctctttggtactcttgggtgtctcatccctggtatccttaaggagtgagagtctagacagcacttccctaaaggtaaagcaaatacaattcgctctagctttttgcgttctcctcttcccactgacctgtcccttggagactgccctgaaattcaaattttaagtgtgacatggaggaaaaaaagaagtaggctatttgatttgcttttgttccagaccctaggctacctctacaagtgcttaatatggtctagtttagttcctcatgttttacagtagggtctgggactaaaaatttagagtagaaaagaattttttagtcaccttgaagagaaatctggcaaaatctgatgaaactgtaaatatgcattccttatgttccagcaattctatctcctgggatataccctagagaaactctcacacatgtgcacaaagagacatatgaagatgttcattatcatattgtttgtaatattaaaatttggaaatggttgtccatcaagataggaatagataaagaatatatactatgtgatatatttgtaaaataaaatactgcatggcaatgaaaaggagtgagctatatttacctatactactagatctaaagtaactaaaaagtattaaaagaaaaaggtaagttacagaatgataggtatagtatgatactagttataatcatttagaaatacaaaaagggactgtaaacccatcacttcattttggaagcaaataaccattctttcttttacaatgcttaactttcttaaacagtgcttacttaagaattccaggaactagccatgagataaaaatcaaggatgtgaaatgtcccctggagaagaaaaatactgagcagttaatctacaaacctgtttcagtctagctgaccactagatggcccgttactcaagataataatcagaacaagacatgctgacctgtacgtagctaactcttgcacacagttttccaagccccttcctctttaaaatccctctggccagcctagggcatttgggatagtttcctgactctagtctgccatctccttgggttgctggctcctgaattaacctgcttttcctcccaccaaccttagtctcttgagtttggcatttgagcagtgagcagccaaactggagttaagttacagctatatgatttcatgtatatatatactatataaaatattaaaaatgttctggaaagatgcataaactcatgatagtgaatgcccttgggggaaagaaacagaaataagatggaggcttgtagttaaagagaaaagttcaatatccacaatgttctttaaaaaaaaaaaaagacgaatataaaaaatgttcatcatcatcaattttgggttttgctaatatgaatgatattcgtactttaaaaaatctgctttgtatttctcaagaaaagtttgagggtatttaggtgctggacattttcttctatgtctattatttctttcaaggaactcatggagttgggtgtatgtttcagtcttgccccaaactcttgaaaggctctgagtgtttactgagaggctgttgtaccttcctgtggggctttctgctctccaggcatctatttcccaggtcctgctgtgtcagtttccagtcttcattgacactcactcccactcctgcatcctgggttatcctctggttggtgtgctgcaggggtctatgagccttttatttatttttttatatttttattgttttattaaagacagggtctccctatgttacccagtctggtctggaactcctctgctcaagccatcctcctgcttcagcctcccaaagtgctaggattataggtgtgagccactgtatctggccctgtgtgtcttttgaagtgtgtcacccacacatggtcagacctaatcctaaggtataatctatggaacttggtagctgatcagaggtaaagccaaaaggaaaggaaggaatcaaaaaccaactgatgattctgacttgatccatgggggacaaagggcagggtattgttgtgcactgagtaaagaaacagaagtgtatttgaggaagaaaataatgaatttggcacatattgtgcttgaaggatctttggcttccggaaacctagaaatatggatctaggacatttcctaacttcttaggaaagaagttaggccttgagacattgattagggggccattggcctagatgttatggaaatcatgggcaataatgagactgtaccaggggagattacagaaaataagagggccaaagataaaattctgggagatctcaatagctaaagaaaaaaaactggccaggcgcagtggctcatgcctgtaatcccagccctttgggaggttgaggtgggtggatcacgaggtccggagatcgagaccatcctggccaacatggtgaaaccccacctctactaaaaatacaaaaattaggcatggtggtgcgcgcctgtaatcccagctctcaggaggctgagccaggagaatcgcttgaacccgggaggcggaggttgcagtgagccgagatcgtgccactgcactccagcctgggaacagagcaagactccgtctcaaaaaaaaaaaaaagaaaaaagaaaaaagaaaaaaatctaaaattaaagtattctaggttgtaaactccttaaatatgtttcatatagaacctacaaagcagctggcacaccgtttttattaaatattttgtcatagcatgatggtttttttgttttgttttgttttgttttttgagacagagtctcactctgtcacccgggctggagtgcagtagcgcgatctcggctcactgtaacccttgcctcctgggtttaagtgattctcctgcctcagcctcctgagtagctgggactacaggcacatgccactacgcccagctaatttttgtatttttcatagagacggggtttcaccatgttggccaggatggtctcgatctcttgacctcatgatccgcccgccttgtcctcccaaagtgctgggattacaggcgtgagccaccatgcccagccggtattttttgaaaatagactgccatatggactcttaattaattcagactatctttccctcaaatcatcagaattttggaagatatgtttcattgaataaatacttactgagcatctactatgtgccaggtaggtaccaggcactagggatacttagaacttcccgcatggagcttatattccagtgggggagatacacaatagtggaataagcaagaacgttagtaatcacactgaggagaaaagaaacgatatgaggtgttgggaggggagtggattgcaattttagacattatgatatagcagaggcctccccaaggtgacatttggtaaagacctgagggaaatatgagagccagtcatgctgacacctaaggaggagtattccagactgagaaaacagtgcaaaggccctgaggtggaagcatgcctggtgtgtttgaggaaggctagtggggctgaattggagggaaagagagtataggagataaagtaggagacatgaggtggagccagatcatacagagctttgtaaatcacaataaaaagtttggtttttactctgggtaagatgggaagctcctaaatggttttgagtggcatgatctaacatatgttttaacagggtcacttcagttgctgtgttgagtatatactgaagaggatcaagggctgaacccagaagactaagggagactagtgtaagaatccaggtgggagaggaaggtgtcttggaacaggatagtgtggtggaggtggtgagaagtagtcaaattaaggatatattttgaatccatatctgctggatcagatgtgaacggtaagagaaagagaggagtgaaggatgacgaggcttttagcctgagcaactggaggaatggagtttccattatggttattattctttagttaattaaccactatatgaaaatgcaactcaaaatcttctacttaccaagtgctagcacttccacccttccacacactgtaagagtagtcagcatttctgtaggacataatgctcaacatccctaagaagcacaagaaaaagaacacggtgcttaacagacctccgtttctactcaaagaacactttatcaggccctgagaatggtaagcttcctttggtgttgggcagcaagcatatgctctgtggccagcattgaacttctcaaaggaagtatatgaattgctcgaattgggaattatcaagtagaacattctgatctcattcgaaaaggaaggaagtgttctgtagtttggaatgcaggtgccttgcctctcattcaggcattttggtaagttgagccaaaatgctacagaaataatatttatttatatagtagagtccatctcatgatttttttgctaaaattctcttacaaagttttctataattcacaacttaaatattagtttaataaaaatattagtttagaatcacccaatttttatgtgaaatactttttttttttaccttcttttaattttttcttcagtttctgcttttcaattaatgggtcagaatgaaaaatgttccaatgatttcctgtttccaggtagtgaaaaacatagaatactgggacaacgctcatcagctccgcctctgcactccctttggggaggtgggttaggatattgatgccttcctgacttagaactgcagacaagatctcacctacaagcagtcctgaaacaaaaaagatcaaagtagacacattgctttttattaacttctaacagtatgttctcaagagagaagaacaaccatctagagatggttcttccctttttatctaggcagttgacttgcttctcagaaacggggtgagaaaaaaagatccggttaggaacatgaatttgaaagaaacaaaaaaaaaaaagactttaaaaatcactaaaatatggtggtaggtaatgtaatacagtggactgattgctgcaagagaacatggcaaattagttgccattcaacctgttagctttagacattataaaccatatttaccaatcccttccaggaagcaaagcaaagagcctgaacagggagtgctgacatgactgtctataattcactgtgcaaccttggacatgccactttcttttatatccaacagcagggttgcacatgatcaaaaagatcctttccagtactaacattttgtgattctagggttttatctgagataaaatgtagtcaggacattctatcattcggtaatatgttattgaattgtaaagcctggagactaaggaaaacctagtcacttgtgcaaatatcacttctgcaaatgtatgcgaggggaggagaatccctgctatggtttgaatgtatatgtctctccaaaattcatacactgaagcctaatcaccaaggtgatagtattagaaggtggggctttttgagaggtgattaggttatgatggctccaccctaatgagtgggattaataatcttatagacgaggtaagaggaagttcttcacccctttttgcccttttgcctttccactttctgccacaggaggatacagcaacatatatcctcatggaaacagagagcagcccttgccaaacacccaatctcttgatgccttgatcttggacttcccagcctccagaactgtgagaaataaatttgtattatttataaattttgttattttgttatggcagcataaatggactaagacaacccttctgggaccagtacttcagcagagcagtgctgttctcgctaggccatgtgcaggccataggccttctctggagcgggactggccactaagaccatggaaagttctttaagtctagaagcaactggacccccattttagagacatctttgagccaatgacagtccctaccttccattggaggagaatgcatctccatgtaaatcaggccgttggaagaagatagtgggaaaagtgattaaaggtttgaaagtgggggtgggtaggggtggagcactcctaaaggtagatttgtgtgtgctactgaacacggaagtggagaaacagaataatcatgaggatatttgatttttgtttgaagcaccaagtgaaatgagaaataaaaatggcatttgttaatttaccttttacactcaaaatccttttgatttctgttttggggaccaaatctaagggtatcctgtatgggaactcctttcgtctgctaatggtacctgtaatttagaaaatttggatttatacagagtttccaggggaagactgtttgcagattatttataatgtatctacttccaaagaatatttcaaaataaaagacttataattagactattaaaattttaaaagaaagttaaaaatcatcaaggactttaatcaaaccctaggcttgtataatcttattaaataaagcattaaatttggctgtaagcttcctggtcattataagatgtgaaataaataggttatataaatcttattcaccagcaaaatatagcatgccagcttgcccaaagacagaaaattgttcctggaactgaaagctaagaataactaacatgtaatttcttaatcaactatatattgaacattagctccacagggaagtatgatctgaaattctttccaccttcccttcccagtctagttttgatactttttaatctatgggcaaaacaacagagttttagcatactggtatcagataatttttctactgtgatcactggtttatgtccaaaaaaaggtaacattgatcattctactgatagagtaccaagcatgctactaagttctttaaatgaattattgcattggattctcacaacagtcctctatgttaggtctattttcattagtttaattttatagatgaggaaattgaggcttagaaagtaacgtgttcaaggtcccagaaacaatacaagtggagctgcaatctgaactccagaagttttgctgcagagcccacactagtcaccacaaagagaatccacctcccattgtcctgctaagaaagcactctgggggcaggaatcatttctcattccagctgtagtcctggcacttagcacagaccctggcatatggaagatgctaaagaaaaatgagtcacattttgcaatttaatggacaagccacatggctttcctaaaaatgcaggaacattcctcataaaacttctttcttcattaatccttgataaatgcagaggatatatcaaaataaaattcagaagacatttaagaggtttgcactttgagtgaaagagcatgaagttcaaaaagagcttagtatatatgtgacgctgggcaagatacaacctttcttagcctcaatttgttcatcagttaaatggagataacaacattttcctcaaaggatttttgtgggataaaaataatatagacaaagagcctggcatacaattcatgctcaatatatgatacttattacagatagccttgagattatctagatttgctccttcaccattttctccattgaaacctgctcttgactatttcaattccattggcaactctactaccaggtggaaaaggtaaagagaaagttaaaactaagagaagttaattttattcctcatcagtgatcacggtaaaagactcatcaagacatcacataaaaaggcaggttccagacagattaaaacattttaaattcaaatctataaaattaacagaataaaatatccagcaatgtctttgtgaactaagagtagagaaagacctcttaaagattacctcaaaaatatataaccataagatgaaattatgatggatttgactacatcagaataaataattccttttcaaacccatgaaggcttgttgttgctcaaagaggtacatcagagacaaaatcaagaagaaattttaaaaggataacccaaatagaaaatttaaaaacgtgcaaaagatatgaataggcaattgacagatgggaaacccaaatggacaagtatatgaagaaatgcttaaaatcattagtaaccagaagaatccaaattaaaacaataatgagatagtgctttatacccattaaaaatgccacattttagagaggcaagtgttggtgaggttgtggagagacgagaaccctcgtgcactgctaatggaagtataaccattctgaagggcaatatgacaggactaaatggcattaaatatgtatatatcctttgacccagctcctggatatatggtccaggtaaatgctaacatggatttttcaagggaaatatattgtatatacagtgatggataaaatggtgagggaacatgctctgaaattctatgtaagaaaaatgaattaagtatacctataacaatagagttatatatatatatatttttgagacggagtctcgctctgtcgcccaggctggagtgcagtggcgtgatcttggctcactgcaagctccgcctcccgggttcacgcccttctcctgcctcagcctcccgagtagctgggactacaggtgcccaccaccacgcctggctaattttttgtatttttagtagagacggggtttcaccgttttagccaggatggtctcgatctcctgacctcgtgatccgcccgcctcagcctcccaaagtgctgggattacaggcgtgagccaccgcgcctggccgagatatttctttaaaactaagccttgagtgtaacaacttaagacagaataggatctatagcacaatgttacatatacatagattaaagaggtacatacatacaaaacaacattacctttctattcaaaagtatacagcaaacacatttgagtgggtacacttggaggaaggggaatgggaatggggtccgggatgaaggaaaaaataaaacgagaggggcctgcctaaaccaatgaggatggtgtgtcaggaaatgagggagtgagaaacttaacactctgcatttgagatatgagacgagttgggagaaaagggcttatcagggacagaaagcagaaactaaagactagagctagtcttaagcattgagtctctgtgtttagtctttttttaagctggtgtcacacaattttaattactatatactgtttgttctccctcattgatatattttttcagatttcctttaacattatagtccatttatttttccaaacactttttagcatttttttttaactgaaccctgtaaagtatcatagttgtatagcgatttcaatatataaatatcagaaataggccgggcacagtggctcacgcctgtagtcccagcattttgggagtccaaggctggtgggtcacttgaggtaaggagttccagaccagccttgccaacatggtaaaaccccgtctctactaaaaatataaaaattggccaggcatggtggtgagtgcttgtaatcccagctattccagaggctgaggcaggagaatcgcttgaaatcaggaggtggaggttgcagtgagctgacatggcgccactgcactccagcctgggcaacagagtgagaccctgtccccccaccccacaaaaaaaaaataataaatattagaagtatttaataaaatatctgaaataagctgaacagaatttttatcttttccctctttagctctgcagaaatcaggaaagctgcctaaacccaagttgcctaaaatgttaagggaaaaaagtcatatgagaagattggaaagaggcacagatttttgttttaacccagattttctctacagagatttattcccagataaaagattgttcctatcctgtggccttgatgttcacacctaggatgagtaaggcaagactgctctggaaaattgtttgcaataatgtcagcagaagaagcatctgtggtgaaaaaaaaaaaaaaaagaaagagaagccaaggacacagtggcttttgaggcttgatataattgcatgaggctaaaacccttgaaacttgtaatatctctacccatagatcattcacaatgagcaggcaaggaggaggtctgtgtgaagaaaaaattggagaaacaagtaagcatgtggacgcatgtacatagatggattttactttttattgctctactgaaataacactcctcagttcatgatactcagatgaattaaagtgtaaagggtattaattctttgctttcccagaggaaatgacactgatgatagtgatcatgatctgtaagtaaattttttccccattgttatatcattgaaataaaacaaaaattattgatacaacgttaagataagttgtaagcatttaataagaactgcagtaatctgtcttctttagttgaaaagagaatggttaactggccacatcctaaatttcataaatacatgtatatgtatttaggccttgattaagtactcaaatgtttgcaaaattctagctttgagaagatttggaatatctcaattgaaggaaaagtagggaagcaggagcaatgaggaatgggtttgtttagtgattaattagcattattatgttttcaaataatgcatgttaattatgtaaatgactttttcttaggtgttctttggactgttggctcaataataatatattataaattattattgtgatggatagacaatgaataatatatgagggaagtcatgcaattgttactatttcaaggccttgcattcaaaattaatggaattattattgttgtgtctcagtcattcagattatagtagttgtactataatgctatcaagaaagatagtgatctaagaagtggatacttttttttttttttttttgacacagtcttgctctgtcgcccaggctggagtgcagtggcacgatctcagctcactgtaacctccacctctcaggttcaagcgattctcctgcctcagcttcccaaatagctgggactatgggtgcccaccaccatgcccagctaatttttgtatttttagtagaggtagggtttcactatgttggccaggctggtctcgaactcctgacctcaaatgatccacccacctcggcctcccaaagtgctaggattacaggcatgagccactgtgcctggccagaagtggatactactgattttagacaattcactttctgaaaaatagtgttttaagttacatacacactttaacttctaaagcaaaagataacatataaaataaaaaatcattttgcctaccataaatacccctaggatccaaagtaacaccagaatagctttcccttttgacaccttctggctaaaataaaggcagaaaacattcagttaaaaacataagtttatataacctgaattccctggatcaacttttctggaccacttttcaaactaaaaaattatttttcttggaaaaggcaaactatgtataaatacttacatggatataagcagcaataagattttatggctatttgcatattgaccagagcaaatgcttaaaaagaagttatttataagccagataattgttctaagtgctttatatgtattaactcatttaacctctaaaaacctctatgaggttggtgctgttattactcccattcgacagatgaggagactgacacacatggaaatcaagtaacactgtcacactgctaggaggtgatggagccaagattcaaggcccagcagcctcgctccagagactgcatggaaccacagtgcaaggatgcatgggaatgtgctttgcacaaaataagtcggtacatgtttactgaagtgaatttcatagctgaaaacagagagtgaagagccaggaaatccagtctgtcattaattggccatatgacccttagcaagaatcttagtcctttaaaagtactattatttttaattggtaaatcatacttatataaaatattaaaattatataaaaatattaaaattacataaaaatattaatgttaatagcgtgaatacaattaacagactgtgggtaaattgtacttaacaaattatacttttcttcttttttgggactgtttatttgtttatacaatggaaagttttctagactgcaagttctttaaattcaagggccatgtcttatttattgttttatctccagttccttgcataatgtctggcacatagatttcaagacacattttctgaatgtattaaggggaaaaaaaagcctgtgtaccaattgtacctgtataccaaaaaaagacgtgtaccaattgttaaaattagatatctctgggtatgggaattattgatgatttttatttatctgtcgtttttcagtattttatattttctacgaaacaaatattgttttattaaaaatttttaagcacgatttcagacttacagaaaaattgcaagaatagtacaaaaaaaatctggaataacctccatccagtttccttaatgcttaatgtttcgttaaatttacactattgtttctctcccccccctttctgtgtctctcttttgcaataatttaagcataagttattgaagcatgtttttcttaccaccactcgtaatgtttttactaagatttcttttccaaaccaagtctccagtgaaaaattgatgttgtgaaggccaatttccagaggaagcacagtgaatgtcaccaagtgactggaggagccctctactttctggcgcacacatttggaggactttgtgccctgatgatcaatgactgggctttccgaagtgcagattccctccacagcagacattttaacacagaactgaaatacaagtgaagaattatatcaaaatacattttttttttttgagacagagtcttgctatgtcgcccaggctggagtgcagcggcatgatctcagctcactgcaacctccgcctcccggattcaagcaattctcctgcctcagcctcctgagtagctgggattacaggcatgcgccaccacacccagctaatttttgtatttttagtagaggcacggtttctccatgttggccaggctgatctcgaactcctgatctcaggtgatccgcccacctcagcctcccaaagtactggaattacaggcatgatgctgtaatccgtgcccagactcgaaatactttatctctaaaaaagttgaccttgattatgcttgtctggacacaaactctccactttaacaatgttaaaataatcccttagattctaaggcacagaagaaagttcatttcagatttcctaacatagacacacaagttgccgtagagtttagcaatgcaaacagatgtctagaaaagtcaacactgtctcagaaacatcttacctttcttagactgttacgtactaaattgggtacagagctcatgctgttgtgatagcacttattaccctgtctctttacatgtttgtgtttcagatagtgggagccttaggctcaggtactttttcattttcatcttattcatttttgtatcttttagctcagcctctggtattcagtaaatgatgggtttcatcaaagactgaaaattccctatatcggcattcaaggccctgcccattatgtccccagcttacttttctaattttatcaacttcccatttgtaccccattttacaaccaaactctggctccagaaagacctggattcaatttttggcattcctcttattaactggtgatggaaactggttgcatgaactctctaatcctccattttctcatctttgtaatgggaataataatagtgcccactgacttctggctcaaatagtaaacatttttcatcttccctccaaattctggtgaactgatagaattgagaactatacccaaaataataaatccataaaatccagaataagtcaagcaggtaaacaaaagagagcaccagctattcaaccactaattttgaggaatttcttgaaaacagaaagttccttttccttcttaactatcttcttgggagacaaccaccagggtgggagaagccagagcaaaagactattggatcacctgcggccaatgatttccttagaacagcaggggagggtggggaaggatagatatagaagagtcatttaatacaattcagcataattgcattacaaaaactcttagtaaattgagactaaaaggaacttttgaaactgatagaaaatataaaaaaaaaagtggttctggtttcagtaatagccaaatagcttatattgggcaacctttctgtaaaaataaccacaaactctagacaagatacatattaaaacaaactacctgcagatactagagagtgggagggaaagtgacacttgggagaagggaatgacactgaataagtgtcccgctttttatagctttaccctgagggcaggtcccattggtgccttggagtggctaaaaccccagtagaacctgacatcatactggtttaggaactagaggacaaagtagggaatagttaccacagctgaatagtgaaggaactccaagttctgtgtataatccttgctcaaacctggctgacccttgacctatgcacagcacagatttctagcatccagctaaggctaaaaatactgaactgagatttcagagtctggaactgaatccagccaactgcctgctaacacacacacacacacgaaaaatcttcagaggaatgtaatagaatccagagtctttataatatttttattaataaagtagaagattcaatccaaaattactagataaaaagaaataggaaagtgtaacccacactcaggaggaaaggtaattaacaggaactaagcccaaaatatcacagatgtacttgtttcttattttgatatgatggaaatgcactgaaaatttaaagattaaataaaatatggcagtatagtgatatgcatgacactttaaaatgctgtcaagttggctgggcatggtggtgtgtgcctgtaatcccagctacttgggaggctgaggcaggagaatcgcttgaacctggcaggcggagcttgcagtgacccgagatcttcccattgcactccagcctgggcgacagggcgagactctgtctcaaaaaaaaaaaaaatgctgtcaagttatatataattgtgttattgcaaaggacatacaaaagagatggcaggctagatttggcccatggtccataaattgctgacccttgatttagttcataaagcaaaaggataaagagatgtaaaagattcaatatggcaagtcaatttcccttatattaattcataaattcaggacaatatgaaaaccctattataattttaaaaggagaattcaacaaactaattccaaagtttatctggcagagtaaatgtgtaagaataacaacatcaaaaacgtttgaaaaataagaataccagagagtacttgcctaatagttatacaatataaccacaaatctatggtactttaaatcagtgtgatactgatgtaaacaaaacagaggagagaatctataaatagatccacatatatggaaattcaatatatatgggggcaagatgacattttaaatcagttggaaaagcatgaattccttaacaaatactgctggatcatctggctatttgggattagatccttatttcagataaaaaaatctaaatgctcacaaaaaactataaaagtactatagaaaatatagaaaaaacagttctttagaaaaacattttattttaggttcggggcacatgtgcaggtctgttgtataggtaaatggcgtgtcgcagaggtttggtgtgcagattctttcatcattcaggtaataagcatagtacctaataggtcattttttgatctttacccttctctcaccctccaccctcaagcaggccctggtgtctgctgttcccttctttgtgtccatatatactcaatgtttagctcccacttataagtgagaacatgcagtattttgtagaaaaacgtttttaaaacttgcagtgagaaaagatttccaaaaacacaaaactcaaatgacataaaggaaaagatctacagattttataacatacaaattaaaaacactaataacaaagttaaagacaagtagcagattaaataccagcaacatttataatcaataaagaatttatagctctaacatacaaagtgctcctgtaaacaataataagtacatttgttgagtactcactatgggccaagtactatatttacatgaattagctcatttaatcttcaactatgaaatagatactattatcatcccatttgtcagatgaggaaactaagcaagaagaagctaggtaacttaccccagaaaaaaggaactcaatggaaagcaaaagaaaggatattaaagtagtatataggatatcatagaatacatgaaagaagaaatacaaatggccacagacaaatgaaatgaggttcaacattgctagtaatcagggtagtgaaatagaaacatcagtgacatatcacttgtgtctgtcaacttggcaaaaattttatgtgtattaacaaacaatatatagcgcggtctttcatgtttttaaatattatgtagttgtattcattgtgtatacatattattctgcaatttgcttttttcagcaatgttacatttttgagctttaatcaaaatgatgcatgtagttatctagtccattcatttcaatttctgtataagtgttcattgtatgaataaaagaaaaaatgtttattcccccaaattataagaatgtgagggatcaaggctacctgcatacacttggtaagaatgtcaattgatggaatccttttggaagataattatggcaatatttattatcagaaggtaaaatgtccatgccctttagcccagttagttcactccaagacaaaacatctatcctacagaaatatacatgtaggaagatatgtatgcataaatgcagactttgcaaaatcagttataatagtgaaaacctgtaaacaacccaaatgtctttaatagaaacatggttcaataaattatagtatacccaccatgtgaattactgtgcagccattaaagtaatgaagtaaatctgtatatactgatatgaaaggatgtctctgataatattattggtggaaacacaaattgctgaggcagtgtgtgtatatatatatatatgtatgtatatatgtatagatatgtacatatatgtatatatgtagatatgtacatatacgtatatatgtatatatacgtatatatatatatgtatatatgtatatgtatatatatgtatatatgtatatatatgtatatatacgtatatatgtatatatgtatatatatatgtgtgtgtatatatatatatatatatatatatacacacatacctacacaagccgattttatatgtctaagactaggtgagcagaggagcccttgctgatctcaatcctacagttgagcagagtttggctgtggcctctgtgccttacccatctgttatggccacctatttatgtgtctatctcaaattacaatttacatggtttaagagtgacacctccttaatcatctaccaaaatcctttggtagccaagatcagtgtgagttataaaattatgctgagtctgttttgatgagatggtctgactgtcttagtatctcagtttccaagcctcaagcccatcttgaatcaggattttgagacatgaaaaccactacaggaacctgatggagaaatggcctttggtatctctatctgagttatgattatcttaaattcatgaagcattctgtctgcagaaaagctagtgggtttaaaagaaataatgtaaaggcaactttacagcttcttaatcaaggtccttctccaactcttcacgttgtatttagggtggtggggatggagccaaatgagggagggcaattccacagggctgaagatggtggcatgattcataggatttatgcaaaccctgtgagtaaattctaaggaagagaaatgagtaacattttgattttatttctgtaaaaataagataatactggccgggaacagtggctcatgcctgtaatttcagcactttgggaggccaaggtgggcagatcacaaggtcaggagttcgagaccagcctggaccacatggtgaaaccctgtctctactaaaaatgcaaaaattagccaggcgagctggcacatgcttgtaatcccagctactcaggaggctgaggcaggagaatcacttgaacttgggaagcggaggctgcagtgaaccgagattgtgccattgcactccagcctgggtgacagagcaagactctgtctcaaaaaaagaaaaaaaaaaaagataataccatcagtatggtaaattctgattacttaagtttattccccatttacatcctgtggccaagtaaaatttgtgtgtgcattctctgatatttagtgttacctgatgaaacaagtttatatggaaaagttcatttttactgaaaattaaaattgtgaaaaaaagagtgacatttcttaacatgatttggattgaaaaatgaaattggcatttctatgacaaagagtaagtctgattttcgctgatcattttatcaatgaggactgatttttccagttagattatatgacaaacatattacataaattgaataagctaaatgtgaagctccaagatataagattaaaatatattgataaaggggtaataaaattgacaatatttttattttatcaaccttcctgataaaattgggttgaacagcaatgcctacctctataaaaatgaaaaataagaatagaatttatgccaaactctctctcatttctaacaataaataacatttatccataactattaagccaattgagagaaaaatttcatttatctaatgagaagataattttttttttgagacggagtgtcgctctgtcgcccaggctggagtgtagtggcgcaatctcggctcactgcaagctccgcctcccgggttcacgccattctccggcctctgtctcccgagtagctgggactacaggcgcctgccaccaagcctggctaacttttttgtatttttagtagagatggggtttcaccgtgtttgccaggatggtgtcgatcgcctgacctcgtgatccacccgcctcggcctcccaaagtgctgagattataggcctgagccaccgctcctggccgagaagagaatttttaaataaaattttatttctatatttaataactttagaaatatgttattttatcaatagtatactaataataatatttgtaatgatacctaaatccacatatcatttgatacttggaattttacaatcatgaaattttaagatatttcattttcaatgtatgtgcatatttttgttcattaaagtataataaggtgatcaacagaaaaaaattcatgcataaaatatgtaacattaggggagtaaaatggaaatatgaattcattgaggaaaaggaatgatatgtaatctgttgctaagagcttattcgagcccaggagcagttcctcatgcttgtaatcccagtactttgggaagctgaggcaggtgggtcacttgaggtcaggagttcgagaccagcctggccaacatggcgaaacctgtctctactaaaaatacaaaaattagccaagcatggtggcgtgtacctgtaatcctagctactcaggaggctgagtcatgagaattgcttgaacaggggaggaggagtttgcagtgagcggagatcgcaccactgcactccagcctgggcaatagaacaagaccccatcttgaaaaaaaaaggcttatttgagcatttaaaaaattgattgctatggtatttggagtctgctatacataagtttgataaaacagttttattttaagataccaatatttaaatattttaaaagtaatagattgccatcttttaaaaaatgtatgataaaaattttagatgccaattttaaaatgtgtcagagggcagagcgagactccgtcttaaaaaaaaaagtgtcagagggatacatagtttttccaaaacaagagggtatgtaagcaaaattttaggaaaccactgaaattctaatctctaagaataaagttagtgttttaaaaaaatatagctagaattttggaacacattgaattctcatgcaaagttttgtgactgtgattttcaaatcaaatcagtcagcctattatataattctctttaggggtgtgctggcaaagagaagataaatggtgggtccaatcatggttggaattgtgtcctggagtgagataggatccagggagttggcataattttagtcagtgtggttttaatgatggctggtgaattctaatctgaacaaggagtaaagtaaaaagagcagggaagtaaaggacaataaaagggattgagtcaatggactgaaggtttcagtgatgctactgacccagagctatggaagtaatctggttaatgagttaggaggacaggaaggaggttgtcactggatggtgagatgtgaatgtctgaaatcaagatttcagagaggatgataagatctataaagtgaagatgagtatgaatggctaaaatggaggaaagggttgttagaatcaaggaaatcaaggaactctgagtataggcaaataaaggaactaaagatgaattcacccttctctggacttccacagcacatggattatcttatgcaatttattctttcaattgaagttacatgaatacctacttgtccttcctccttccttcatccctttaattcacatccctacacatatagtacaatgctcattttaagtgtttggtttctattgctgaactgagttgaacttctacttttttgtgtatggtaattccactaatagaattctcagaaaaccagagaatgtttcctttatcccataaatattaacacctacttacctgcatcccagaagtcctatagttgtaaacagttcctttcaattggatctgttctcctcgtacaacagaatatggtatattcatttccaggaagacatctttgaacacctttgccttgacagtatcagcaacacatataccttcagcccaaagtggaagcaaagtagaatcatattaggaaattcctataatgttttattggtattaaaatttctcacatttgctttacttcaaggaaaaaataatattagatcatgtttttctctgaactctcaactcatgtccttgaattttctattcattgatcttaatttcaataataattagtattaacaaaaaacttcatttattcaacaaatagttaattctatttaaggcatgagaatgtttatcaactaacacaccaaatctttttagatattcattattggctccatgtttaatgagtataaaattttgattgtggaaaccaagattttaaaacaaaagtagcaaacaaacaaacaaaaccattcctgaagctatttggaaagcatctgcacttaatcatcataaagatcagcccaagagagttcatttatttgtttctaactctacacaagctcccagtcagtgagaaaagtgaaggaaaataaagacttgaggctgggtgcagtggctcaagctgtaatcccagcactttggaaggtggaggtgggaaggttgcttgaaactaggagtttgagaccagcttggacaacatagcgagaccccttcttcatttacaaaaaaaggaaaaagaaaaaaaagagaggagtgaaaggagaaatcaatatgttcaaagatgtgggtatatccaagtcttttggtaatacataaaaaaaagaatattttttaaaaattgctaccatttaagtcctgggtaaactaaatagatactaacaaagaattacatcttgctaatcaaatcactatttaaatgcatatatcacttaaacctgcttaccagtgtttgaaatgccaacgccttgaatttcccaggtggttagagaatcaggtagggcaaactgcaactgttttctggaagttaaaatgttgatattcaaatacagtggaatattgattaacccaacttaacagagacatccattaacagaatttttgcttcaaactactttagagaaagaaaaaaattcacgagatgaaatcacatcattaaggaaaacctcatcaagaaaaatatattcagtaactctcttatatattgcatgtttttagacattgcacctctatgatgagaattcaagttcagaagaatgcctttgaaacattgcaaaatccaagcacacaaacaaagaaaaagatgtttgttgtgagtatattctaaaatagggaagcaaagtgatgcatgttagcactgctcaaaacaaagttgacataactaaaaactgctgattatgattaagcttgtatatttatttacagctattgtctaccaactttgtatcaggtatagtgctgagtactgagtaaacagcactgataagatacagtcctgctctcaggcagtttacaatctagtggaagaaatagttaagtaaataaattacactgcactgtaataattgtaccaataaggcattataagagttcagaggcagtgtgctttcgttcaacacatttattttcagtatcctaggccaagtcctggatataaaacagtaatctgaatttagttcatgcctttgaggtatttacattttaatgtggaagacaggaaagtaaacaagtcattataatacaatatgatacacacaacagggttaattgagggtgcaattaatccaatcactggtagtgtggggagcagtggccagaaggtttactagaggacatgctagctaatgggtaatgtcagatgaaatggacaattgtgtggaagaaggattagagaagacaagggtagaaataaggagatgcgtgaggagacaactgcaggcctttgaactcattccttgccttctcattggaaaaccagtgctttaagcccatctaagaagagtatggctcgaggactcagcccatcactgttttcagtggtatagaggaagtgtttccttaaaatgtgttgaatagaaaactttaaaaagaaaacttttcttcctgtttattaatgtttgttttatagtacagatattttaggataaaaatagtggcttaatatagtgtatcgcacatagttgtgtgtagtaaatgcataatgaagtcaaataaaattaaatggaatagcacccttcttcattctgacctggagccaatcaccagtacgatgtatattaaaaaaataaaaatttaaaaaagcaaagcaaaacaaaacaaaatttgatcaaattgcaggatcatcttaactcctatgcaagctattgggaaatgggtagtttctagatttttggccataatacttgcattatccacatttctttcaaggaaacatgaaagaagtataataccttctgggaacaagatgaacttcccacaaccagctttctggaaaataactccgaatttctggcttgcttactggtaacagggtcttcatgtctggacaaaaaaatcatattcaattatggaaaaacaatataaattctacttataggtgaattttaaaatatggccattaatctgtaacttaagcattttctgaaaggtaaataaaacattttgtttaatgcttccaaaatagaattataggcagggtgcagtggctcatgcctgtaatcccagcactttgggaggccgaggtgggcagatcacctgaggtcaggaattcgagatcagcctggccaacatgttgaaaccccgtctctactaaaaacacaaaaattagctgggcatggtggcgggtgtctatagtcccagctactcaggaggctgaggcacaagaatcacttgaacctgggaggtagaggttgcagtgagccgagattgcaccactgcactccagcctgggtaacagagagagactctgtcacaaacaaacaaacaaacaaacaaacaaactataaaggccttaggatttttccactaatagcattggcaaaacaaagcattaaatatctttaatgatttttttcttaaattgctaaatgtttagtattcctgagattatacaagatatcgatcagtctataaagttatttgcacttatatatataattgtaataattgtgtttatattagaaaaaaggaggctttatatggttctctgccttctttaacttggtaatttgtttatatttactttaataaaaatggactgaacttctgttttcatataagatgccttaatagaaaacaaaacatgatatgcaaaataacagttttcagacattagagcataagcaagactgtgatctctaagagaaaggaaacaattaggtgaaacctaaaattgccccagcttactgcctagaggcagtttacagactagggcagggagaggaatacaagcagagcctgatgattttgaagacttgtggcaacactgatgggagttttgcaaggccaacttgtctggaatgagggagagttccaggaaggagggggctgcagagagagacttctatccagctgaagccaagccagatgattatagttgaaaaattgaaaaacgaaaaaatatatgagaggggagagcaagatggctgaatagaagcctacaccatttgtctttcctgttggtacactaaattttaacaactaactacacacaaaaagcaccatcaagagaaccgaaaatcaggtgagcaatcacagtacctggttttgactttacatcactgaaagagacattgaagagggcaggaaagatagtcttgaagcaccaatgccactcctcccacatcccctagcagtgactgtgcagcatggagaatctctgtgttgggagagggagagtgcagtcattctgtggctttgcattgaactcagtgttgcactgtcacggtggaaagcagaaccaggctgtactcagctggtgtctgcccatggagggagcatttggactggccctagccagaggggcatcgctcatcccagtggttggagcttgagttccagcaagcctccccaccatgggctggagtgctctagggccctaggttaacttgaggggcagtctaggccacaaggactgcaatttctaggcaagtcctagtgcactggaagtcctagccagaacaattagacaagagaaggaaataaaggtcatccaaactagaaagcaagaagtcaagttatccttgtatgcaaatgatatgatcacatatttggaaaaacctgaggactccaccaaaaaactattagaactgctaaatgaattcaataaagttgcaggatataaaatcaacatacaaaaatcagtagcatttctatatgtcaataatgaacaatgtgaaaaagaaatttaaaaagtaataccatttacaatagccacaaataaaattaaatacctaggaattaaattaaccaaagaagtaaaagatttctacaatgaaaactataaaacaccaatgaaagaaattcaagaggacactcaaaaaaatggaaagttattccatattcatggattggaagaatcaatattgttaaaacgccttaatacccaaagcaatctactgattcaatgcaatctctatgaaaacaccaataacattctttgcagaaatagaaaaaaaatcctaaaattcatatggaactacaaaagaccagaatagccaaagcaatcccgagcaaaaagaaaaaaactggaggaatcacattacctgacttcaaattatactatagtataattcaaaacagcatggtagtggcataaaagcagacatatagacctatggaacagaatagaaaacccagacaaatccacacacctatagtgaacgcatttttgacaaaggtgccaagaacatacattggaggaaggacagtctcttcaattaatggtgctgggaaaactggttatcccattcatgcagaagaatgaaacgtgacccttatctcttgccatatacaaaactcaaataaaaattgattaaagatttaactctaagacctctaactataaaactgctataggaaaacactgggaaaactctctaggacattggtctgggcaaaagtttcttgagtaataccccactacacagacaaccaaagccaaaatggacaaatgggatcacatcaagttaaagagcttctgtacagcaaaggaatcaataaagtaagcagacaacctacagaatgggagaaaatacttgcagctacccatctgacaagagattaataacaagaatatataaggagttcaaacaactctacaggaaaaaatgtaataatcccacttaaaaatgggcaaaagatttgaatagacatttctctaaagaagacatacaaatggcaaaaaagcatgtgaaaaggtgctcaacatcagtaatcaccagagaaatgcaatcaaagctacaatgaaatatcatctcatctcagttaaaatggcttttattcaaaagacaggcaataacaaatgctggaggggatgtggagaaaagggaactcttgtacactgttagtggggaatgtaaattactatacactatggagaacagtttggaggttccttaaaaaacaaagaatagagctaccatatgatctggcaatcccactgctgggtatatacccaaaagaaagaaaatcagtacatcgaagagatatctgcacgcccatgtttgttgctgcactgttaaaaatagtcaggatttggaagcaacctaaatgtccatcaacagataaatggataaagaaaatgtggtgcatatacacaatggagtactactcagccatgaaaagaatgagatcctgtcatttgcaacaatatggatggaactggaggtcattatgttaagtgaaataagtcaggcacagaaagacaaaattcacatgttctcacttatttgtgggtgctaaaaatcaaaacaatttaacttatggagatatagagtagaaggctgggaagggtagtaggaggatgagggggatgtggggatggtttatgggtacaaaaaatagaaagaatgaataagacttagtacttgacagcacaacagggtgactacagtcaataataatttaattgtacatttaaaaataactaaaagagtataattggattgtttataaaacaaaggagaaatacctcaggggatagataccccattttccatgatatgattgttacttattgcattcctgtatcaaagtatctcgtgtaccccgtaaatactatttacccacataaatttaaaaattaaaaaaaattaagagaaaaaaaagccaaatcctccctccaaaaagaaaaacaacatatggactagactgtttattaaaattctgcttataataagcaaatattattagccaggcatggtggcaggtgcatgtaatcccagctacttgggaggctgaggcaggagaattgcttgaacccgggaggcggaggttgcagtgagctgagactgcgccattgcactccagcctgggcaacaaaaacaaaactctgtctctcaaacaaacaaacaaacaaagcaaaacaaatattggaaaacaatctgaatcttagacactgtacatctcaatgaatatatttctacaaacataaattttgtggccatttaccaaaattatggttattagatattgcttaacaatagggctatgttctgagaaatatgttgttagatgattttgttgtgtaaccatcatggagcgtacttacactaatctagatggtataacttactacagatctagactatatagtatagcctatttctcctaggctacaaacctgtacagcatgttactgaacagaatactgcagacaactgtaatgcaatgataagtatttgtgtatctaagcatatctaaacacaggaaaggtacagaaaaaatacggtattataatcctataggatcaccgttgcacatgtggtccatcattgatgaaaatgtcattacgcagcacacataagtataaaacagaagctgtcattttgcttttgcttgttttgttaaagactatacataggctgggcacagtggctcacgcctgtaatctcagcactttgggaggccgaggtggacggatcacctgaggtcaggagttcaagaccagcctggccaatatggtgaaaccctgtccctactaaaaatacaaaaattaaccaggtgtggtggcaggcgcctttaatcccagttactcaggaggctgaggcaggagaatcgcttgaacccagaggcagaggttgcagtaagccaagattgcaccactgcactccagcctgggtgacagagccagattcctactgaaaaaaaaaaaaaaaaagactatatataaagtcctaaaagttctgaaaacatgttaatgagagttctataaattctggaaacatgtattgtggttgaaactgaaataagacatcagcttttatataagtacacttaaccttaggctagatttagaaatattctgctttatttcatcaatgtagatatagacagaatttttaatggttgtaatatcacaaaagcgtagacttgtagaactcacaggcatattggagaggatctggtcgaagctccttgcatgaggctcagagaggataaataatcattcaagtttatgggatgacttggctttaaggttatgccaggtcttaactctggcctagtgtactctgctctgtactgtacctcttcggatgcccaaaaatgaaggatttttttttcttatggacatttacaagttatcttttctactttcaattctaaatagatcatgaaaactgcctttcttagcagcataaaattacacaaaattccccatattgagcagaattctgatagaaaatgtcatacttacgtagccttcccaattgcatgtctttatgagagatattagcacggagctggcttgcgacgacacaacattcagtgaaagctttgatgcatcttggccctaaactaatccgtgcagctcgctgctcacaggtttcatcattattaacgcaggctccatcgtaacaacatttcttcactactgaatgtttatatttagcagctgaaatggtaataatgcaagtgctcttgatgacgcagagtgataacatctcaggcttagaaggaatctcaagggatacctggtttctgttgctatatgatccccctacccacaatagttatggctagttgactgtccagactccccttggaactattctaagaatggggagaatgtgaccttaccaaatggtccattccagctcacactaaatggttaaagggtttcctgcaattaagctaaatactaactcttgaaactggaactttgggttctgctgaaaatatgcagaaaaatatagaaaaagaatagaaaatgttttttaagaaaataagttaaatatccaagaagccttcaaatatttgaagatggctatcatcactatacaaatatttccttcttcaagctgaatatcctatttttcaaaaacttcttatataacatggtttgtggacttcacctagtagcattatccttcattgtaagtgctcagattagtcaatgtctctcttttcatatcattagaacttagaataaaggttagaattaaaataactcatatacaaatggaagaaactattatattaccataggcatgatattagttgaactcaatttgctgactcccagtttgatattctttctacagtaacatgacgaattatcataaccatttaaataattattttaaaataattctcacaagatgtattttccaaagaacaatgctactaacagttaaatatatgaaatagaagtaatagacttctaggtatatccccaaaatagtcaaatcatggattttgtcagaataaaatggaaggatatgattttaattgccagatgaagttatcagagagaaaatatttatgacaaataaaagctaatattttggattttagagcttgaagtaataaagacctatttccttagattaaggctatggcaaatgaactactagactttatttggattaatctttctgagagagataagctagacctccatacatatctttcttttcattcattttatttcaattaggggaatttatataacatttaattttgtccagtttttgaatgatatgaccataacctttttacaatcacatgaatcttacagtacctatttcttctatcttcttttgcagcgttcttcttggcctgagaatttctttacaaggttcatctggtttttttaaaaaaagataaagaagaaggattaaaaaggagataaaatctcaaaaaaaaattccatgaaactatttaagtatttagagccttcacaagtcattccttaacaaatattgaggggctgctttggattaggaactgtgcaccatacttcttaatatgacttgttttatcttagtggagttcatgatctagtgtcatatcttttgacttattttatctgaatttggttttgaatcctgcagcctctctgatccactgattccagagaaatacctaagcatttagagtgagtgatgcttttgttgggtatgctatttttattatttgctctttgtgctatattattgcaaatataactatgaataccacagtatcaagtataattatgaacaattttaaaaccatagaaagaagatgattaaggtatggttactatccttaaagagctcctgatgcagtaggtgagcaggacttacaactacatgtaagaatgcacaatgacacaatgctgttctataacttgtaaatagatctagtccctgcaatagcctccctattaaaggaggagggaattataaattctatgtggggaagaggtctcgtagaggcgatgattcttacattgcttctccaggctaatgaaggggaaaccaattccaataaataaaggcccaaaggtgcaaaatagcataatgccactcaagaactccacttggttctgtagagcttaaacataacgtaaggcacagcagggtaagagctagttggagagagccagggcgaagatcatggaaggttttgagtactacactaaagaatttgtactttatcttgaaggccagtgaaacattttatacaggtgagttatgtagtcttggcattctaagatcagggtacagaatatttgggaagaaggataaaaatgagatctggggggcaaatgatcaatgggattttcagtaataaacatgctgagcattttaccattttcttgggagtcatctgcatttgcattagtgaggaaggtaagtccagctaggtggaacacattggcattgttgaggccaccacctgccccacagcccagatcactcttctctaagaattgaaatacctgtccagaaaggcaaaatgttgagcacattgagatgtataaatcattcctctaaagatctaaaaggtactaattgttacatggttatcacaaaccagtgaaatacacagatgatatttttcaaatgatcaaagacaaaatttcccaactttgtttctaagtttgtccttttgtatttataaatacataactattcaaagttaaatcaagaactaagtcttaaacaaatagctttgatgaggagtttcttagaaactgatatatagtgttttgtacatagaatgaatgctgcaatcaatataatgttccaaataaataaataaataggtatgaatgcatgaaggactgaattaacatagaaattaattttaagttgctttaaaagcacaactttgtgcattttggtggggaggtccctaggttctaaatggctgaagacttgtttggacaggcttattcgttctccgagtattttttaattttacagtttctcagtccttccttccttgttcaaagacattcaagcctcgaaaataatagctgaacataataagataaataggaacttatgagaattgaatgattttgagattcttctgtgctatggatttcaatgagaatttaaaaaaaatccaaatgttacctatacaggtctttcctgtgctgctactagctactataactgccatcaacaccctaccctaaacctccaaagtattctgatagtaatttttcctccatgaatgtaattgctaccatgatcatatattcttaaagtgcttacatttacatttgaaaaacaaaagaggattgacctgtgctttgggagctgacaggaggatggtttaccttcctaaaaatgagtatgttgagtagattacagaaaagcaggcctagtcttcccttagttcttcctccatatcctagcctggtggccacacttcatgcaacactgcagcgagacatgcattacttaactctttccaagggctttttggctcctctttggactccatacacagcactgtccactgctgctaatgccacccaggaatccattccagttgccatattaagagacacagtttggcctggagaatatgcatctgcatcaggagacagatgaacctaaaagttcatttgaaaaagaaaagaaaagatcatttgtatgagacaagacttttcagaagcagctaaaactttggcagcctccttcattgaaaagaaaattcaattgtgacttataatttgtggcttacctggagctggttgccacatttttcttcaatatttaaccagactgaatcagacactaattctgctgtctgttctcctgtgacgatgtaatagaccagaagtcgggatgaaggaaccatgttctgtgttactggaatgtttatactttgataagatgcatctgaaaatttctccctcgtgccaaagtggataattttgcccttggataaaatctaaaaataaacagcagcagcaacaataagtaaaaaataaacaaacaaaaacaaaacctgtgctttaggatgcagcctggagctggagcagaaattatgttaaagaaaaataaagttaggctgggcacagtggctcacacctgtaatcctagcactttgggaggccgaggtgggccgatcacttgaggccaggagttcaagaccagcctggccaacatagtgaaacaccatctctactaaaaatacaaaagttagccaggcatggtggtgcatgactgtaatcacacctactcgggaggctgaggcatgagaattactggagcccgagaggtgaagtttgcagtgagctgagatcatgccactgcactccagcctgtgcaacagagcaagactctgtctcaaaaaaaaaaaaaaaaaaaaaaaaagacataccaattttggctgggcacggtggctcacacctgtaatcccagaagtttgggaggccaaggcaggcagatcacctgaggtcaggagtttgagacctgcctggccaacatggtgaaaccctggctctactaaaaataaaaaaattagccgggcactgtggtgggcatatgtaatcccagctactcggaaggctgaggcaggagaattgcttgaacttgggaggcagaggttgcagtgagtcgaaatcatgccactgcactccagcttgggggacagagtgagactccaccaaaaagaaaggaaggaaggaaggaaggaaggaaggaaggaaggaaggcaagaaagaagggagggagggagggagggaaagaaagaaagaaggaaggaaggaaggaaagaagggagggagggagggaaagaaagaaagaaaagaaagaaagaaagaaggaaggaaggaaggaaaggaaggaaggaaggaaggaaggaaggaaggaaggaaggaaggaaggaaggaaggaagaaagagtgagttaacgtttatgggcctactatgtgccaggaactttaacatgtatttaactcctttcattctcacaatacatcaataagaggaatattattctcctcatttaagaaactgaggctcagaaactaaaagtcatactgattttaattcaaaatcacacaactagtaaattagagagctaaaatttgaacccaaaaactgttcaaagtcatcacactgtcactaaaaccccttttgtttcaccgattaaaaaaaaatagatgaataagtggagtgcatcttatttggggatttaaagccagggtttagattctaaattgaaggtttaagattaaaaaaaaaaaatcacgtgaagccaaaatgccctcagaggtcccttaaattgtccttagagaccagaactgcatacatggatttggtatctagtccataaacagtttccctttatcagtcaatatttatctatggtcctcattactgttttttcaatttcttcctcaaaaatgttgaaaagccaacagcatgtacttggcctggctgtcgaaataattcattccatttatttggtgattgtcaggaagctcttaatattttctgtaagtttttttcttggtttcaccaacaggcttcatcgatccacctctgtttaatataaatgatgcaatagggatgttgctcagctacggaattggaacaggcaagataggattcaattctcaggagaggattttgcttccccattttttgacaataaaattcacttatccgaactgggtctaggcatataatctttggccatgaaagagaacagaggcaacatgatttaatcaggttctcgctttggaataactaggctctctttggtaaaaagtgttattagaacaggagtcagagtcctcagctcaaatcaaaattttcctcttcccagctgagtaaccatcataagtcttttaacttctctgtccctcagtttcctcatctgtgaaatggtcatgaaaatcatgccctatttcaaaggttttttgagaaactgatgttcaagttagatgatgctcttgaaagtgctttgggaataaaagtataaaggataattctaatgcctctctagaggcaaaggaaaatgttccaggtgggggaataagatgtaaatccatcattatgtacttaccaagtaattatagtgagttattttgtcaatatatgggcttttgggggtaacaataatattcagatgttctcccactagcaaagccttatggttatcagtccaatcaatataaaggtaactttggctgagagatgagtatgctattgctcggtaaccttccctggcctgattttcttctggaagatctggagcatcagttttgacctgaaaagagaaatttcaaaaagacatgtatactgtgatgtaatgctttctgtaaaacatacctttcaaattattttccttgctttataaatttctaaatttcacaataacaaatgctaaaggggaaaaaaccctccattacttcagtgtttatacagctgtggtgtcaagcaactttacaaagactacagacaagaatgatgggattatgggctatggcggaaaagtctgaaatgaagagagaaagatgctccaggaataattattggtggtcttcctgaaatgtcatggtaagttgggacttctcctcgcatgggatgattacagagagatgcctaagcatttaggaaatgggggtaggagaagggaagtagtggggaggtagcactaactcttggggacaggagctatgaacgaacatctcagagactatctggcccagtttcattgtgaagtagaggcacagatgggtgcttataaatatgaggtggagaagaaatgatatcatggcagcaatatctaccctcagacagcagaagtgttattagctcatgctctggagtcaggtacacactggttcacataccagtaccaccacttattaactctggataaaattagttaatcaaaagagaggttagaagcctccatttcctgagccacacaatggcaaagataatattctaactcatcttgctaattaaatggtgtttcatgtattcttcataaagctctcagcatgatgcctagcatttagtaagtgctcaatagatgacagtgagcatatgcatgctgcagtcattggcctatgttattatgttactaagttactttgtaactatgttactatgttattgctcatattttatttgagattgggaacttaaataatatttgctgcgagagaagactattaagtgggctctaaagtagaatggtttctgtagttagaaaaaagggaggcttccatatttttgacccttttgtggcccttcaggggattaaaagtgaggggggaagagaggatattcctaacactcatgtgcactgctatacctattctgaagcttctagagtctgatatggtcttaacggtgtaagataaaacaattaactcccaaataaaaaattgatacatttatcttcctcaaggaccattcaatggattagcagattgtctctgggactaatttgtcttggatgcaaaattatggaactgttcactggactcatgtgtaaaatctgccgcatctgttctgcacactagccaaaacacatggtcaagagtacacattgtcctagaaaatacaacaggagaattcagctcacattaaactccagcaccgtcactccagatgggagattaagcacaaaggaagctactccatcatcaacacgtgttacacttttgcttggatccaagtcagatgtctcttggtttacatcaattgtttgtgcattcagtgttactgggactcctcctaccaactggtcaagcgaatctttaacctgcacctgtttgtcaaaacaatccaaatctatttcaacagctcatcacttattttaaagcacaattctgaaataattttccttcctccccaccaaagtataaattatttatgtatttttttctgaaaattttttttctgagacagagacttactacgttgcccaggttggagtgcagtggctattcacaggcacaatcatagcgcactgcaaccttgaactattggcctcaagccatcctcccacctcagcctcccaagtagctggaactatttaggcatgctccaccacacctggtttacttatgtttaatttagtaaagagaagtgtattctcagcttatagaaagatttaattctatttagttaaatcattcttgaatagattctcccataaatcaagcaaactcaaaacataaatatcattctattaagtcagtcaaggagtaggtgtgataaggtcttctgctatctaacttctgtatttctttgattggtttaggactggataaaggagaaaatgaggcaatcgcttctgggaataagtcccttgaatatgagaaacaaaaatagatacaccttttttcctttaacatctacctctcactgccatatatatatatatatacacacacaattccacacagatatagtttgttattttacttttatataaacatattttaagcttatgttctatataatattgctatatttacatattttagtatatatattatatattactgtatatgcattatatgatactttgttatatattattttctatatatagtatatatatgtaagaacctacaagcatgtccaaaccttgctttgggcttggtaaatccttttttttcttaaaagcccatgacccacagtaaataataaataacacattttgattgtacttaagttgattttaaaaagtaacacattttcaaagaacaaaaaaaaattttgctctggatttctaaattaagggcagggaataaacatttccatttaatcaacataataaaatatattatttgtaataaaatatataatgatagataaaaatctaaaaaccacatgaatgtttcaattctatactgtcagcatttagaggaggaaaagaaggtgaaagagagaaaaatgaatgcagaggagtaagcaaaaaagacagaaaaaaagagattcagggacggaaagaagcaaaaatgaaaagaacagagagcaatacagagacgagagattgaacagagttatgcacaaagacaacacagagacagagggaaacaaatgagacacactggaggcaaaaacatagtgagagaaaggagtctattttcaaggaatgatatctccatcttaaggctttttaagaatttgccaccaaataattttaaatgtttgtatttttgaactagagtcttatgagattttatttacatataatttaatgcttatttattacatgtaatttaatgcttatttagggatgcctaatacaaggctatcttgccctcacttttgaagtcattgccaaggctgcagctgaccttcaatttcccatccctgtctgtgtccaccaggaggggcaggtttcacagaataagctccctctgtgacttcatggcaacattcttaccctgtttgccacccacatgttttccatgaacagaacaagatgatcatatgtagcaacgtctaccccctcacccaatctaccttgatgggatatggaatcccaggcttcaggaaaagaggagtagcaaccaaattcagtttgtagggagagaggacatatttgatgccaggtatttctgcctcttcagaaaatccacctaaggaaatggcaagcatcatgttgacagtttttaggagtatcatgatctgtatggatatccatttcatctctatatgtctccacagacttattcattcactcactccattcttgcattcattcatttaccagtagtaagtaggacataggtcttgcttcagaggggcacagcagagaagagtttagacctcaggagtttccaaggccttatgcacaagctcgtatgtagagaagcccttggagaagtagagctacaggactggactgaggaaggatgccaggaagggacaccacttttcatcagtggcctgagtttcagttgactgtattcaagggattgaggagagagggaagggtcaggccagaaactgagccttacagaagtggaggtgggggatgggggttggtgttcacagagcatagatacatagagagaaatcagaaaaagggagcttgatatagaaagaaccctgaaagggagttcgagaccagccgggccaacatggtgaaacctcatccctactaaaactaaaaaacgaaaacaaaaaaagtgccaggcatggtggtatatgcctgtaatctcagctactcgggaggctgaggcaggagaattgcttgaacccaggaggcggaggttgcattgagctgagactgtaccactgcactccagtctgggcaacagagcaagactcgggaggggagggagggaggggaggggaggggggagggggaggggggagtgggaggggggagggggaggggagggggaggggaggggagcgggaggggggagggggaggggagggggaggggagggggaggggagggaggggagcgggaggggggagggggagggaaggggacatgaccagacaactggcaagagcccaataatgttatcctccaggtaaagattaagttaaactattaagaataacatttgaagctttaatattcccaaactcctttccaatattacatctctaatacattctatacatatcctatattttagccaaactggatgatctgctgtcctcaaagattaagcttcaccatctactcttcttcatctgccctctctctggagggtttctatttcaccctgtctagcaactctgcctcaaaaccctaattatttttcaagactgatcatcttcacaacactgttcttgcttgctcaacaatcatctagaagctcaccttcctctgaatcctattgcattaatattttgcttagagctcatatggaattctttcttgcaacagttctttcttcacctgtcttatacctgatgctaatttgtaagccactttagtgctggcatcatacatcattaatgtttgcaagcctgtctgtttggcaatactttaaatatctcatagatactgcttaaactgaacttatttaaaataagttgaggaaaaaataaaaagaagaaacattaaaataatgttgaaaactttaggctttaggaaacattcagtttgactccatcattatgtagactataataatgataatagtaataacttttatttgtatagtactttatcaaatagttttacacacataatcttattttggttttgattttcaccacgtgaggacactagggtgccaaatggtcaaggcagagagcctgcagaactactttggacatgaattgggtactgttttcccatttttgcagtagaagtggaggtaatagggacccaatggcttgtccaatgactaaaaagaagcagagccctactgcctttttataactatataaaagtctacttcttataattatatttaactatgaaagaaaatacaatgtgaaataattatagaaattggaaattatttatatctttaatattctgtctaaatatttttcaaaagaaagtatacacacacacacacacacacacacacacacttacctgtagactctatgactgttacagcaatataaaggtacttgttgtttaaatcttctaaactgtagtatgacagttctttgactgctgtttcagaatcaaatgtgacttgagcaattccatttatcaactttttaaaaggagaaaaaggaggagttatttcggagaagaacttataaggaaaaattaataaaatctgcttttactaacctctaaattgaaggtaaatgtcagaagaatggtttagtgtcaaaagtaaagtagataaccgagtccacgattaagcccaggatgttattttctaattatttgtatagaattatagaagtagaagggtcttgaacatcacatggtccaacaggtctttttggtaatagctgacaaacacgacttcttccaattcctgcgtcatcattcatctttataggcctctcagcgtacttccgcccttaactgagagtttgttggtttttataatatttaatttgtacttcactgcttacaaatttaaatactaattttaaaacacacaatgagtaaagggatgtggggttaagtcatattatattatttaattattaacacaacagtaaaataaactttgccttattttttcttataaaattgagcgacttgagggcaggcatttttgtcttatttagctttacatcccagtgtctagcatagaattttgcattttaaaaatgcatttaatttacatcttgaattaataagattgtagaggataaatgattgatgatgcaaaccaaatgaatacgaaaaagtgagcaaaaatgacatgaactcatatcatctgtggtataatgtaaagaatgctgaataagggaaagggaaccagcgccctaatctcagttccagcaatcattagccctaaactatggacaaataacttcatgaatatttccttgcaagaaactatgctgtctctgggcatataagggaaatgattcagactcacaaatagtttaatattgaaaatgatagataagtaaacaagccattccagtaaagaagggtttctcaacccctcagcattattgacattttgaacaggataattctttgttgtaggggcctgccctgtgcatggtaggaatttagcagcatccccggcctctccctagtaaacaccagtagcaaccacaaatgtctctggacattgccaaatgtctccttgggaataaaaaatcacccctagttgagaaccgctgcaatgaaatgtgaagaatgtgttaagaaaagaggctatacagccggggcagctaacctagtgtagaagagtcaggggaggcttcccagagaaaggctgtcaatgttgaaacttaaagaatgagaaggaattagccaggcaaagaaggggcaggaggtgacaatgggaaagagcattttcaagcagaataaatgatattgtaaagacctggaggcaagagagactttggtcagttagagaaattggagtgattaatacaaaggggagggagggaggaaagggcatgagatcagctggtaagggaggctgatgccaaggaaaatgaactttaccctaaaggcaaagggaagccaatggaggattttaagtttcaacctatctaaaatgggggattggactagatggtttttaagtaacttctcatctctcacctctggatgcatctgtaggtgtgagtgactgtgtcttaacatcttaccattgtgttttgcattgctgtttgcatcatttctttttgatcatcttttaagtcttctcttattccaaatgtgatataaacgtcagcctcagtgactactttattataaaaatatctgtcagacaatagcataaaactgttttactaacatggttacaataacaggattcagataaaatgtaacaatttgaaattacgtaaagcacttgaggcactttaaagtgtctttcatcctaagcaaaaagaacaaagctggaggcatcatgctacctgacttcaaactatactacaaggctacagtaaccaaaacagcatggtactggtaccaaaacagatatatagaccaatggaacagaacagaggcctcagaaataacaccacacatctacaaccatctgatctttgacaaacctgacaaaaacaagaaatggggaaaggattcccaatttaataaatggtgatgggaaaactggctagccatatatagaaagctgaaactggatcccttccttatatcttatacaaaaattaattcaagatggattaaagacttacatggtagacctaaaaccataaaaacgctagaagaaaacctaggcaataccattcaggacataggcatgggcaaggatttcatgactaaaacaccaaaagcaatggcaacaaaagccaaaattgacaaatgggatctaattaaactaaagagcttctgcacagtaaaagaaactaccatcagagtgaacaggcagcccacagaatggagaaaatttttgcaatctacccatctgacaaagggctaatatccagaatctacaaagaacttaaacaaatttacaagaaaaaaacaaacaaccccatcaaaaagtgggcaaaggatatgaacagatacttctcaaaagaagacatttatgcagctaacagacacatgaaaaaatgctcatcatcactggtcatcagagaaatgcaaatcaaaaccacaatgagataccatctcacaccagttagaatggcaatcattaaaaagtcaggaaacaacagatgctggagaggatgtggagaaataggaacgcttttacactgttggtgggagtgtaaactagttcaaccattgtggaagacagtgtggcaattccttaaggatctagaactagaaatacaatttgacccagtgattccattactgcgtatatacccaaaggattataaatcatgctgctataaagacacatgcacacgtatgtttactgcagcactattcacactagcaaagacttggaacccacctaaatgcccatcaatgatagactggattaagaaaatgtggcacatatacaccatggaatactatgcaggcataaaaaaggatgagttcatgtcctttgcagggacatggatgaagctggaaaccatcattctgagtgaactaccacaaggacagaaaaccaaatgccgcatgttctcactcacaggtgggaactgaacaatgaaaacacttggacacagtgcggggaacatcacactctggggcctgtcatggggtgggggacggggagggatagcattaggagaaatacctaatgtatgatgagttaataggtgcagcaaaccaacatggcacatgtatacctatgtaacaaacctgcacgttgtgtacatgtaccctagaacttaaagtataataataataaataaagtgtccttcatgcactattacatttcatcctcataaagccacattaataaagctatgtgctagatgaaaaaaattgatcttggggagatcacaagacttagaatcagggccctctcctatatgccaaattacttccttgataattttgatatcagctactctctgttttcttttatgtttttaaaaggtacgtgtccaatctcactgttatatgagatctattcataaaaaatttaaactgcatgtttccctttttagtttagaattaaagtaagaataaagtaaactttctacccagcaaataatactatagcaagagctaactttccttatttatggtttgaataaatagtccccattataggaggtcagtttctataattttctctcaagtgagccttttatgctggtttagaccaagtaataaacactctatttttcaaatcaatgctaataagagagctagcatagggtaatgtttgaggcatggactctggaagcagacaggctgtgcaacttactagctgtatgattttgagcaaattattaaacatttatgtacctcagtttttccacttgtaacatgggaatagtaacaatatcaacgcatagagttgttgtaaagattaaatgtgctaatatatgctgagtacttagaagagtaccccacacatatagttatatagattggtataactacattatattgtaattttaaaatgacctaagcttttgtgataggttgcttgcaaaactaacccccaattctctacctccccatgtatcaacgacctttgcacagttccttgtgtccacaaagtgtgggaggggtctatttcctctgggctgaccttgtaacttgctttggacaaaagaatgtgtggaagtgatggtgtgccagcaccaagcctaggctcagggggactttcatgcttccattgcctctttgagtgttgctgctgctacaagctagcctgctggatgatgagaggcacacacacttttagccccatccaactgccagacatatggacaggaccttcctagaccagccagcccccagctgacctaccaactggctgcagctacatgggtgagcccagctgacaccagcctggcccagatcagcagaacttcccagctgactcataaatgtgggagtttcaaggcactgggttttgaagtagttacgcagcattagctggctgattaaatcattaaaaaaagataggaagtgaatccttcatatctcagtcccaatattctaagttaccctagtttctaaacacatacaccaaacttagatctttggcacttttctttgtttttgctgttgaatagccaacaaagctaaactcagaatcagctaaaatcagaataagcaaatgaactaccagcatgatgtctcctttatcaattagtccccaaatcatggcacactttgataataaatcacagatctcactttgggcaactatcatcaaccagagttgagttaatttgaaaaataaaaataaaaacaacaaaaaaacaaatgttcttaccttgcttttatagtaatttcaaaattcttaaagttcttgtaaccaatgaaattatattctggctcgattgagacagaaaaatgtggcaagactgaaaataaaaacaaacaggtaatattaccattttgattagagcagactttaaagcctagcaaacagctagactttctggtatagttggacaagctgtaacatcaacacaacatccactttattatcataatcatcatcgtcatcatcgtcatcaccaacaacaatctctgcagaaccttcccactccaacaatcagaggtcaatccagaagcactttgcctatattttgattacagcatttattataggcaataggttatttcttccattagagtataggttccttgaaaacaaaaaaacttttcaattgtgacataacataatgaaatttgcatttcaagattattttggctaataccaagcaagatagcttggaagcagagacatcagttaggaggcttttgctgtagtccaggagggagagtgctgatgaattgatgagagtggctacagacagtaagaggtgggtggattctagatatacagagaaaatacaaaaacacttagaagaagggagatgggttaggattatatgttacagagagcctgtaatctttaaggttgagtttcatcataacgaatttgttttgtcactgtttttcttgttaattgttaaaatttgtgtcagtatttattcttctccatgtcattatgaatctcttgagggaataaaaaatggcttcaagcagaagaaagttaaatttgatagcagagcacacagaaatgctagtaaactactataagaaatgaaagattaaactatttacgttacttgttagtctattaatataatttatttcaaaataagaatatcttaaatattcaaatgaatatattaggaatttaggagccagaaaatagtgttggactaggggtaaggaaacctaattgttgtttttgttttgtcactaattggttttaagactcaagtaaatcatttattggttttactgggttccactcacctcatctatgactatttaagtttctcctaataataatcacaattctagaaaggatctttactagtcaagctcttcaggggactagatctcttccagctctctgatggggaacacaagtacacagaggttgttctgcttgatcagggttaaaggcatgctggaactagaatctaggcattcaactactactcctccctccaacctctagccagtacttctagccatacgtacaggctgcctcatcttcatctgggaataattttgcattaactacattattaaaaagaattattgcaaaacactaactttttatagaaaaacttttaattggctgggtgcggtggctcatgcctgtaatcccagcactttgggaggccgaggtgggtggatcacgaggtcaggagttcaagaccagcctggccaagatggtgacaccctgtctctactaaaaatacaaaaattagccggctatggtggttggtgcctgtaatcccagctacttgggatgctgaggcagagaattgcttgaacccaggaggcggaggttgcagtgagctgagatcgtgccactgcactccagcctgggcaacagagcgagactccatctcaaaaacaaaaaacaaaaagcaaagaaaaacttttacttgtcagaaattaccatattctttaacttcaaaatatgcggttccagttgttgaaaagtcctctttatatttagccttgatcgtccacataccatatctgtggaagcaaaatatttaaaattatagatgtcatcaaatgtttttaattcactcagaggagatctaataaattcctgttttaaagagggaagaatacacaaagatatataaaacctaagtaatatattttatttgtgactgatttttaagcaataaataattgagcatttttaggataatagataatagatattgtttagtaaccagtttttcatatattgtattatttttcctggtattttatcttaatacagtcattagttttgatttgaagaacttattatttctgagaatttatttaatcttggagcctaattatgctaacataatactaaaatccaaaatacagtacaaaatccataataacgtctctagaaacatataatacaagacaagcttatacagatgataaaatttacacctcacaaaaatgaatttatggttggaaacaaagcatggtttttaaaagatgaaaatgacctggctttaattaataacctttattcaaaaacatatactaggccaggtatagtggctcatgcctataatcccagcactttgggaggccaaggcaggaggatcgcttgagcccaggagttcgagaccagcccaggcaacatgatgaaaccccatctctacaaaaaaatacaaaaattagtctggtgtggtggtgcatgcttgtagtcccagctacttaggaggctgaggtgggagaattgcttgagcccgcgagatcaaggctgtggtgagctgagatcacaccactgcactccagcctgggtgacagagtgagactctgtttcaaaaaaactatgggtgtgtgtgtgtgtgtgtgtgtgtgtatgtatgtatatatgtgtgtatacacacatatatatacacacacacacacatatatatactgagcctaccttgcagattggctatgaagtccacaaatgttaatagtattataataatgattattaccatcatcatcaattcaatgaatatttatcaagggcctattatgttgaactgctggtgtgcaatacagacaaggcccaccttaaagagtttataagctagtggggaataaaaatgccagcaagcaagtaaagaaatgattatgacattgagataagtgtcatgaagaaaataaacaagatgctgagatagggagtaaaacaaagcaagagattacattacatcatgcatccaggaatagcctttttgtagtagcttctactctgggtcataacaatgaaaagaagccaggcttatgaagagccaggtgaagcccattccaagtagaggggatgacatgtgcaaaggcacggaggtaggaaagcactggacatgccagaccatggctagcacataatttgccatggggcaagtggcacaagatgaagttggagaaatgatagcagtaataaaataataggtttaattctgcactatggaacatgtagtattttcaagaatgtacacaatttttaaattatccaagttatttaaaacctccaaattcaatttaaatttttagaaaaatttcagtcagcgaattaactgagggcagaggaaaaatgaccataaaaagatgttgttctaaaattctagtgcagccatgtatagatgcacttgtcttattcattctgctctattataaatttctttctttcttttcttccctccttccttcctccctcccctccctctttctttccttccttccttccttccttcttctttctatcttagttggagttttgctcctgttgcccaacatggagtgcagtggcatgatcttggctcactttaaccctcacctcccagattcaagcgattctcctgcctcagcctcccgagtagctgggattacaggtgcctgccaccacgcctggctttttttgtatttttgatagagacggggtttcaccatgttggccaggctggtctcaaattcctgacctcaggtgatccaccgacattggcctcccaaagcgttgggattacaggcatgagccaccgcacctggcctattacaaatttcttgaaagcagggactgtggattatttattttgtatctctccctcttattgtgatttgcacataccaagaatgtgttcattgaatatttattacattgaaccctgtttaaactttttcttaaatcctttcatgtgaggccaaataatagatatagctctgagaactccttccctcttggactttgccttctggtagtttatccaggcaaaaactacagacgaccctattttatagcaaccagagcaaggaacaagaccacaccagccttttaaactgacaatctattagatactttgaggggtaggagttgatgttttttatgacaaaaaaacctgggtactattttttcctcttcccaatttttatttctatatgtaaaaagaatggctgagaagtattggaaattttttgccaagaacagagcttaagttcttgctagaacttcaaaagattttgcatatccacctatgtgacaccctttgttaacattaggtggccccctttaactggttacctgcttcttcaccaaaagttccgtatgtggttttattaacaactatttttacatacctaggattagacggaatcttgaagtcaggaaaagagataattccaatatgatcaatttcttctaccatgtcaacttctgatccttcaggatcctgtaaataaaaacaaacaccctcaaaggccagaaactacattttaaaaaatttaactgattatacaatctttgatgtacaaaatatttatagatcaaatatttgaagacaaatacccatgtcttcaaattaaatatgaaggatgaagatctgttaaatgttatagaagggaaatatggttcatttcagccatttcccttcttctttttccaatcttccccatctctcctcattatcttgaagagactcaactctcgttgtacatctaaaagatgaagtgtaacaacacgtaaaaacaacaacaaacaaacaaacaaacaaacaatgatgtttttgataaactaaatgtgaattttgttggctttataaacaccagaatctaatttttatatatgttcatttaaagctttcaaaagcaaatattctatgaattatattttttagccagatgttttataaatgtatagtatgggcatttttcagcttggtaaaactctcaaatggttaaacaaacttgacagttctcgtaaagcttccccataaacttaattttgtgtttgggttagcaaataattgaaatgaggttttgactttctttggactacacatgggggtccaattcagccttaactcaacacataaacatagcaggcaacataagtgaggcccctatctgtacaaaaaacttttttgagacagggatcttgctctgtgatccaggctggagtgcagtggtgtgatcatagctcactgcagctttgaactcacaggctcaagcaatcctcccacctcagcctcccaagtagccaggaccacaggcacatgccaccatgcccagctatttttttttttttaatttttagtagagatgaggtctctccaggttgcccaggctggtctcaatctcctgagctcaagcaatcctcccattttagcctcccaaagtgctgggattacaattacaggcatgagtcactgaccagcctacaaaaaaatgtttaaagagttagcagggtgtggtgatgggtgcctgtagtcctagctactcaggaagctgaggtgggaggatggcttgagcccaggagtttgaggctacagtgagctatgatcacaccactgcactccagccttggtgacagagcaagaccctgtcaaaaacatacaaacaaaaacaaacaaaccaacaaaaaacccaaagcaaaaaatcttagcaccatttaccatgactgaaattcacagttggattttagaggttttatttcgtaattaattgtaaaacttacagaagcctattttgaacaagaattatacttgtagctgagtatttttatggctcttcttcatcgcactatccattgtgcacaattcttctaagatcatctttctcaggtactattttgaggatacttcctctatattaactccttaaggctctgggatcagctttctcaatcttttcttcctggggcagctcttacaagagatgactgacattcatttttctgcaggttatgccatgattctgcatcacttaagttcaaccatgaagacgttggataaagagcatacatccacacccctatcattccctgatagaaaaagggcatttgagctgacattgctctccttagttctctttcagacattctatcagtcaatcagtttatttactagcttcatttttttttatttcttcttgcccccatagcttaactcacactgtttcttacatggatggtcttcactatttttaaataatttatgtcaattcctttcattaacacccaactcagggttccctttaactactccgttccagagaaggatgtgtatcacccccactctcacctctcattggtcttccctctgagctcatggtatttgtcctactgtataatttatttgttttatattttagtatggttttgttctgtagtatctatgcttttgcacctgcattctgataagtttttatttttattttttggttttttttttgagtagcagcaaaagtgctgcagcctatattgaaggaccattagtagtatacctactgttaataactgagcagttataactagttgtattattttatttcctcacaaaagtgtttggggtatgtgacacaaattagatgagatcatgggagttcaatgcacagcgtctgttacatatgtcatgtctgataaatggtgaattactgccaatctttaactcatgatttagcaagattttttgtgttagtataatagttattaaactctaagttccttaagagtaagtaccattaaatatagttcttttgcacataataaatacataatagatatatccattatgtatatcttatagttaaatgggtattcagtcaattcttagtgattggtgggtggttttttgttttttggttttttttttttttttagattttcttttttgagatggagtctcacactgtcaccaggctggagtgcagtggcacaatctcggctcactgcaagctctgcctcccgggttcaagcaattcccccacctcagcctcccgagtagctgggactacaggcgcctgccactgcaccagctaattttttgtattttagtagagatgaggtttcactatgttggccaggttagtctcgatctcctgacctcgtgatccacctgcctcggcctcccaaagtgctgggattacaggtgtgagccaccacgcccggccagtgggtgttctttaaaaaataaatcagcaagattgtacttaaatggtttagctcaaaatccttcaagttattgaaatttaatttgtatgagcctttcacatacgtgtattacagaggtatagatctatgattctatactcattgcagatgttcaataaccatttatggaacattgaatgatttagtgtagtgtgaggacagggttatgaaatgagattcttgtcctgaaaaatgaattaaagtattatttaaataaataaaatacttactatgaaagttaagacagtttctcttttggctggcttcaagtcgtcattcaacgaataaactctaacttttactgtaagaataattgatataatcaaaaactctgctaaaaacaaggatattttgattttttaaaacaaccatccttaaaagagatgaatcttactttaaaaaactcaatacacaaaagtccatatttgaaaaaaacaaaaattagtttgcagacatatacattactaaagattctcttatttaagagaatcctcagggattcctttaaagaactatttctcttagtggatttaaagtacagttcactttcttaaaatacatttacctacaatgttttgagaaaacattcacagtatgaaattaattacatctgtaattaggccattatttattaagaatttcatagtagcaaaatagtgacatcaccatatggttatagaggagcataatatattgtctcagagttgaagatcttaatggaaaattgggagcttgattcagacatacactcttccacttatgaaaacccacaaggctccaaattagctcttattgcaaaaggcagctttggattatatggttttgttctatttattgagccagatcctacacttgttcgctcattgttaaaagagcaatggcaggggctcaataactgttagttctcttccatttctttctgtcagttaatagatccctactttttaaacaaaagcatctgtttcgcttttaactcacagctgtttgagacacagtgatctaattctttccaatgacaaacttaatttctctagggtgttgctgatgctcaaatcatttcatggccaaaactttacccacaaaataaaatagaactggcaccataaacccagtatcttttaaaagatcagtattatgcaaagctctatataagaagccacattaacactggttttactaagttcacaagataaaaacaatgtgctcagtaaatgccccacctctctgctctctccttcccctcacacctgtctcccaccacaaatcctatctcctgctttttgggacacacccagtctaggcctgagtatcactgggaagctgcccaagtcagaaagtcacaaaagttaagagcacaggccctggaattaaacactttggtttcactcctgcctctgccactttttagtatgaccctgagcaggatacttaatccctctaaaccttagttaactcacttgtaaaacaggaatactagtgtgtgctcatagtgtccttgtgagaattaaataatgcaaagcttttgcatagcctgacacatactaagtaatcaataaatgtttattttattattatttctgttactactatttggctagtttttaacccagtttgtgtttaggttagaaaattaatcttgtcttcacagcgatggtacattggaggcaagatctatacaattttttgtataaaagatatggcttattggccgggtgcagtggcttacacctggaatcccagcactttgggaggccgaggtaagtggatcacttgaggccaagagttcaagcccagcctggccaacatggtgaaatcccatctctactaaatatacaaaattagccaggcatggtggcacgcgcctgaatcccacttacttgggatgctgaggctggagaatcgcttgaacctgggaggcggagattgcaatgagacaagattgcaccactgccctccagcctgggtgacagagcgagacactcactaaataaaaataaaaataaaagatgtggtttattaatttaaaaaaagtttgaatgccaggctggagtgcagtggcgcaatctcggttcactgcaaactccacctcctgggttcatgccattctcctgcctcagcctcccgagtagctgggactacaggcacccaccaccatgcctggctaattttttgtattagctcacatcccgtgtgagccaggatggtctcgatctcctgaccttgtgatccgcctgcctcggcctcccaaagtgctgggattacaggcatgagccaccgcgcccggccttgaatgccttctaatgtgccagtcattatgctacgtactgagatacagtagtgaaacaaatcagacatggacatcttttaatggtgtggaggaaagaggcaaacacaattatatgtaaaattctagggtgtgaagtgccacaaaggatatttgcctggccttatgagcatgtagaagagggagatttgaagaggtcagggaaatcagcgaaagctgcctttagaaggatctgtgatgacacgtgagggtgaagtaggagttaacaaggcaaaggaggggcaagaatgtaccatgtagaggcaacagcatgttacacaggccttaatatggatggggaaacggtgtgagaaagcatctgaaaggaggtcagtttggcttgtgtctatagagggtggggccgtagtaggtgatgaagctggggaagaaggcaggacacaggctttatgaaattgaaggattttgggcaatattctaaagtcatttatccagtaaagccttgaagcctttatcctaaagatgcttacactaaaaatccctcaagaatcttcagattaaatgtgttgatcgggacattatagctataaataacaagacgattaaaaaatacttttaagtaattatttttcttttctgtaaatatggctttgtgctattccatagataataatggaaaacactttcctagtgcttactgtgtgcttggctctatcttaagtgctttacacatactaattcagttaattctcacaactctatgaggtaagttgtattattatctctattttacaagtgaggaaagtgggagtctgagaggctgagtgattcacacagggtcatacagctcacagcagctcaagctgtgacttgaacccagacaatctgactccagagtctgcttttaaccaatttacttcactatcttgcagaaatgggccaatatttatagcaaacttctctcattttactctacgattagaatggatgaggatattacatcgtcttctttttttttctcttttttttttttttttgagacagtcttgctctgttgcccaggctggagtgcagtggcgcgatctcactgcaacctctgcctgccatgttcaagcaattctcatgcctcagcctcccgagtagctggaattacaggcgtgcaccaccacatccagctaatttttgtatttttagtggaaacagggtttcaccatgttggtcaggctggtctcaaactcctgacctcaagtgatccacccgcctgggcttcccaaagtactgggattacaggcatgagccactgtgcctggccaggtattacatcatcttacagtaaagtcctgatagagaaataatacatgaagccttttttttttttttttttttttgctgagacgaagtctcactctttcgcccaggctggagtgcagtggcttgatctcagctcactgcaacctctgccacctgggttcaagcgattctcctgcctcagcctccagagtagctgggattacaggcgcctgccacagtgcctggctaatttttgtagttttagtagagacagggtttcaccatcttggccaggctggtcttaaactcctgaccttgtgatccccccacctcggactcccaaaatgctgggattacaggcatgagacatgaagccattcttaaggaaagccttgataaccgaggaaggtcccagcctctggatattacactgcttactggacaaagactgatgacccttagttgtgggacgtgtcaacaggatccaagcaaaaaagaatccttcaatgtaggaggaggacaagagagatgatatgcttgtttctaggtatgattatgtctaaaaggacccaacctttgtgggcagagactatttccttgtataaaaagttgtctcttggagaaaaaagatgctattattctggagattttattctggccaagtagatagcaatatctccaccccctttaggcttttcctttctgagctgatcataacaaatgctcctgctgaaacggtaatggttcagtccagttccaccccactattctcatcatcaacatcaaccaacatttagcaaatatctactgtgtacaaagtttttcaacaaagtcagatggtccccacttcctttctctgtcctcctccaagaatatcattaatgaaattccatagcctctccttcccatatatacatctctaatattctatttctgatgtacttaaaagtcattgatgacgagagggagaaacgggggaatggaaggctttgcaaacacatgaatatattgggaagcattcatacttttctgtgttttacttttggttcattgggaataggtccagtcattcctattcacatgattttgattggctattctgcccttttgcctctaacagaagaaccatgaatgttaaacaatgttctaacagtaactttcttaggtagatcccctttgaaaattaatatccatatatttctgtgatctagtttatcctctgctgaaatatctgatcccctaggttagatttatttttccagtttggggattagctccagacccagtggaatttttaatgaacatggttctacaataaattatattttcccattgccaaattatatttgcaattaagtcttatatttgtttaataaattgtaacatattggaaaacaaatttttcttgttttccaaacttttacaataatttcgcatagctaattctacagcagttggtttttgtaacaacataacattttacatttttacataacattcaacattttacaattttgaaaaagcattttctacttggaaataagtgatggggcaggtaatgtaattgttggttttgtaatttatttagcactttctccataaatttaaaattaaaatgctattaaatatttgtaagtatagatgtctttgggaattgagagtcttttgagcaaattaaaaagaaaccgatctccactcaatttcaggtattaaaaagctctacaatatagtgtcaatactgtcaaatcccccacccagaggaagaaatatcttataatctacctgactggtctggagtataaacaggtttgtctgtatgaatgaagagaaatccattgtcataggttattggcattctttttgattttgaaaaatgctttgatacaacttccaaatacacataagaaactgggttttgtcctccaggcaattgttttggttgtatctggaaaagaaattgttgatggaaaaagtataataattctaaagttattaaaccattaactttctaaatacaactgtaatctcattagaacaatcagtatgtatatgtaatcatttaaaaagtgatacaggagcaagaagagtaaataaattttgcccgaagcccttcagtgtctaattacataataaaaatttagctttaagcaattgaaagtctctttggttccatgtttcctaaattttatatacatttagtgaaactactactataaaagcctttaagaaaccttcactcaattagtttgctgggttaccccatgctccccattccctttgtgaaacctcctgaccgattctctggacccttagctttttttttttgagacggagtctcacttactctgttgcccaggctggaaagcagtggtgccatctcagctcacgacaacctctgcctcccagattcaagtgattctcctgcctcagcctcccaagtagctgagattacaggtgtgcgccaccatgtccagctaacttttttttttttttttttttgtatttttaatagagacgggtttcaccatgttggccaggctggtcctgaactcctggcctcaagtgatccacctgcctcggcttcccaaagtgctgggattacaggcatcagtcaccgtgcccatgtgtccagcatctctggacccttagtattacctcacatatttctgctcccctgagttgagatgctcattttccaatttatgtttgtaattatcccctttacattcaatgatatgtaaatttaatgcatgaaaagtgataaaaaagaaaagtgtatctatgaaaaattaggctttggaaacacgggatgaaagttaattacaaaaaccaactgctgtagaattagctatgcgaaattattgtaaaagtttggaaaacaagaaaaatctataaatattctgcacccagattgctttgtaagtgcctttaagttctttctccccttttaagaaacagaaactatagaacaggctgggcacagtaacctatgcctgtaatcccagcactttgggaggccgaggcgggcggatcacctgaggtcaggagttcgagaccatcctggccaacatggtgaaacaccttctttattaaaaatgcaaaaattagccaggtgtggtggtgcacgcctgttaatcccagctacttgagaggctgaggtgggagaattgcttgaacctgggaggcgaaggctgcagtgagccgatattacaccactgtcttccagcctgggtgacagagcgagaccctgtctcaacaacaacaacaacaacaacaaaaaagaaactatagaacaaagatgatccattaaatttgtagcacgtaataaatgagatttgacactgcaatccatagacccacacttaaaagaccttggtacaacattaaacaattggcaaataaagatacatgatattgctatgataaaattaaatggttaaaatatgtattgactatgattgccccaccttaatctagtttttcagttaatcatataggtcagcactgttcagagaactttctgtgatgacagaaatattctatatctatgctgtttactatggtagccaatagctacctggggctatttgaacacttgaaatgttgctagtgcaactgagatactgcatttttaatttcagttaaatttgtttgatttaaatttaaaactaagagccacaaatacattgtatcagataaaagagtgtcttttgaaagtaacactttctttttttttttttttttttgagatggagtctcactctgttgcctaggctggagtgcagtggcgcgatcttggctcactgcaacctccgccttctgggttcaagcgattctcctgcctcagtctcccgagtagctgggattacaggcatatgccataaaagtaacacttttaataaatgaattttaattgttaacaaacctaataagtggaagaatttgttaagagatatgagcatttactgctaagaacattaaagaattcctatgtttgactagaaattttttagattagtgtttcttaaacttgagtaatatgcatagtccttttaaaggacaaaagtcatggaggaccctcagcattggctttttattatttataacataatcaaaataatttttgatacaaagatacttaaatatatacaaacttaaaacggtacaatcttatgcttatgatttttgtataattaaaaactcaaaacaaatttataaaataaattcaaaatgttacaaaatcaatataattcgaattttaagctctttattaaatttccatttttaatttctttataaagaactcactttagagaaactctggtctaaatgaactgcagagcccattttacgtctgatattctttgattttctttattaagtatcagaatttttagtaaaaataagttgcaagtatgtctctaagcaatctatactacaatatcttaataggagagttatttgatcaaggttgttctttctattaactgcaggttgtcaatgagagctattcactttagtaatcacaaattttttagtttttgaaactataattgtagaatattagagttcaatcgaatgttcaataatatccatggatttttgtgggcaatgtactacagataaaatcatactcatatttctcaatttctttctaatagtaattttcatagcaaacaagtattttcaattatctccaaatattttcacattagtacaattttattttccaataagaatgtgaaaatggacatgcattgctcaaaaagcagacataacttctgtttagaattttctgtttctgttagaattttcacttacattatcattagtgactgacatcatctaataatcccacagtggatgtaaatgattaaatctatatgttatcaatattcaaactttgtacacatttttattgagaatattctgtatatatatataaagaaaataaaggataaatacatactgttaagattgcagagttttggaatttattctctgaggataaatgaacatggcctgaggagtaactaaattttttatcaggataacttttaatagagattgttgcatcaaatgcttcagtgtatccataaacttgaatcacaatattttcagatgctccaacacggaatatttttggtgctgaaatgacatatctgttgaaaaaggaaaagataaggctcaatgtctttatatgacatattttcttttacttttgatttttttctctcacttgagagattccatttaaaatacatatatttcctcacttaaaaatgatactaataagtcaaaatgtacttgtgacccaccataacttcagcataatttccaagtagtttggaattaagacctgagaagctggaggtttagtttacatttagaaagttaaggtgatagcagcactttctcttagctactgcagccaaggaagacttttaatcatgttgaccagaacatgtaaatggggtcaatattttttgctcaatgaagaaaaaagcagtgattgaattccagctgtggcatctgctggctgagtgaccgtggtaaagtcactaagtctttctgaggctaaaataacttactgtgaaaataatcgccttctttaccaggctctggtaaagattaaataagaacatatatatgaaaaggtctagcactcttagtactcaatacatgttaagatttattaatctcactaaattagtttaaagggagtgatcttagaaatactatgttatactagtaaacggataacggaaaggatagaatatgagtgagctgggaagtgcatttggaaatggaaatagtgatgatggtcctttaagagcaaatcatcatcttcaaacaataatggtaattaagtacttgccacatatcagaggctgtatcagcactttacatacagctcttgttaatttttacaataagccaatgatgctggtactatcattattcgtactttgcaagtggtaaaaggctaacttggctaaggttatacggtttgtaagtaaatgggggaggcctttatatgagttctcagttgttatgtgtacagttgaggtcaagtttatatgttattcacaaccatagactgttctcttatttttacttttcatgtgatttatacaataatggaagtgagtctatacatgcttttgagtgatttttaaaaattattttatttaaaaacttacaaatataaactggattactaagtgtatatcacaagagtatctaatttgaatagcgagaactacatacgctattacataggaaaaaaaagtgttttaacccaaaagggcatagtgatcgactaattcaagtggcccaacaagcttggagggcacccaccaccccacctggcagaattattccaggcttctgccaacattgtgacattttaagagtctggtaaaagcaggaagtttttagtaacaatggaattaatttatcagcaattaaatcctttaaagcatctgacagttatcctgcattacaattaatttggatccacttacaggcaaattacaaaagagaggaaagaatttccagatttccaaccatcatctgaattccccttccccacatgcctagtaggagatggcagaaaatgagaggagttcagtttttatgataataagatatatttactgaaattttgccctgtgataaggcactattctgaatactttatttgtataaactcattgtgtcattacaaccactctgtgaggaactattactccaattttaaggtgaagaaactgctaattaattttcccaaggccacacatataggatttatgaattctataattcacaaattatagaattagaaatcgaacctgagcagcccgtttccagaattaacattttcaactgttgtactaaatggaatttataaagagttttgtaattagaaaaatttagggatataaagctactttaatttcagtatttatagaagctttatgtttttaagtttagtattgctttaattttgaattgtgtatggtaggggtccccaacccctgggccatggacaaataccagtccatggcttgttaggaaccaggctacacagcaggaggtgagcagtggggcaaaggagcattaccacctgagctctgcctcctgtcagatcagtggtggcattagattctcctaggagcatgaactctattgtgaaccgcacatgcgagggatctagattgcaagctccttatgagaatataatgcctgatgatctgaagtggaacagtttcattctgaaaccatccccaccccaatcctggtccatggaaacattgtcttccacaaaacctgtccctagtgccaaaatggttggggactgctggtctatgtgatggtagccgtcaagcaaaaatacatagtgtttagaagcccctaaaagaatattctggaaccaccctttataaagattttggttcttattgacttatcagtagcataatctatccatataaataatttcatagttttctttgtctttcaattgctgcagaggagcaggagcttgcagagaggcaagaatgttattttggcctctatctggaatgctctttcctcaaatatttgcatggtttgcttcctcacttccttcaggctctgtttgagtgcagcctccttaagagaacctttcctggccacattttaaaatagtgccccataattattttttaattctcatactctgctttatttttttcttcataatactacctacctgaccttacacattctttcattggttcattcattcattacttgcttctcccactagaatgcaagctctaggaattgtcttaccgtttgctatatctgcagtgcctatcatatgtttagatgctcaataaatatttgttgaatcaatcaatcaaccaattaattaaagtgattgattgccatgttgtaaatggtacactctgacttcttcagagaaagtgaggaaataatttttattaagggctagtagaaagaattcagaataagtctggacaagaatcatggaacccaggtcctagccctagttctgccaccaatttgaagtcacttaatttcagtctctctaagccttagctgctcgtctttcaaaaagaataaaggcaggatgctaaggtagttgagtgcttgtggccatgtaaaaagatcacagatcagaaatacgagggtgctaaaaaagaatgacatcctaagtatgtgtttatatataatatatttacatgtatacatttatgacaaaatgaaaaaaattgaagtgataaacaggagaccttaataaaaatcctgtttctctctctctagaactgtgacctttggtcagtcacttcccttatctggacttattctcatatataaaatgaataggtttgattagatgatctgcagttacttttcagtattaaaatatttctagatataagatcattatttttaaaacattacttaaaatgcatattatctcaataatgacactaaaaattgtgaaaagtcagctcataaatgtatggtagaagtcactacaacaacagattttcagatcacagtattagattgactcctaaataaccctggtttaactgtgtatagtctatgaaaaacacaaagaaaactaaacaccaagttaaaataagcaaaaaatgtcaagaaagtttattatctggagtttcttttgtgcttttttgaagaggaatttgaataatcacttaacgtaaattttaataaataacaattccataaaagctgtcatgttgttagctactcatcaaatcaaaatgcttccatgactttctcattcagagatgatactattcacttgctgttctcagaagtagcaagttattttcaagttaacagaatctgttaaatttaactcttcattcgtcataactaagatgcattgaaaaatgaagatagcttgttttacttacgtttgctcctgtccccaggttttccccaggaagattaaaaaacaaagtattcccaaaaggcccatggttggaggtagcaggaaaccacggatata

SEQ ID NO: 2363 - DNA, 71448 bp, Homo sapiens
  source 1..71448: mol_type = genomic DNA
aatatttccttgcataagatgataattaaggatgggactcacccttccgtgttgtattttctccaaaacaattatcaccatcaaacatgctacatattttacctgtttatttcattttttgtgtgtctacccctgaatgaatgtatgcttcatgaaggcaaaggcttttgtctgttttattatctgccgagttctcaggactttggtcagtacttgacatcctgtatacacactcagaaattatttgttgaatgaagatatgaaagctgggcttcaagaatgtgtttcagaggttctggagatttctgtttattaactcattgaagaaaattatgggttttattcttatttctaattgcgagaatgcttaatgtcacaggctacataagggcctcagaagtcacattatttttgtacaatgtgaacaggagaatttacgagactgctgtggaagttggtacctaggggtatgctacagggcgtcatgagctggaactgaataagacatgcccaaacaggagagtcaggggagaataatgatctcaaactaacagaaaataatttttgtcagtaactttgagcatgccagtctgctgtttgtgcaagaattctcatttgtaggagttggttcttcgggatggtaaatctgttcattgtgctgggcctagcagtaattgtgctaggccaaacactttccaggatgcagtatttccatcttcctgtttgcacatcttatagttcccacttcacagatgttcaatgttttctcacttgttgatgatcccattttgacacagtagagttggtttccacccttgaagcactgtgggggcaataggcagacacatttggaagtggaggctgtaatgagagagagagagacagtgtgacttaccacagtacattagggtttggctttatctaaatcatccccagggtggcgagctccttgatggtgttaaattaagtttggtctaaagctttctctaatgaatgagaaagccaaaaaataaaaattaaaaacaaaacaaaacaaaaacaacaaaacaacccaccaaaggcaatgaccccaaagacccaactgtgactgaatagagagatctgtatataagagactagagggcactagtaagccagtaagcttaaagagttggcctatttctggcacttcccccgtctcactgtccacatccaatgaggatttgcactatctctggcacctcccttttactcactgcctacattcaatcaggcactagtcctatcaatccatttctccaatgtcttcagcctgtcctttctgttttattttatttttatttttaacattggcattgcctaactacattcatcgttatcatttgtagagcatgtactgtgaagccacacaatatgccaagcactttacatgctttatttttttgaacccttacagcaaacatatgaataggctatcatactaattctacagaagaggaaactgagctcaaagaatgtaagccctttgcgcattgccacacaattagtaaatggtagaagcaggatttaaataatacatgactcacaggcctgagctctttaacataactccatatcacatttgtttctttctttctagaatattattgggttatgcctggggatctgtatttttagtaggcagttaaattgagtgattctcctatgaggcctgcttttggaatcaccaaagcacttcataattcatttaagtcttatgttcatgaaataggtttaaaacaatcatttagagataaagttaccaaagttgagtatatcaaattaattttgaacaaaggtttataggctcatatattctacatgtatgttttagtcaaaggtcaaagtcttccactgtttggcctcaacttccattttcaacattatcttttttactttctccatttcaagtagtttaactgtctgtttccccaacaagaccccaaaagtgctccagtttttgttctttctcctatgtcatctgcctcttttgccagactgatgtgctctttcctacttctccccatacgtccagtttctacaagtcttgcctcctcaatgaagcatttcatagcaacataaccatattctgatcttttgatcgtttcttttctttttttttgagacagggtcttactgtgtctcccaggctggggtgcaatggcacaatcatggctcactgcaccctcgaactcctaggttcaagagatcctcccaccttagccacccaagtagctgggactacaggtgcacccaaccatgctcacctaatctattactctttgtagagatagggtctcattatgttgcccaggctagtctcaaactcctgagctcaactgatcctcctgccttggtgtcccaaagtgctgggattacaggcgtggaccacaatgtctgaccagattttctcttttttctttttcttaacttttattttagtttcagggatacatgtgttaagtttgttatataggtaaattgaatccataagggtttggtgtacagattatttcatcacccaggtaataagcatagtgcatgatgggtagttttttaatcctctccctactcccactatccaccctcaagtcggccctggtgtctgttatttctttgtgtccgtatgttctcattgtttagctcctgcttacaagtaagaacacgtggtatttggttttctgttcttgtattagtttgcttaggataatggcttccagctccatccatgttgctgcaaaagacatgatctcattgttttttatggctgcatagcattccatggtatatttgtaccacattttctttatgcagtttattgttgatgggtatttaggttgagtctatgcctttgctaatgtaaatggtgctacaataaaatacctgtgtatgtatctctatgatagaatgatttatacccctttgggtatatacccagtaatgggaatgctgggtcaaatggtaattatgttttaagtccttcaaggaattctgttttaagttctttgaggaatcgccacactgctttccacaatggttgaactaaagcagatcttttatttagctaaattttagtggtgtaaacttgtcattttacaaaaactgacatttttgtatacattcttattagttagattttcatatgtcttttccccaagacaatgataagtgcttttttggagagcagtgtggctcatctgtcctatcaactcttaacaaggcgctcaattaattcttctggatcaaccgacttgaaattctgaattgtgcatgcaggtataagtgtacaaaaaagaaatttatttaatggatctggaataattcatgttgccaaaatacctgagtcagcgtgagtattagcaatgaggtcatgaatgaatagcttattttaggcagacatcgattctttcccatgtgtctcaactgatggggaaaaatagggaaaggaagtaggagatactcatatgcaccacatgcctgggcatcttgcccttggtaggaaacattttatggaaaagcatgcatttccgtactatgctctccatcaaccagctagagaagattcttgttcattgttggaaagaatgttcttgtccattgatggaagggatggagtttggtgaaagacaggggactattccacctctggttaggacatcagttccttaggtttttggaagggccatggtcactacccttttagtatggatatagcttaaatgttctttgcttaattattttcagaactaccagcaccaaaagacccttcccaccacctctactaattcatccttcaacactcagttctcacgcttctatacttaagaaacccttccagaccagaagatatttctctctcttaatgctcttatcacatcctgacttgcactaaagtgattcatgtaattattgtctaatgttactcctccaaaaatttgacgggtaaaaagggtgcctcatcttaaaaccatcatcatggctgctaaatggatgttggctgaaaaaatttcccgttcctgtcggttggtggtagatatttctgaaattcagataaaatacttaatatctataaaataggcttctgggggatttcattcatgttgtaacttttgaaaggtgaccttcatattactttgaagttctattttaaagttttttaaaattccattttagatagagaaggaaaagagtagctaagagcacaatgtaatcaagaacacagtttaatcaaagtgacattcaattgaactgaaaattactaatattccaacttcccatgagtggcctgggtataaagtacatttttagctttctctgtcttcataaatgctatcatttgtatattgatacttttctatagtgctaatccaaacagaaccctctgtgacatttacttttgctcaccaattaaagaaagctagcagagaaagatcatatctttagaggaaaaaaatgctttgagtttcctgattgtgtgcagaaccaaaaaatattttaaattgcctaaatatatcttctattaagaagtgttcatgtattagtttgactacccaaagcattctgttaatttcacagtttttagtacttttttttttaaaacaaagttaaacacctcaagtatgtgaggatttagatatgtgtacagcaaagcggtaatagtaaagacaggtatttcgataaaattgtaaactgttatttttcactcaggcagatttgaaaaaaaatttgtgggaagatagcaaaaaaagggaagatagcaaaaaaaaaaattatttccaatagaagagttctctgaagactgcttctctatgataaataaggaagaatggaaggtaacactaaatacagccccaaatgcctgacctatctattacagtacagtcagggaacagttcttaacttccctgctgaccaaattttattttctctatgtatttttgacaataatgttcttatactacatttctcagataaaaagttgatatttaaaataaaaatgatgttgtataatactttcagctcttttctatcacagattattgtttgcaagagacgtcagttgagtaatggtgttgatcaagcatcaaaaaaatgaatagtagagtttttgtctaaaaagttatttaatagtgattagaattaagcaacgtgcatatcaggccctagttttctgtaacttatatggaattgctttgtttagacatggcatgaaggttgaaaaccccagatactggcatcctgagttgtcaccatcagatgccagctatgtccaccctctgtcatgtttcaatcttgtggcctgtcaagggagctgaagcttgataatcaaccttaagtggatcggaaaagaactggttttgagtaataagacctctcccctttccaggactgagctgaagaacactgggccacaaagtcaaaaaagagtcaagaggaacaatatggtttttgtctttctttttgcaaaagtaaggtggtttcagcaaagattcctttgcatactttatgctccaatttaagataatttttttggaaaatgttccacaaaggaaatatctctaactgtttgggttctgttgtaatctccaatccgtcttttgaaaaagaaataaagcttagttgggctatttcagggtcaaacttcatcttggagcaaatgtactgctgtgaagtccctgcctcgaaataattcacaactgtaatgtctatggccagtaaacttagggaaaatggaaatagaatgctactccttaagtattaaattggcagagatacaaaggagtgataactccaaggtttggtgagagtgtgggaaagcagtctttactatatgttctaggaaatataatatggcaaaaacatttctggataggcagccaacatattgtatcaataaaaaaaatttaaaaataatatttacctagaaatgtccctttctaagctatatctgaaggatgtaatcttagctcacagatttatttgtgatagatttaggtatgatggcactatttatgatagcaaaatacaggagaaaaaatttaaatgcctaaccagagattggttaaataaatcatagaatacccgtatagacttttgcagacattgagaattatgtggccgaataatatatgttgacatggaaacagttccatgacatagtaagtgaaaaaacagcaatatatagaataacatgtagagtatgctccgattttatattttaaaaatttgtagtatatacggggccactcctgaaatgttcaagacccaggggccaatttttttatggggtgcttatctataaactattagagtcaccccaaattagagtgtcagcatcatactggctttctaatttcaagcaatcttgagcaagaatgccctgctggctagcagcagcaatttgttcaccaagctgttttctgagaatgagggtctagtctgggccagagatgactccacaggcatgagccccagagctctttggggcatctggctgaccccacgcatggtggggaggagaagcagtagagagctggaaagtataacagtgcctgggttcatgtgggatgctgtctgggctcagggtgtcctgcctgaatagtattgtcagccttggctagactaaggcactgaaagaagactgaaagaaatttcaggaagatgctttggcaatgcaaaatccagtcctacctggacagcactattggcctcagacagtcccaaacactagaaggaaacttagacaattctggtgaaggccctccaaagctgggactcggaaggatgcctgaaacacgagatcgggacaagtgctcttcccactggggcctaagggtggtactgattacatatgcatagagaaaagattggcaagatatacacccacattactacagtagttatttctacttgtgggtgattataattttcctttctgtttaaatcattttatgaattttttttacaatgaaaaggaattatttttgattaaggataggttatttttaagaaagatgatgtactagctgagatgaaggttaagtgagagcatttagtatggtcaccattggaacttacctgaacatttttcccagtcatagcaggtgtcatagccacaggattctttctttgtgctgttggatgaaagtcttgtcctttcaagaccccattctaactggcggccgtcttggcaggaaccaatatgtagaaaatggagttgctgattatttaaacatttctcagccaaaaacttacaagcgggtgaagtaaagtaatcgttggagtctgtgtcaaacacacagagatcttctgaatgatggctgcccaagagaggaaagcaagcatttctatatgaagatcagaaaaaaacagggggcacgtagccaatgtagtgtgttcactcaccaaccagttttcttttgcctgttttccccaccccactccaagccctgggcttgagtgagaggaacaggaaagtgttgatataactgagtttaaagtttttacatgtgcagaagttaagtctttaaaaccaaaatgagactgttataatgaacaatctcattttaaacagggaactgggctgagagataattaagaaacttgctacccaatggggaaggaggaattcagcagagcacaggaatatcagttatgtggaaaattcatttatttcatgtctgtgcttcaaaaagctcagctcttccatcaaattggttacactagactggttttcccaatttccagacacagtctgtagggtatctcttacctacagtcttcttctggagacatacaaatgcattcagatcctgattgtttctgtcccagctgacaatggccttttaattttgttagagtatctgaaacaaaagaaaaaaggagaaaagaacagtgcacagcatggattctaagtgataagcttgaattcagagaagaggcagtggtaaaggattcatatttatctcttggagttagatcattcattttggcttctctaaatacattgtcattaaatattccacctgaaaggtcctttccagtgcacatgaggtgtcattttccaacctaaaattgcgattatgttcagataactaaagaaaatggaactgttgaaatttttgttcatttgtttttcaaatatttattgagtatacatgatattctcatcactctgtaaggttctggagagagtagattgagcataaactgacccagatcctgtgctcaccaagcttatagtcttgtgggtgcagacagacattaatcaaatgagcacactaatataaatatagaattgttgcctttcttagggctatcaaagagaagcatataataaaaaattgatgtagctagaaagattagaaaaagtaaaatgaagaaaggtgaggctgttcaatacagaggaaacataaggtatggaaaagttcaaatgggaggcagtggtcgggcatagtggctcacgcttgtaatcccagcattttgggaggctgaggcaggcagatcacaaggtcaggagttcgagaacagcctggtcaatatggcgaaaccccatctgtactaaaaataccaaaattagcagggcatggtggcatgcacctgtagtcccagctactcaggaggctgaggcaaaagagtcacttgaacccgggaggcagaggttgcagtgagccgagattgtgccactgcacccagcctgggcaacagagtaagactctgtctaaaaaaaaaaaaaaaaggcaggcagcatgtgagtttcctggaactgaaagaacccagtgtggttgaagtgctgaaaaacaagaggatggaacaagatgtggccagagaggtaggtgtctggtaggctgtgtgggaggctaatagggtctttgaagggttttgtcttcattttataaatagtagacagtctctgataggttttaagcagggagtggtgtaacaaaatcagccctcgattttgaaaaaaagaaattaattatggcttctgtgcagagaatggatttgaagaggcatggtggtcaatagggctccagggagctaatctatgaggttattgtggtagttcaggtgaaagaggatgataatttggaccaaggttccagaggtggaaatggagaaaagtggataaacttgagacacagctagcaggtaaaacaagtgatattacctattatgtaagttatgagagctgtcaattatatgattcttcggtttctgatttgcataaaagaatatacattagtgccttacctgaaatagaaaatattagaaaatgcttagttttaggaaggaagggtgatgaattaagagttccctactgtagatgttgaatttatggtatctttaagacatccaaacaacgtagatatataggaatttagatattcatgtctaaatctcagtggcgaagtctgtgctaaagatttaaatctgttatttgtctatgggggaatcactgaagctatgcatgtggatgagattcttcagtaggagagtgcagtgtgaggcgaggggacagatccaaaacttgggaaactccagtgattaatgtccaagcactggcaggagcctaccaaaaatagagggcaacagccagaaatgtcggagctaaacaagaatatgaagccaaggaaagaacatatgtgcagaaggtcaacattgctgaaggctgccgaaaggccacagaagataaggaaaaaaaaaaaaagtccattagatttagcaatatggatgtgaatggcttgaaattcagattttcttacaagaatcagtggagaaatgcagctcctaaatgtagctattaatccctgcatggcattctaggcactaggacattatggtgggaaaaaaaaaagaaaggaaggatggaaggaagaaggtggaggagaggagaggaaaggagaggaaaaaagaaagagaaaacagatgttaatcaagtaattataataacggatttataataaagggctgagacaagtattctgaagaaagggaacatggtttcaggagaccacataccataaagactccaactgggaagattagggaaggattcataaggaaattacacttgaaccaagatgaggaactgaatagcatgtcggtgagggagggggatgaaaatagagggagtgacactgggggtgtatttatgaaagagggaaccttggtttctttgctcatgttgaggcccacctagagaacctggacctgaagccgaactcctcagtctattgaatgaaacacattttcttgatctggatctgactattcaggcatcccaagaaccaaaatgacctcgtgagcaagttaattgtcaaggcaggactggaggctcagctcactcttcctcctcttagcttatcaagtagaaggtttgataaggaaaggtggctcacgtaagaagcaaaaataaagatgtaaaaaattcctaggtttcttattcacagttgttttcctttccttctattaccaccattttatctggtgaaacttggcccggaactctcctgaacttggagacctatccttccggtaaggctttagctactatggtttacaatgtggtgatattgtttacctgtgcctctttgccctttgtaattaggcctgggaggagcagcaaggtatacattgtttccaaaaagaatcaattcagctttcaagtggcacacagccttgctctatcactacaggtttgaaattgtcaatgatcttatgcaaggaatctgctcttccaatcagcctcaggttgaagcagtgctgggactcagctgcccacacctcccagcacaggagcaacaaatactccacagtctgtaaagtgctcagggcaagaggatcctctgaagggctaagggaggtgtccaggtctgggaggaaggaaaaaagtaacggtgtagcatctcacatcttcatgaagcagaactttttcacattgaaagaattaataatgtttccctgcctgaaagtgtctttacctcacagtgtcgggttttatttatgattgtctttctctttctgtgactccccttattggtctttctgtcaatattattggagagaaagtatatgaaataggctatgtatttcctttatctagctgtggaacatttcctatttctcagtttggattataattttaatttctaatctaagggcacgtgtgtgcacatgcatgcatatgcccttatgaggatactgcctacagtgtcttaaagatcctaactttctgaagtctatggcttccacatacattcattccactgacacttacattccttgtaatttattattatgatcaggagtctagtgaaaccaagacacaatacttaaacctgaagttctcactaatttccatgagatcgctttactgataattttatttaaggttattcaaaaggttaactttctccctttctttcacacgttataaaagcccagaagagaataaaggacgcaggatggcaatgagcttagggaattagcagagctattgcatagttccggtttgacccacactgtctaaacttgcatcttttttagcctctcagtgcttaagaaatataatggctatagaggctatactaccaatctcagggtgcaccaccttatcagaccccagaacactgagctgctactcacctttttcacaggtgagagagtttgaaatgggtggtgtccaggaattcccctggcatgtgtaccttgatggcccagcaacaacaaagcctttggggcaagttagctcaatggattcaccaattctatacaatctctgaaatggtgtaattgtcaggacttcctgcacaactggcttgatgcactccgtccctgcaagagagcaacatttcatatgtgtttagtggagcagaataaacaaaaaatttaggcaaattttgtgcaaccaaagaggtgattttgatgagatttactgcatctgttcagctttggtgcctccttttgatcagaaaacctgggggataagaatcctgggctttccctcagacccttcattgaaaaattccctttagtttcattatctgagattcccttgctaaagaactggctccagacacatccaacttttatgaaatcattgggaccttttcctttcaagaaacactttcttttctcttatccctagtggatttctccaaatgcaagttaccacgctatgactgatgcagagtgatgggcattctaattgacactggtctcaactctgcttcatggtctcccacaataagtctttggactctcattcaagccttatttgaatcttgtttttcactttactctagcacagatatgtgcagagcctaaagctcattcactctttctcagtaaagaatgtgaacatgaaccaaggagtagtgtcttggcgaaaactacgtcttacacaaaatcccatcttacacaaattcccatttctgttacataaagagtgtaaatatcatcttcttgagactcagcattttgcgtcaatttgaacattgggcaaagcagatgtctgtggttagatacagcttgcagacttcctggatttcttttgaagtgcatacttcacagtcctatgtgtgtgacagtaataggtaggagcaggaacactgaaatatggagataatctggaaatccagttttagcaaatgagcccttctatttattttctgcttcacaaaatctttcaccagagttactaaaaactagtaaaatgtattgatctaaggatgtgattttactgtttttatattgggcacattcattctgtaaagtagtcaagcaaaattgtttgcccagttctcacgttggcattccacatccccttgtctccaggtcccgtctggtaagcatctgaagtactggtatccaacagtttcaaagccagtaaggcatgaaatttcaacatcttctccaaccaagtatagttgcttttcattcttaattaaagcagaaaccagaaattattaatgctatgaataacactctctaaactctttagtctcacactgatcctttctatccttcacttctggatctactcagtcaccaagtcctctcaatttctacttctaaaaacctgttaaagttctctgcttcctgttgccatcattgtttttcttcatgatatttattctttcttactagggcaactttataactggtcactcttctaatccatctccctaaattggttagggttttgtttgtttgtttttttaacttgaaaacttgctcccctgctgggaatggtggcttgtgactataatcccaacactttgagaggctgaggcacatggatcacttgagttcaggagttcgagaccagctggggcaatatggcaaaacccacaaaatacaaaaatacaaaaaagtagccagacagtattttctgtctccacaaaaatacagaaaagtagcgagaagtggtggcatggcctgtggtcccagctacttgggaggctgaagtgggaggattgcttgagcccagaaggttgaggctgtggtgagccatgattgttccattgtacttcagcgtgggcaacagagtgaaatcctgtctcaaaacaaaaaccaaaaaacaaacaaacaaacaaaaacccaaaacaaaaaaaaaatagaagaaaccaaaaaactatatatgggatgtcctactattgctagaatagaaaaaccatatactcaccatgtagtgactataaactgaataaataatatatcttacatataaagcaaacatatgcagttgctattatgactgagtgcagatcatttaaaaatgttactcaattcctagtaacccattggtcattatatattttcccaattaatggattgtacaactaccttcatgttgctggggggtgggggtgattcactacaattttcaaggtaaagtgggtcttagacttcttagtttggaatatttattttaacttactttaccaccctcacctcctgccatttcctcccataaaacctatgctctagcaaaacaaaaccctgccattcttcgaacataaacttctttttcatgcctccatgtctccacttggttgtttcttgtatcctcaacaccttctctcttcccttctctcaagacccagctcaaatagaacatcctttgcaaaaatctttgatttccctagtatcttgaggtacaacgtcctttcagttctgagggaaactcatgcaaagctctatttttatagtgtttatcacgtttatcagccccacccctgatcctttagtggcaactccacaaccagatctctgtctcataaatctttacacaggccttaattctttgctgaaagaatacaaaacattatccttcttaaggagctagtaatgcaatacaattttcctttactgagaggggcaagagtaccaagaattgactaagcagttgttcttctgagaattgaagttgggaactttgagagcggtgaaagcttaattgtcagcttatgttgttacttggccatatggttaaacttgtctcctagaagattcttaattttctggatacaaaactaccatcctactgttggttattactgatatggctttgtttccaagggaaatggactaatgatttggatgttttcttcaaaggctgcacattttttcttgcatttcttctgaaataaatttttgccttaaacttttgtttctatttcttgtttcttatgaatctgtaacatataagtgtatgttgcaataatcaaacttagggaagtacatctagtagactgactaaacaaaaaaccttgccaaaagtccctgtcacttacagaggttggacttgtctgttactcattaaataaatatacttgtgtgcaataacatcattgctctagcctggaattaggcatatctgcctctatttgaatctatacaaggggcattttgccactagaaattccagaagatgcttattaggaaaaaataaaattttattacatttgagtaaaaactattgccagacagagaccaggcctttagtaaagagcaaaataaaataagaaatgaatttatccatgaaaatgggaatatataatctaaccttacgaaatgagttagaagaataatgcatcactgttgaaagccttcgtgtgttttaaaaatgagaatgtcaataattttaacggtctttgtatgcagccagaacaaatagattaaaagttattttggtatctggatctgccaatatgtgattttaaggataatgttctagggcaggggccagtaagcttttctataagtggcctggatagtcatctgtaggccatatggcatctgttgaaattactcacttctgccattattgtatgaaagtagccatagacgatatgtaaacatatgaatgtggctgtgttccaataaaaataagactttatttttttttaagtggcaggtcaaatttggcctttgggccatagattgatggctcttgttcaagagaatttgttcccaaagtgtggctcctaaaccagcagcatccatattacctaggaatgtattagcaatggatatttctgtgcccttcccaaaaccttctggatcagaaactcgaggagtgagacccaatgatctgtgttttaccaggtcctttggcgcattgttgagtttgagaacctattttctagagtaaagactaattaaaattaccttcctctgaaatatttcctccccataaactttaaggtatggtccttatgcatgggcagaagataagtgaatatggaagatacattagcccagactacactccatgaataaaactatttgctggacttagagaattgagtgttattgatcttttatcataagtgtgatacagttgggaaaagattaatgtaaagatattactaagtttaagaaaggtaaaatgaaataggaagcatgacttctgtgatcacttttagatatcatgtatcacctgtaaaatttatgtcaaagggcatagatctgtctgacaaaatgtattcagcttttaaaaaaatcatagaaacatgttgtggcttggtaaaaaaaaaagttgaaacttaaaggtatgtgaaaatggttttgactgattaagagttctacaggtttctaacctaataaaaacaatacagaattaacacctccatgattatagccagtctagtgtgtttctctaaacattccttaggtaagggtatcagtttgctcagactctgaaatagccagatcttacttgcaaattctcacaagtcatacaatcctatattatactgaagttctattacctttccaagaaacccaagcaatctgctatactttagtctaacaactggctatgaagacatctctaggaaattcaagatggaagagtggcaaagtgtttctaaatattattttgtacttttaaagtcaataggagattattcgaataggaaaacagtaactctaattaaaagacaagctatacttttcgaggtttttaaaactacaaaccaaaagtgaggtttaggatgctgacccggataaatccattttctggaggaactggctgaggacacccggaatctgcttctatctcaggaagatcgacctctttcatttcttcgtcatcattgatacatggttgtccactaaaagggaaacataaatatgtgtgtatatgtatgtatgtacacacatttacatgtgtgtatatgcttatgtgtatacatgtgtacacattgcatacatatatgtattaaatagaaaacattacacacagaaaaaggcacggcagtagacccagtggctcattaatattctgtgttggcataggtaaagttctaattatttctttacttagcagtagactaataaccatttgaactctcaatgttattgagagttagggcaaaatgacccattcttttcccttacccggccttacttgttttccatgattgaaaatgtgcagtcttcctcttgtcgcttctccccctcacagcgtttccctcctcgttggggggcaggattattgcattctcgggttctcgatctcttataagtagcatcacaggtactccaggaagaccaacaaccccactgtccgtctactgcatctggaacaaaggaagactcactcccatggatcatggtgcagctgaatttgggtttggaagtgaggccaacctggtttcctcactttttagctcagtaacttcctttgtgggatatgatagggttcttctaaggattaaaagaaattacctgtgcaaggggcctgacacattgcctgatttccttttagactttgttcccataagcctaaataaaatggcaacaaatggcaatcattatgaattattttcaactgttaagaaacctctgtattcttggctttggaggccttttaaaaatgtgcactcatatgtgtataaatataaacatcttcttaacagaatgcatattaaattacacttttaaaggaagtagtatacattcttactcccatgccttaccctgtttctaaggaggatttgaggtaactatgaacatacttagtcctgtatgaaaactttggttgtggcttaatttattttttattacaaagccatccttctatattacaatacataagaggcttataatatcagaatcatatattttatttgatgttatgtttgattttttatgttatgagcattgtatatgtattcttgatatataaatacgcatataatatattcatattccttagatagatactggtgttatcctcattttatggatgaacagattgaggcatagggaagctgggtaactttcccaagctcacatagttggtaggttacagctgagactcacactttttgcaggtttatcttccctctgagcctgtacaaggtggaggttgctaatagaagttttgtttctttttaattgaccaacttagaatactctttggaggggaaaacttatctacctcacaatagattcctgatacttactggatttataatctggagactgtttctcacagttctcaccataggtgccactctgacacacacacagacattcagtccctgagagggtgggtcggccattattagggcatggagcacactggcaaggatcgaacttggctgcatactcttgcaaagctttcctgaggttgttccgttttgtcactgcacaggggatgtttcttaccaagtccacgatgggggcaagctaggagaaaatgggagagaggaggtccagtcacatcccctttggtaataggttgccattactgcccagttctctgaaatgagagggaaagcctgaaaattttacacttcaaagggattattgcagaatatagtattgcacctgttgaaccagtaggcaaaagccttctacctgtggacaggtgtgatgtatatggcacttaccttccctacaattttactgtgaaggaagcatgggaggtgttgcttacttggttatatatcatgttatttattaagtattctatgcatgcatcaaagcactgagataggtgaccaagagttaggcaactctttcctgctctactgaaacctcattaaatttgattcaagcagcaaaaaatttagagaggataagagaagctttccatgttctttttttccaggacagttttggcttttgttggagttagatgagaaaatgtggagtgggagaaaatgaagaaataaacttgccagtaggatgaatggaagaattacagtaacaaataataggctaatgataaatcagtgctcattttattaacatcataaaacctcaaagaaatgaccttctagtgcaatatgacttgcaagtacccggaggggcagctgggtctcatttttctcccataacatgtagagctcaacacatcttcacgctgcaggcaaatgattctattttcataatgattgaaaccttttatcttcatttaaatgaaatgaacataacagcttctttggaggccttttaaaaatatggatatgtttgggggaaaacaggttctaaatggcatatggctgatacgtgggtaaagtattccataaataataaatatcaccttttaatgtaattacaacaaatacaaaactggtaaattcaatcaatagtaatagaaatggatctaaaatctcatttatctcacagagctacaaatgaagacttaggagtgttcatcaaataaggagttgcaagaagaacacagaaaccagatttattgtatacatgaaaaaataaaaagtactactcaaggaaagtttgagcatttttattcactaagttccatttcctggtgtttcatgcatgctaggaattctaaatactgtactgttgaatgcttgtttgaatagcaaacgcattagacatgcaatttaacatttaaaaaaaggtacattgtgcatgaatactaaagaaaggcatttctttcattgtctgagaagaaaatggaaaataaattgtgtgatgtgcaatttgggctgctagagaactactttagatctcttacctggaataatttttactcttacctcaaagtcaatcacagcaggattttccttcactgattctaaccactcagaaaatgtcttctcctccagaccagagctccctttctcccatgccaaagctgctccatattcactccttccacctcgaatcagggatatggatttctctgctccctgtataaatgaacctgcaaggtgtttcaataaaaatgcccatttaattttagtgcaaattcctattctaaaacaaacaaacaaaaacctatttgtacagaagggagaagtagatggtacagtatgtagctccattaagaaagctaagtgaaaaagcaagagaacactcctcctccctgtagggagtttaataatagaaataataataacagtactaacagctaccatttattaagcatctggtagatgccaggcactttacacacatcttatataattctcatgacaaccctgagaagtaggtattattataaacattgaagccgaaagtaatttgtcctggaacacatggttactaagagacaggactaggatgcaaatatagcccagtccttgactactctgccccttactctttaatgtcaaccgccctgcttctgatttatgttagcatatgttttgggtgcccagaataagataagtcacatggcttctgatagccagtcaattgactgtcatggtgaaacttccaattacagggaaaaaatggtggaatgattttatatttaaagacagaggtgaaagcacaactaacacagaaaaaaacccccatcaggttaagagttggcacaatgtttctttagacacaatgacatttactgttaaagtatatagcacaactcttttatacaaattgccataacaatttccactaaccaaatggtaactctaactaacagggatagagactgagtaataaggaattgccataagaaatagtagcaaataaaaagaaggctagtgatatgagcgatagttagtggcattaatttggtgtctatcagtaagaattagctatgatcccactatttagcaattctatagtaagatagtctagaatgattaggaaatggatgcaactgtcttcctatgaagaaagtagtatggctgcttttagagtcaagtgcataacacaacacaggtataaggcgtaacaaaacaaaggtatacaaggaaaattttagaggtttttgtatttatttttcatggaaaagtagaagccaaattagagtttgccaatatatcatgtacagactgacagtggcttcgtcatgttatttcatatttagattgataccatgtatttcataaatggattgacactggtaagggttatctgtgaggggcatgggatcctgaagaaagagtaagtctgtttactgttccattagcttactctcacaagtgagcaagtgccttaaaaagattccagaaagaaaatgcagattgaagataatgccaataatgcaaacaaaagaaaaaaaaaaactagtaaaagacagaatgaatatttctacttatacaatcttctcagaagccacatcgtaagatgaacaccaaagctgaccaaaagcatgtcaaaaatttcaagaaacttttgtaatatatgtatttatcaatgaactttttttttttttttttttgagatagaggtctcgctctgccgcccaggctggaatgcattggtgcgatcttagctcactgcagcctctgcctcctgggttcaagtgattctcctgcctcagcctcccaagtagatgggattacaggcatgcgtcaccaggcctagctaattttcatatttttagtagagacagggtttcaccacgttggccaggatggtcttggtctcctaatcttgtgatctgcctgccttggcctcccaaagtgctgggattacaggtgtgagccactgcgcccagcctgaactttgtttttaagtgtgtgcagccactactatgaggaagataaaagttctgtttgtttcatatatgctatttaaaaaacaatttccattttttacatttgcatattttaatgcacatttttgaataatacatttctacaattctttagtaaaaatgtataaattagtgatatatcctcaaaaaattttaaaaatgatataattacagatttgagaagtctgaagtccaatgatttaactgaaatagctcagggttagaaataggcaaatctatgttcttgtgtgtgttttgctcttcaatgtgtctgtgactttgactttaggcaaattgtcatcaataatttgttgagaatcttctatatgtcaggcccagataaatataaaatatcgtgttaagaactcagactctcaatgagtatatggaataggtatataaatatgctagcaagactatggagaaataaacaaggatggaaaagaagaaaggaaggaaggtagaaaggggggagggagggagagagggagggaaaatggaagaaaagaaaggaaattaaaaagaccaataaaatagtttttgcttagtattactcaatggtaaaaacaatgaacaattactgagttaggaaaatgaaataattctgtcatctttggcaattaaggaggatggcgctctgaaggaagactgacatgttcctggaaggaaaggtgagacctattagggagatcatggccctaatattagggagacaatggccttctaagcatgggcacaccatgggcaaggacctggagtcagggccgttgtgccatgctctggagacagcacatataggcatgagtttgagttgaaatggaaggtccagggagggggaagaacagcagaaatgagagagtctggatgtaaagccaaggaaattagacttcattcttcaggtttagaaacaattgcattccctagaaacaatgaaaggttttgaggtggggatttaaaatgattcaggaatattagcagtattgtgtcatctgggtagcaatgggtaattgaaaagccagcttggagcctattgcaacggtctctaactttgcaatgtcctcttgttcctacaggctgaaaactggggtccatatgtgatattttctcatgtcaattcctctacattaactcagtttcctaagttgccctgattccagtctagtattttcttatattttaagtaaatttttatactgaagtataatattgacacagaaatgtacataaatcattaagcatacagctcaattaatttgtaaaaagtgagcacacccatataatcactgcccacgcctggaaatagaactctagcaacaccggaaagcctccttcatgcttttatccagtcattattccatccccaaatgcaaacgccaattgtattattattgctatagattagctttgcatatttttaactttatatgtaaggttttaaaacatgtactcttttgtgcctggtttcttttgctcagttttatgtttgtggcattcatctatcttgtttgtagtagtagttaattcatatcataatttgctcattttactcttgatagacatttgagttgtatccaataaatgaacaatgtggcttttcttatttttgatccatgtgtgtgcatatttttgttggcgcatatctattagtagagtttctaagtcataaatatgtgtgcgtgcatttatgtttcactttagtagatattgccaaatagtttccaaaatggtattaccaatttatactcctaccagcaatgtatggcaggttgtgaagttctactgccaatacttgttaatttaaattttttcatcatttgcatgaggtggtattttatggttttaattttatccttttgattcccagttatctttatcatattttcatgtttattgctttttaaaatatgttcttttgtgaagggcttattctatatttttgcttattttacaatttcaactacaattttcctatattatatgtctttactacatgtcacttgtgcaactacaaaataattatagcagacatgtattgaatatttagtatagcctaggctttgtcctcatcaatttatatggattgtttatttaattctcacaataagcataagtaaatactattattatttttattttacttacaagaagaaagattaaactcttgatgttgattacatagccaatcaacagtggagccaacacttgaatataatctagcctgaaaatttaggcgatatgcaatgaacttaatacatcacagcatgaaataatttctataaataacattttactttcctacttggtaatttttactgctttcccactgaatcaatccagtaaagtgttctgctcaatagtaagtctgtgaatttcttggcaaggtattttaggggaaaactgcatagtatatcagcttcttaaaaaactacaatgttctttataattttaaaagctgagaatttctcttaaacactgttacactcaaagtttttcaatttaaagatggaactcccttttcacatgcagcacctattaacattctgtagatgatatgtgggatagtgacaatatttaataggattaagtctaatttttttagtaaggcatacaagccctgttttgtatggactaaacctaccttgtcagctttatttcacaaatttatgctcaagctaaatagaaatactcatttattcatttacacattcattcttttcctctctatgcctctgtgtcctcatctataaaatgggggtaataattgtaccagtctcatggggttgttgtgagaattagaagttaacacacacagaacacttaggacagtgcctggagcatagcaagagttcaataaatgttaattacccattcatttattctttcaagcattcatgtgttcaatgagcacatctattaaacatttataatgtgctaaacatggtatgaagtactgaggacataaagaccatgtcactgtcctgaatttgcatactgtggaggaaatagaaagtaaacataatacagtgtgatgagtgctatgatgttgtgaatgcaggttgcagtgagtacgtctaggagggcacctaaccttaattatgaacaacaatagagatggtaatcaggtaagacttcttggactgtctgctaaaaatttcaattttgaaatttttcaattttgaaattacaatttcaagattttgttacttcaaaatagctattacatctttagcatatttaacacttaagcaatgcagaaaagcacaataattattccccttgttgtttagtcttagttttatacagtaaatgaatccagttctcattgcttcatctttgctcactgtttctttactcctgggctctatatttatctgttggattaatgttttaatattaatttttttatgtgtttttatattttctttatctctattatttctctcataattgaagctgaatcatgggctttctatatatacagcctcaggctggagagagtcaagagagaaaaagagcaaaattttgtctttcgagatctcaagtatacttttataaatctagcaaaaatcatagatttgaaggctagggtttttaatgtcaagggccaggctcttgagagagaaaaagaattcttgagtccttaatgcttgaactaaaatatcaagagccacacattttaggattcagaatcacagaatttacaacatcaaccacagaatgataaaaaatgtatacaacagccattttccttctcaaaagtaggaaagattttgagcagctgggagaatgggggaatattggacatgtggtaactaaaatatagacttgatggattccttagtgcaggcctaagattccaccactttggggaaaatcttggaaataatagtttgacaagtagaagtttgatagaagctcataagaggctctgcaataagttaatggaaaatgtgtattatgaaaaaaatgcatagctttcaaatttttttgcacaaaaataaactcatactaacttatcataacatagctgaataggatcaagcttgaggcacaaagagggataagacatcagtttgaaaagagtccctatcagagcaacttgaaatttgctaaaatagaagtaagaccaaacatcaaatttatggtgaagcttgggaggaagaatggtgaaatcactgatgccttaggaaaagtttatggggacaatacttcaaggcaatcagcagtttacagattcataactcattgtaggaagggaagaaataatgttgaagagaaaactcctagcagtagaccatctacatgaatttgtgaggaaaaaatttaccttattcctgccctaattgaagaagactgatgattaacagtgggaacaagagccaacactgtagaaatcttaattagttcagtttacacaatcataactgaaaaattaaagatgagcaaactttccactcaatagctgccaaaactactgtgtccagatcagctgcagacaagagcagagctttcaataaaaattttaaacatgtaggatcagatcctgaagcacttttaaaaaagaaatgtacacaggagatgaaaaatggatttactagtatggtcctgaagacaaagcactatcaaagtaatggctaccaagaggtggaagtgggccagccaaagcaaaaatggcctagtcaagagcaaaggtcttggaaatggttttgtgggatgctcgaggcattttgcttgttgatttgctggagggtcaaagaataataacatattatgagagtgttttgagacagccaaacttttagcagaaaaatgcccaggaaagctttaccagggacaccttctctactgtgacgatgctcctactcattcctctaatcaaacaagggcaattttttagatgagaaattattagatattcaccttacagtctttctttgactccttctgacttcttttgttttctaatcttaaaaatgtctttaaagggcaccctttttttcagttattaatgtgaagaagattgcattgacacagttaaagtcctaggaccctcagttccttacggatggactaaatggctggcatcattgctaacaaatgtgtcaacttgatgaaacttatgttgataaataaagtttatattttctatttttatcttttacttccagttccctgtgaactttttgaagtcctctcatgtacatttaatcttctcaagtagtaggaagggaatggcaagccttgtagagaatcttttgtatccaacatggcacccaagcaagtagttccttagtagtctcaaggccctcacatttcactgtgatgtacagaaaacaggcaagggttccctaaagcctgaagaaggtgagaaagtcttgagaaagagtggtagacaaaagatggcctggcctttttgtgaggaagattcaaaggatatggatctagtaaccaaaagccaaggcaggaccatcaacattggcaataggtgccagtgcatgattgtgagaaccagaggaggcaaatgacctatcagatgaggctagccaaggcaaagagaaacatgctaacaaaggtctcattctccctgtgactctaggatactatctggccacccttccccaacacatatgcatatgcatatgcatgtgcatgtgtacatacacacatacgcacacacacacaggcacacacacacacgcactcttaaattatccctgacaagcagcaaaggagaaaggtgagggaatcctgagtttgactgaaaattgaaaactgaaacccagaacggctgggttacattacactggcaattttatactttttaccacttagaagaaataggaatttgagagtatatcagttcattctttcattgcaataaagaactacctgagactgggtaatttataaagaaaagaggtttaattgggtcaccgttccacaggctgtacaggaagcctggcaggggaggcctcgggaaacttgcaatcatggcagaaggtgaagaggaaggagtcacgtcctacatgactggagtggtaggaggagggtgaaggggaaagtgctgcatacttttaaacaaccagatctcataagaactcactatcacgagaacagcagggaggaattctgccccaatgatccagtcacctcccaccagacccctcctccaacattggggattacaattctaaatgagatatgggaagggatacaaatccaaaccatatcagaaagctatgttaagttccattaaaatatcctagctttgaacatctgaattattccaattggtttttcattcatgtctttgttgcatagattttatagttgagtagtttttttccagtaggacttaatactgtatttctagaatttgtcttgaagttgcatatttgaacaatatttccctgtatataatcaagaaaaaattcttcctttatttcagagacatattcttatataacattttttaaaaatacagtttttctatttcatttactgagatctctttttcacggatactaattttcacatattaaattacatttgtcattccatttccatcaaattttctttaataatatctaaatgtttttccatgttgagattacttgatatctttcttgtatgtgattaattttattaattttatttttaaagaattatattttgtccttgcattgtataatttatttataattataatgattatgtttctcaatgtttgtttttgtaccttagctttgaaatctgttttaattaattcttgtatttaatctgtctatctctgagttcttgatttattgaactcatattcttattaaattattttactacatgataaactgatatagaatctgtattcatattttggttaatattaccagattatttgctttgcatgctatatgcctttgtgccctctttttcttctttgctataaggagtgtgcagttgtcaagccagttcttctcattttgcttatgcataacacagtcatgtgtatgtagaccatctacctgttctgatatcatatttaaaattatctgtttattattatagtaaatattatattttatttgtttcttgtctgtcttctccatgagaaggtaagcttcaaatttgggaatgtctgtgattctgcttccctttattctaagtagtcaagcaaaataaggaaacagaattttacagagaggaaggagttatttataatggcaaggcataggagagagcatgacttgtttaggaggctgtataaagtttagctgtgcagagaaggacaggaacttatgcttaaggccatgtgaaacctgacatgttctaagtatgaaggtttcatgaataagattttccatagagaagattcctctcaataaaatgtgtagagtagactggaataaaacagactacaagcaggaagaccacttagggggcttctaagataatccaggttggaaatactgaatggaaagtttgccttccattgaaggttttatatccatggaaataaaaagaggaagacaacttgcagagacattcaggaggtagaatgaattgtgcatggttacttattagatatagaaagagggtagaatcaaggacagcagccaggtttctggtttggctgatttagttgacggtgatgccatcatcaaggctgggactgctgaaggagaggaaaggtgaaaggagccaaccactgctggtcactctgcaaggctccttataaacaccatgtcacttagtcttcacaacagtcctactgggctataatgtaaaggctatgctattagatatgagtgagaaccaacagcagcagggagagaatatgtgaagcattgtagcctatagactttccggtagagatgtttagtggacagtagatgtctggagttcagaagggatgtctgggttggggattgggatagaaaagtgaaagcctattgggattggggattgggatagaagagtgaaagcagtggctaaaattgggaaggagtaagatcattctgcaaaacataacttgtatcttcttttttcagtatttttttgcctggattttctttctcactctttccatttgccaaagtcttcagccatttttaatgcatggccccaaaataattcttttcacaaaatctgatgtatttcaatcccaggattttcttctgcccatagtcctttatagccttttagaaactatacctctcttagacccttgtcagtctgtatttttaatggatgtttatatgtttctttactttgtaaggtcctggttcacagccatatgcacttcacaatgcctaatattgagttctgtccatgagcaaaatcaataaattattcattaaacagcctaagtatgagataaagaaaaccttaacaatttccttttttaggtaatgctaatgctattttatttgtatcccctattccaacacacagggttctgaggaagagaaatgaaataaatgaaaagctaaaaatagcacagtcacatccaatatggtctgtaaatgacagccaggctcagggcacactggataagctgctaagagagagtactgttaccttcatgtttctctgacagcttgttggtggtgcacctatgttccacttttgttttcttagcaaataaaacgcgtttctttgtttcaatcctgacacagtgtttggcttcttcctcggttaaacctaggagatgaagtacaaacagaaaccactgagaatgcaccattgacaattcaaagaggaacatggtgctctggtcacttcggatctacagatactttatattagcccctctcttccccagtccccataatcttaagtgacagctcaagttagttttacctatagattcaatcctgcatgggcccagagatgatcctgaacaggagtcccgtgagtgcccatcatctcccctttcagcactgaccctcagaagcacatatgagccattttggcccttcccatggggatggtgatgtcctgtccttgttgcctgccacttgttgccacttaacacaatggagctttaagctctccctttctattggccgctgcactgtgtagccctgcaaatcaaaagattatgacgtgctctgatctgttctctactccaagacctactttccgggccactgctgattctgtgagacctgagtccacttcaattgcttccctgtttgtcacctaaaatgcaaatcttcttggccatgcttcttccgtgaacactcattctcatacctctctgggcttcttctccttaattcacctgctcactcagcccctacctccaaatcctttttattgtaatctcagaaattctgacttcctgacctatgaattattttcagactcctccttggctattctatctcttcatgttaattcaagcctgtacttgatactgtttccactgtcatctccagcagaagttcaaaaggccacattctcaccccattcatgtatgggaattgggaatgatatcttcctagtttctcactgctgctttcattggatgactccccatggtcttataacctgcgaaaaccttgatgctctgaggctcagccatccggttttaatacctttagtcctcattattctcctttatcaaactctctagcatcatttgttgaagatttgggcatctgaaccactcccaccacagtcctgtgatcattctcaatggcctcagaatctgtgtgttagtggaagagtgcagggaaacagatgtagtatttttgtaggctgagttagtactatctggggtaattgagggaaatcaacattttctttttcttaacagcttccccaggcacctgactcactgctggaaacatcaaaactaaaatccagctcttttgatgtttagttaaaatttgccttgcagaatacgagcacatgagaggtagagctgttaatataagctcttaagcacctaaaagcaaagtaggttatcaaatactagtatttggggttgcaggtcataatagcagggatgggtgtttttagagcttgaggttctgattaggtgtgatattgaaatggaaatctgaaggcatagatcgctgagaaatgaggctgggtagatgtgaactgggcctgtctacctcattttttgtgacagttttgaagagatgcattgttatttgggagtaaaaaattcttggtttgaagccctcatgcttagtttgcatattcaaccctaacaaaaagatggttgtttcagtctggttgaataaatataattcatttttcttctagtaggattgtttttataagtgggttagtcaaatatttaggccatactacgaatgtaatgcatttatagtgcatgactccttttcttaaccattctttaggctcttattatttataagtaataattaaattgtatgtgtccagttaattaactataacataatgaattaactataaacttaatttcatttttgagggctatagatgaatcttcaaagatttgaatgatgaatattttttatgacattggtcatgcagtgattaaaatatctggactttatcaatgaatttctgtgcaatccttttcttccctgcagtatgtccagctttttgctgctggacctctatctgtatgaactaacaagctacttgatactgcagtacctcatctcttaaacctcagtgttcctctgctgtggagcacaggaatgagtatttcagtaatgtctttagctaccctgatgcgtaaaagacaggagtgttagttgaaaatttcacattagtaagtagtgtggtgaataatttttaacctccaattcagtgtagaagatgacttcccaataaaaggagtttaaaattatcctcttgcatattaggatatttttattgtttgatgttttcactgtgtttatgaaactcttttcaccttgcacactgaagcaatgccaacttttattcaaggttttaacttgactatgggacattgaacaatagagaaataaatcaatgcatgcaaataaaaggcaatttaattttgttttctttttcttgagggaaagaaagtactatgaaatattcaagtcatttttcaaaaattaacaacaggggatataattcttattgaataaggcatagcaaaaattaaatctatactttagtttcatgttatgatgaggtaaagggagagagaataggaggagagaaaagggaagaggccagaatacatatttatctagagagttgggaaagccaggtaagcacatgaactggagaatttcattttcttgagaagtcatttctgtctgggtgtgcttcattttaacaacaattaaaattttacagataaattattccatataaacttattgaatacaagaatatcgaatacatcttactgagagcttgtttggaggttctagcaggggagtgcagctactcatatacccttgacctaagaccagtcctcctctgttggaggtggtcatcctctttgactgagcatgcagctttggagggacacacataaagtggtgagggaggaaggggacacccatccagccagccagatcagccaaatcaaccctggcgatcaaagaagtgacagatgtcacagctagatcatcctcacatccagaatacatcttactgaatatatatacacacatatatatgcatatatggacacactgtcaatacatgcatacagtgtatgtgtgtgtatgtatgtactgtgtgcatgcatgtatatatggatatgcatgggtatttatttggaatttcctatcacatcccaaactccttttctttccttcattatatgtaactgtcagtctctacctctacagagaaagagatggaatgtgagaaggtttccgtaggaaagtatagctcatcactcttcattttggtgatggggctttaactaatagttgattaaagattcacccagttctcaactgacctgatccctaagcatttaggggctctgctctgaatgcatgaggattatactcatcaagtgggaaattattttctgggctatagcagaagtgaccagaataatttcttctgagggtgagacaaaaccaagtcaagagcagagatttcccctaattacttctgctcagcattagtgttgatactatttgcagtagcagaagacatcaaattcacatgcaagagttactccagtggaaaggataactgaaaggaaacataaagcatgcaggcagtgtggaaagcctacaataacgcaaatcttttgcatttagtttcaggtttcatcaccagtaagtgctcatctggcccactctagcttagtcgcttgtcaagtttttaacttttctttcatcatatgtttcatcttggcttgtagttaaaattattacaggaaaaaattgctatttaattcgttataaggtattgctttatgaaattatatcctataaaaatgttattcataaattatcttttagaatttagtgccagtacaaagttggtttcccttgagatattggcatgcatcttcctctttgggtaaccactactgtgtaagcttatgatgttcccagatgttaggaaatttagagacaaatatgatgcctaaaatcacagtggttaagcatacttatttttctttattttttggtcttagttttctatttttgttttatttatttgaatgtgtattttttatcattcttcatatcattttggaaataaagcaggatctaaataaagtcaaagcagaataattaaaatgatagagtaagagaaaaatgtattgcatgctatcataccagttaaaaagagtgaggactgaagaaagttacctgagttctttagttcctcactgctaaactgatagagaaggtcatacacgcctcccagggagccagaggtgaagtaatgagtcccaaagtcatcgaatattcggctgtacaaagcagagttgtattctagaggcagatggttaagtgctttcaaaaagacatcagaaaggtgcagatctttagctttcgttgtgaagtttaagactttcatcactttatggatcctaataaaactagaatcctaaatggaagaaagaagtaaaaagatgattaaaggtaatgaaagtttgaagtacctagcatttaaatgtcattgatttatcattagtttcattcccaccacagaattacaataattctcactctctattgcatgttctcacgtacaaaattataattttcattttgctttccaataccaatgtccaatgtgcaaaacaggtaagattatctcaataatgtaaactgtgtaatgggggcacgtgttctctaagaaagaagaaatcagtgatcaaaaaagtcatctttctctcctgattgccaatcatggctgcatttctactgagtttttatttagaatatttgctaatgtgaataattgaaaaagaattgtgtgcattttgaactggaagttatgcaactgagatggaggttatgcaagtgagattcaagttacagctttgtcattctggaaaaagcgtttcgattctctagacttcagttgtcaaatgataagatgagggcttgcacctggtaacacttcacatctcctttcaactccaaaatgctgattctaaattacttagtgggtgaaattaagtaaaattatttatattctctctcctccacccatatgcagaaatatatgagtttttttgtttacaaacttatttatttatcatttctttttatgtcaggttaattgagaattagctggtcaatattatgcttaaaatctcatttcctcagattatctttctacatagccactgaggtttataagtgtatttatgtacattgttttaaaaaaaatttatatactttatctgatctctcaattttaacaaattgtagtaatagtaacagagtaaggaccatgttttagcaaaataactgtattataactgttaattattaaccgtattcctctttgctataagtatggcaaaagatgactgctgacacaaaagaaaaaaaataatcccaaggattgaaaaagaatcagcattaatctcccttctgtctttccttttccctgtccctctcttcctttattctaccttctggccttctatacattcattgcctacctatctgagatgctgtagatacagaagtgaagaaggcagacaaagttcgtgcctttgtggaacttccattttagtaagtgctcattaattctatttttaagtttaatacttgaattttgtcagagaaccatagttttcaaaagttggagagcccttgtgcttttaataagaagcacactcactccctgagtatctgaactgccctttctggaaggttcaatatttccaggtttctttaaggtctcagtcgtggaaaatacaagttaaactttggtagctcaacttagcacaataacctccatggtgttctacttgctggttcatgatacctgaaactggctattttagattaaaaaaatacattactataggttattaaaccacatataatctatttcaacaatgtgtgaggtcctgctttattttaataatattattgtggtttccattttgtaaagtatatcaagaaaatactgaacctgactgagttatctggtattttgcttggaaacagactgtttgtccaacaaatgtctagtttgatctgtgaatgacgaaacaactaaagctttatgctctactgaaagacttggattgattttcaattttgtggtatcttgttttctctacttgaagactaagagaggcttcagtagtattttcttttttctttttctttttcttttttttttttttttttttgtgagatggagacagagctagctctgtcacccaggctggagtgcagtggtgccatcttggctcattgcaacctttgcctcctgggttcaagtgattctcctgcctcagcctcccgagtagctgggaccacaagcccccgccaccacgtctggcaaatttttgtatttttagtagatacagggtttcaccatgttggtcaggctggcctcaaactcctgacctcaggtgatctgcctacctcagtcctccaaagttctgggattataggcatgagccaccgcgcccagcctcatttccttagactgaaattccttaattctgttcagaactaatcaaagatgacagtaatgatgttggattgaactatatgaagctaacaattttttgttgttgttgttgctctgtcacccaggctggagtacagtggtgcgatctccgctcactgcaacctccgcctcccgggttcaagtgattctcctgtctcagcctcctgagtagctgggatcacaggcgcacactgccacgcccggctaattttttgtattttagtagagatgaagtttcactgtgtttcccaggctggtcttgaactcctgagctcaggcaatctgcccaccttggccttccaaagtgctaggattacaggcatgagccaccgtccctggtgaggctaacaattttgtaaatcaaaaatggttgaataacagtagtttaatatgttccaacctgatattgtgaatagctctaaattttttaactttgggacagactattaggagatcaaacaatagctgtttatctacatataagggttttacaaacgttctctagcatgtttgaaatacatataaatcacatacgtgaagcaagacataggactgtacctatgtctcatacaaacatgtctatctatctcccttcatcattgactatgtttataagcagttatttccaatcctgcatgctatattatactgagctagggagctaaaaataaaaaaggccatattcccatgcccaatcccaggtattctgaattagtagattaagggaaagtgctagagatgtgtatttttacttacaagaaattctgatactatcttgtcttacaaagataatttgttaagtttggagggctctataggacccacagcccattctaaactaagttatatatatataaaatatatgttatattatatatataaattatatatagttatatataatttatacataaaatgaatctatttcattgtcatttttacatgtctgtgtcaccagaactgtgttctttctgtattttgctaaaattatgaataaataaatgaatgaataaagagtcaaatatcttgaagtgtaatacaatgaataagaaaagtaagcaaaaataagacaaacagatttcagttcccaactctagcatttatttactgtaagatcactggaagtcacttagcttcttggactttagttagtgcctgactcatggtaggtatttgataaatgttcgttgaattaaaaatgcgtatatgaatttcaatctattcatctgcaaaatgatgtttaaatattgactctgataatctcttagaattgttttgaggataaatgaaatacttgggaaaactatccacacagtgctttaggtcttatatttgtataagtgcataaatggttgactaaataaaagtagaagagcaatacgataaaagtaggagcaaccgtaatatggtggcctccagttgctgatctcattaactctgacattggtacctctatttcctccctctctagttccatgattcagggctcattctcctcattcatctcttgggaaagagcaaatgctacttagagtggtggttgtagtgagcaatagacagtattttaaaatatctttgtaaatgtctaaaaatttcagatagaaatgtgtcttctaaatcatttaaacactgtgagacatatctaagagatttaaaatgaaaataataggagaaaaaggaacacatgaagctgtagctttgtatattaaaagggttctctaagtccctggcaagattaacaggaaaagtccaatacttagacataccctaagttccaagtgcaaaaaagaattgtaacttttcaagcagggaaaagaaaatgaaaaaatttgctctgaatatgattgttcttatacagcaatggaaattagaagacaattgaataacatctactatcaagagaagaagattatgatacagtcaggatattctttatatttattgctcagggaaaaggcaggcaatgttagatacaaaagatttagagaatataccttgcatgtgtcctatatgaggaattaaaaaaaaaaaaaggcaactgaatgagaacagggatctcaagaaaaggaatataagaggaaaaaaatggagataggtaaatgtgcgtgtgtttacataaatgtagcaaaatacacattttgttatattttatatatgtatttgtatatgtgtacaaatatatacatctatacaaatatgtatataacatataacaaaaatataaaatacagattgtcatattacatgaaaggtcaaagttctgttgtatggagtttataagaagcacacctacaacaatatgaaaaaaaagtgaagataaaaaacataacaataacagtcaaatgcatgcaaaatggaaccattaatatacataatatttctataacttttgaagtgagatataacaaaaaatggaaaaattacttaaatctgtattagaagtcatactggtacaatatcaaaactctccccttcttattgcatgattactggaattactgttaattttcaagaaagaataaaaggttggaaaccatttttgatacctttttgtgagaggcttgaatggcttgtttgaaggcagaattatggttgatattttcacttctctttgaggaataaaaaattggtacactgaaagagctccccccctgacttgagaatgagccttgttgattttcattgtgtccaagagaagttaaatccttgtagaaatctgttttcaagtcatcttctgcagtttgtacctggagaaaaatccatgtaaaataaaatataatttaggaaatactggagcgacttgtggatatctaatgaaatgatgatttatttatttatgcactcagccagtatttattgaggacacattttgctagagaacaaagaatagtgttatttcctgcactgaggggttaatagtttagttagagagaaagataatcaccaacacttaatgaggtaagtactgtgtgaccagtggaatcccacaggaaatataagaccctgagaggcaatatcaggaaaccctccctcaaggaaatgccacctaagctgagacttaacagggtgataaacaatgaaggttatttttagcatgtctgtgattttgatgcagtgtgcagtctaactaagatacttttcagttctgacaactgggcttgttctttataaccaagtcccaccttgttttatactttttcaagagacgagtctgacttcgggatcacagtttctgaggttgggttcccattgcctgctaccaaagctcccagtgctgatcaactcttgattgacctttgtgttagtcattacgctgtttacaactactctagtctctttctgggcacataaaaagcatgcatttccctactctttttggccaataaaatgtaaatataaatggtatctgtcactttaagagttgatgggcaatatgtcacttccccccgcccctttttttttttttgcaattcatcatcacaccagtcaggatgtgtcaaagcaggatcccttaagtcccttgctttctaagtgactattatcagtagaacgtacagtatgagtggcactgttttaagacactgacatcttagtattgatattgcagtgtaacctaacttgtcttgattaaaatgctgagtctggtgtctgtattccatcatctgtcctgtagttattctaaggtcttctaactccctgcccagttgccttctcttcctttcatgagtctctttaatctttgtataccagccagccaattatttcatctatcttcataagctacaatactacaaaagaagggaagtgagatgcctgctgaatttctcctcctctattgttttcaataaggtatagcttaggtttgcatagctgcctgctaaaagcatgcctaaagaatgaagttatacagagatcagttaaaagaaaaccaatagcttgtgaccttgactctagtcattcccaaatttttgtttgaagaaataccactatgaccttcttcagccatatcactatgacttcagccataccactatggcagagttaaagattagctcaggtagcttcataaggttggacaagtcttagagctacattgataaggaaatgagtttaatctgctgtaaaagaattttcaggctgtatttcctcatgtaacttgttatccaggcttgtgttatcaagctttgtgggttaacccagtgatctgttagtaaatgtttaacaactagctctctgggaaggggaagaaagccctgatttgctatagcatttttcttttccattgtgcatatattcctaccatggctgatttcaagctacctatgtgatgccctgaattcatattgggaagagatgcacagtggcaaattacaaagtattttcataatacagatccaatagatgtaaataaccccaatagcatggataatggtaaaatgtagccaaataattgaaaagtgatcaattttgagcaattataacctttgtttttaatgtgtttacctgtgagataatatatttgatatttaataatggctgtgttttgaccaacaaatatatgaaaaaatgctcatcatcaataatcatcagagaaatgcaaatcaaagccacagtgagatgccatctcacacaagtcaggatgactagtattaaaaagtcaaaaaaacaacagatgttggcaaggctgtggagaaaaggaatgctaatacactgttggtgagaatgtaaattagttcagccactgtggaaagcagtttggatatttctcaaagaacttaaaacagaaccaccatttgacccagcaatctcattcctgggtacatatccaaaagaaaacaaattgttctaccaaaaagacacatgcacttgcatgtttatcgcagtactattcacaatagcaaaggcatagaattaacctaggtgccaatcagcagtggattggataaagataatgtggtacatatgtgccatggaatactagcagccataaaaagaatgaaatcatgtcctttgcagcaacatggatacagctggagaccattatcctaagcaaattaacacaggaacagaaaaacaaatactacatgttttcacttataagtgagagctaaacatcgggcactcatggacataaagatggcaacaacagacactggggtctactagggggggaagggagggaggggcaagagtcgaaaaactgttgggtactctgctcagtacctgggtaaagggatcatttgtacccccaacctcagcatcacacaataaagccaggtgacaaactcgcatatgtattccctgaatctaaaatgaaagttgaaaaagaaaaaaaaaaatctatgtttcacaattggattccaaaattcctgaaaagttaacagttgactcttgtgaactcaaagagctgggtccagcacatcattgtctaacttcaagggggatacattttaactgatagtttatgaaggtgctcagacttttaacccactgtgtggagttttaatgtctttcttgatatactacaaatgtctcatctaacataggccgcctccgactataagagccagaagccaggaatccttatttttctgtgccatttatttgctgtataactctgagagagttgtttaactccaataagcctaaattttcttttcttttcttttctttttttttgagagagtctcactctgtcgcccaggctggagtgcagtggcgtgatctcggctcactgcagcctctacctcctgggttcaagcaattctcatgcctcagactcctgagtagctggaactacaggtgtgcaccactacgcccagctaagttttgtatttttagtagagacagggtttcatcatgttgcccagactggtcttgaactcctgacacccaagtgatctgcacccccttggcctctcaaagtgctgggattacagatgtgagccaccacacccggctaagcctaaattttctgttagtaatgtggatgtaaacaattttctacctttctggggaggttgttatgggaatcaagtaaagcaatatatgaaagtactttgaagactctaaggtatcatatgagtatgaagtgttatctaagcctcaatttgctccagcctcatatacttcctttattttgttacttgtaaaactacatgaaatagatgtttgctgaaaatacaggcaatatccttttgtgaaatgaccatattttgaaagtaaacttgtggattggttgttttggaactggaaagcaacttccatcagaacaatattacatataaatgtttaggttttagctctgtctacaaagcctgttcaaatacaatatatcttaagagcagtattatcagtcttcccagaggtattcaaatttgacggttagttcccaaagacattccccacctatcagtatatattagatggttttaaattgagtgaattgaattggaaaatgcctgtatttatatgtatataaaggtctttttaaaggaaggattaaatgagtttttgctgaactcatattacccataaagtggttctcagaaataattacaactctgaaattctctctagcttgtcaaatttctatgcatgaacgtcaccattaaaacgtgtattttctgttcttatcacaatttaaaagaagcagattactcactttagtgcaacgagtatggagcacttacgtgtaaagcatgagttagattctgagagtaggtagtatgctgctcattataatttactaaaagaaacaaataaaccaaaccaactaataaaataggaagaaaagtaagcagaactatctcattagactgactcatcatgatttttcttatgagcctggcactttaaaaaaaaagtctattttttgtggttatctaagagcactacctaggttaggagaaaattctgaagaaatcaaactgtttatctgtgtggagctattttagagctgaatattcaatggagaaagcatggactcgaatcaggaaaacctggccctgaatcttgaattcacttcttgctagctgtttgacttctggaaaattagttaccttagttttttcatctgtaaattgataacactggcctcattgtgtgtgcatggataaaatacaaacacataacacgtgattaaaatggttcaccacctttttattctgtcccttcattcatcactaattttgcatgagaaatttagcttataatcactgacggtgttggagttgccaccatgctaggctgtcatacctcaaagccgacattttccagattggccggaacacggtatggattacttgtcctactgcttttgacagttttacatattcctccagtgaaagagttatcaaggacttctcctctgggctctcctgccagaaaatgaaacctagaaacaaagtaattttcaggaattcaacagatgtagaacaatctttaaaatttaccttagttatatgaaaggaattcctcttctaaacctttttgcctcaagacaaatgacttgaaggaatcccccacacctccgcttttttttcctagtccatggtgaggcatgcaaggaagctggaaagcccaaactcagcttctctggctctattaggttctcctattccacttacttaattgttcttggctttcaacatacaacaaaatctggatttataattttttatgacttacaaagccagtgcaaagtttggaagcagattatgaaataagttattatataataaatgctatcccaggtctacttctttctgagtggaattctaatagagagctcataataaaatagtaacagcaatattttaatggaattgtaataatattatagttttactaataactgactataatatttaaaatatattttatttaacaaatgcttatatactatttactataagccaagcaatagtaagtgctttacaaatattaacttggttaagtactttactaataataacttatatttattacaaccatatgatgtagatataattattatacctgttttacaaatgaggacattgaggcacatagagattaattagcttagcataaatcaactatttaagaggttattttgttatagataaaaaaacttctccaagatgctaatgcttttccaaattctaagagatattaatatgtattctgtgaaaaaagtagtttttttgtcaaacagtttggtaatgctgtattacatagattataaaaatcgttttctacaggtcatgtcacagccttaaaaatataaattgtcagtctccaagtacatttgaccaaataaccttgtctttcatagaacatgtagtgtagttctacagaatatcactggaaaattccatgtagcagaaggaatagcaccaatgcccttcccttctcatgacccttcagtacacccatcccttctgatagttgtgggggctcaagggaactctaaacatcctcaagaatgtcattgaccacttacatgtctgtttcccttgtacttctatggcattaactcacaagacaaaatgtacctgaaaggcaccacctttaccagagctgaaatattaagttttgtaactatcacaaagatctgaaaaaaagacaaatagactcattcatttgtgagggaatcaagaagcagttcactatgggaggcttttgcgatctattagacatttggatttaaagcagaaaattcgaccaattactcaggcgcttctaaccaaggggcacaatatttttctatcaaagaggagcaaggatagtttgaaagttgtaaagtgatgttagaatactgaaaagaaagtaaggctaatataaatacttgtaaattctctaccaataaaattgtgttaatgtaaaagtacacagacacacacatacacacacacacacacacacacacacagcttttaagtttctgaaatggtttcttcacttgaaaatggagctaattgcttttttatagtagttgtggaaattaatagtgactagcacaggcctggcctgccctatgaaaggaaacaatacatactatctctcccattttttccaccagggaaagtatattttaattttattaaaaggttgcatactaagttcaaaagtaattgcttgcagaaacaaaatcaacaaacaaaaatcaaatgtatttccctacaaatagcaatgaacaatccaaaaataaaattacagaaacaattccatttataatagcctctcaaagaataaaatcctcaggtatttatttaacaaaagaagtctaagactcatatactgaaaagtataaacaatgttgaaagatattaagtgaaatctcaatgaatagaaagacattccatattagtggattggcagaatttgtgttgttgagatagcagtacttcccaaattgatttatagattcaagacaatcattatcaaaatctcagctgcctttttttggtaaaaattcacaagacaattctaaaattcaaaagacccagaacagccaagagaatcgtgagaaagaaggacaaagttcaaggaattaccttcctgatacacaatttacttcaaaattagggtcatcaagacagtgtagtagtactggcatgaggatagacagacatatagatcaatggaacagaaatgcatctagaaataaacccatacatctatggtcaattgattttcaacaagggtgccaagacagttcaatggggaaaatagtcctaaatgaatggtgctgtaatgacctaatggttatattgcaaatgaatgaaattgggcccctttctcacataatgcaaaaaaattaatcaaaatagataatagaacctaaatttaagagctgaaactatagaacttttagaagacaatataggactaaatatttgtgaactccagtaagacaaagccttcttagatatgacattaaaagcacattcaacaaaagaagaaataaatatattgaactccaccagaattaaaaactttagtgctttaaaggacaccaacaaaaaagtgaaaatacaactcatataatgggagaaaatatttccaagtcacatatctaatgaggaacttacacccagaatatacaaaaaatgcttggaactaaataaaaaaaccaaattactcaattaaaccatgagcaaataatttgagtatctaaatatatagttctttgaaaaaatatgaaaatgactaataagcatgtgaaaaaatgctcaaagttattagtcattaggaaatacaaatcaaacctgcgatgagataccagttcatagccattagaatagctttaaccaaaagatgaacagaaacagttttgatgaaggtgtggagaagttgattttcaatcatatgtaactgggggaaatgaaaaatggtgcagctgttttggaaaatagttgggagttcttcaaaaattaaatgtataattaccataagaccctgcaattccattcctaagtatatatgaaagagaattgaaaatatatatcaatgcaaaaacttgtacatgaatgttcatagcagcattactcatactagtcaaagtaggaacaaaccaaatgttcattagctgatgaatgaatcaacacaatgtgatagaatgatacaatgggttgttattctctcatacaatggaatgaagtattaacatatgctttatatgggtgatttttaatattacatttttaaaaattgtcacataattgtacatatttatggggtacgtagtgatgtttagatacatacaatgtatagtaataaaatcagggtaattagcatattcatcacctcaaacatgttgggaatattcaaaattttctcttctcggtatttgaaaatatgtactaaattattgttaactatagtcacctgcaatgctatagaacactagaacttattcctcttatctagctgtaattttgtaacctttaaccaatctcttcctatcctccccttcccctactctttccagtctcttgtaacccttattctaatctacttgtatgagatcaactttttaagcttctgcatgtgagtgagaacatgtagtatttatgtttttgtttctggcttatttcacttaatatcctccaggatcatccatgtttctccagtgacaaggtttcattctattttatggctgaatagtactccattttgtatatgtaacatgttttctttatccattcatctgttgatggacacttagactgattccatatgttggttattgtgaacagtgctgcaaataaacttagggatgcagatatctgttcagtataccgatttcctttgctttggatgtatgctcagtagtgggattgctggatcatatggcagtgctgtttgtagtttttttgaggaatctccatactggtctccataagagctacattagtttacattctcaccaacagtgtatgagcttccttttctccacatcctttccagcatttgctatttttttgtctttttgataatagtcatttcaactgtagtgagatgatacctcattgtagtttgattttcattttcccgatgattagtgatgttgaacattttaaaatatatttgttgggctccttttggtaaatgtcttattaagttcactggtgaacttaatccgttaaattggattatttatttatttttgaggtgagttgagttccttatatatcctggatattaactccctgtcagatgaatagctggcacatacttttttccactgtgtatgtttatgttgtcttttcactctgttactgttttctgcactgtacaaaaagctttttagtttgatataatcccatttgcttttgttgcttctgcttttgaagtctttttcataaaatgttttctcacatcaatgttctaagggttttcccctacatttttctctaatagtttaatagttctggaattttacatgtaagtctttaagctatttggagttgatttttgtatagcatgagtggtgggggtccagtttcattcttctgcatatggatatccagtttttccagcaccattaattaaagagactcttgtttccccagtgcatgatcttggcacctttgtcaaaaatcagttggttgtaaatacatggttttatttctgggttctgtattcggttccattggtctatgcatctatttttatgccaatagtgtgctgcttgggttaccatagctttgtaacatgtaacacatgtaacatgtatattttgaaatgtagtagtgtgatgcctttggcttttttttttttttttttttgcagagtctctgtgtgttgcccaggctggagtgcagtggcacgacctctgctcactgcaacctccacctcccgggttcaagcgattctcttgcctcagcctcccaagtagctgggactacagatgcccaccaccacgcctggctaatttttgtatttttagtagagatggggtttcactatgttggccagacttgtcttgaactcctgaactcatgatccacccgcctcggcctcccaaagtgctggcacaggcatgagccagcactccaggcctgttctttttgctcaagattgctttggctattaaggttttttgtggttccatatgaattttagagctttgtttctattgctgtaaagcaagtcattcgtgttttaatagggattaccttgaatttgtagattgcttcgggcagttgagtcactttaacaatagtaatattccaatccataaaaacaggatgccttcccatttcttttgtgtcctcttcaagttctttcatcagtgttttatagttttccttgcagagatctttcatctccttggttaaatttattcctaggtatttttttgtagctcttatagttagctctcttgatttcttttccctctagctcgtgataatatatagaaatgctacagatttttgtatattgattgtgtatcctgcaactttactgaattcatttatcatttctagggcctttttttttttggtggagtctttagtgttctcgctataaaagataatgtcatctacaaacagtgacaatttgacttactcctttccagtttggatccatttatttcttttccttgcctaattgctccagcaaggacttacaggactatgctgaataacagtggtaagagcaggtatccttgtcttattccagtccttggaggaaaagttttcaacttttctctacccagtatgatgctagctgtgggtttgccatatacagcctttattgtgttaagtttcttctatttctaatttttgagagtttttatcatgaaaggatgttgaattttatcaaatactttttccacaactattgaggtgatcatatgttttgttctctctgttgatgtgatgacattattgatttgcatattttgaaccatccttgcatctctggattaaatactacttaattatagtagatatctgggatgtactctggggttctgtttgctagtattttgctgaggatttttgcatcagggatattgacctgtagtagatttgttgttgttgttgttgcatctttatctggttttggtatcagtgttatactagtcttgtagaatgagtttggaaaagttccctttcgattttttgggatagcttgataataattggtattagttcttacaaagtttggtagaattcagcagtgaagccatccagtcctgggcttttcttttttgggagactttttgttattgatttaatctcattactcacaattggtctgttttctatttcttcttgattcaatcttggtaagtttttttttgtatccaggaatttatccatttcttttagattttcaaatttgttggcatattgctgtttataatagtctttaatgatcatttgtatttctgtagtaccaattgtgagtattgggatgaatcttaaaaacattatgctaagtgcaaaaaggcagacacaggctgcatattgtagaatttcatttttatgaaatgtctagaatacacaaatttacatgaacagaaagtgaattagtggtttcctagggttaggagtcaggtagaagggggaaagaaatgaagcttgatatctaatatgtacaaaggttttactttgggtatgttgaaaacattctaaaattatatcatggtgatggttatataagtctttgaatacgctgaagatggttgaattagacactttcaatggatgaattgtatggcatgcaaattacatctcaataaggctgttttttaaaatgagtgaattctgtgggttgtctaagatgcatattatattcaaatagctgaaagcataacagcgaggactaaaaaaccattgaccttatactgctttacactatgtacttatgtttgtcacaagcaaaaaagggcttgagaaaaatggctctcaggtcatgaggaatctatgaaggtgacagctatttgtggagaacctgaagataggattttatggaggtatttccagcagaccatgcctgagaaatcttttaggagttaagccagctatgaagaaattttcagtcttattctttccttcctcctctcagatgttgatactgacttaaaataatttagtgtttcacatacagcattgtttctaaagtgctttgatctaatctgatttatgtgtcatactttgtaactttttgaatataactagaaatatataaatcaaaaatatatatttgtgtgtatgcatgtattttcacatatatatgtgtgtgatccctactcacagatctcactattttgccacatagatgaatgtgtcctttcaactgtgtgtgtatctatacacacactaagcctgggtaaaaacaaatagcatgctattattgcctgattcttgcttcatatttagaacctagtgactgatgttggcaatgtagaaatttttatatctcttgttaaaatttttcttggagaaatatcagttaagaaggtcagccactcaggaagctattttttttttttttttttgtggttagaaatatgttggatagcaggattggagaggcagagattctaaggccagcagattagaacaagattacagtaagcaattctcaaaactctcagtctctggggaggcaaggagaggactggttgtcccgagccggcaggctttgctcatttctcagaatcactgggacaacagctctggttggcagagggccacgtcgtccttcagccaaagtacacatagcatgtggtcctccccatctgtaactctagagtctagatcaactgaacaaaaggtgattttgtaatgtcacccttcatcaatcagaacattagaaaatgtgattatcagtgggagtttttggctgacgttttcttgtaggcaaaccaagagaaggaaaccatttctgcacatggataagaatatgttgttgaagcactttcatcgaaatcagcactaattagaaattcttaggacagaacatcacatcagtttatagtcatccaacatatagatgaggaaaccgaggcccagagttgttaaataactcggctgtggtgtagtgagataatgtagaactggttctagttctacattagaaccagctgagttatttagaactcagctcctcttactttcagactaatggtttttccattttactggtgtcctcgggtttggttcaatattttctgggttttattctaaatcaaataaggttgtatttgcaattgtggctgtttgtctttggtgcctcgagttttcatattatgcaactctggcagcattaagtgaagattctaattttctaaagtccaatatgaagcaatagaaattgatagcaaactatctgccttctggccaaaaatttaagaggggtttctttattatgtaaaggggagagtataggagattatctttactgattttttcttatgtttcaaattaaggctcagtttttctgttttcatagccttctcttatatttcctaacatcatctaaaacacaggttcagtctaatgaatttagaacccctggtaaaacccccagtgtgctcatgattgggtattcctgtagtaggaacactagaagaaagagctatgtgatctcctgaggtttcttccagggtgtctcatttgtaaggtagatgtagtcctgaatcagcatgaaatcatggaaaaagcctgggttttgaagtctggatttgaatcctggttccaccatttgctagttggtagacttggtcaggttatgtaagctttctgggactcgtttctcagtttgtaagctgagactggatggtaatataggtctggcttctgccattaggctctgctgacctacccacacgtcacacagcctatgggagagaatacctagctatattcacttcacctcttactctcttacgttttcacacccttgttgcttagccctctctttttttctatatttgcttaacttctttccttttggctttatcgctcattatttgactctgggtttgcttttcatgctggaagactggttttgtttctctagtgttttggctttcaacccacccataggcatacttttatcacaccctctttctccatttgctcctgacatttctgagtggttactcacccattcaaggcctacctccaggaccccaccctggcacctcccagcttgatgggcttagaccagtctgctctaatccattccaaaactttctgagagatgtatgagaaataaaacaagccatgtttatgaagggcccatagcattgcctggcacaaactatatttggaaatgctaacttttacttctcaggagtgaggatcatggccacatacctcctgaacatggtagctaagtatcagagatagggctggtaggagtagtaagaagttaatgaggaagatggacaatgatgtatctcattgctccctctgactcatttgttctgatacctgttctccccaagatgataaaaagatgttacatacccattgcccatcaactgtacactagggatgggattatacttccgtgtgcatactgcctttgtcctcccacagtccctttcatctgaattgtctccacagtcattttctccattgcattctaactttctggcaatgcagcggcctagtcaagaaaagcaaacaaaatcaatgcaacaaattatcattttagaaagtatttattaatttgaaactcaaatgctttaaatttcaaggtaaagttgaaggcaagtcttcactgtttttgatagagttttagggagcacataaaaatggagcgataaactgataaatttccacttgtaagattataagggtcaccacagaattatttagttgctgattgtctttaaaaagagaaataatcctagaatataattcccattacagtgagccgctatagagatcatgttcagtaggagaaaattaacaagaggttcagaattttgttttgatctaggatgggagactcaaggtcactgtttttatttaaaaacctgtaactttatagacacacacacagatgcacagtcacacacaataacatggttggatctctcaaattttatgttgggtgaaaaaagccagacacatgagtcatgtcatgtgattcctttatatgatgtccagggagaaggagggggaattaactagaaaggagaaggagggagctttttgggtttatgggaattttctatatctcgatatagaaatctgtattttctatatcttgacataggattgtttacatgattgcataatttgtgaaagcaaaattgcacacttagaattgcatattttactatatataattagtacagattttattaaatatattaaatatatctactatctattttactatatataattactgtatataattgttttcctgcatataatttgctatatctattttttggacaagttaagtgtctagatactacagtagcaagtagagtgagcaaatttagaaaatggtacaaattccatgtacccaaataattaccttccatttctgacttactgaatttcataaggatccttggaatcagtatataactatatattatagaaattgaaatacttatgtgcaatgacagatatctcctctcctgccttttaccttcttgcctgtagtcaatgatgttggcatctgtaccagtatgtacaggtccaactgacaatgattaaaggttttacttgagattatctggttgattattttaagatgtgattagcatctcactacaattatgcatgactgttttgactaaaattcttgggaaaattgggcattctgttgaattaatttttttaattaatagtgggttcccaagaaagtacttggtttcaacttttttggttaataatcttcacttagaaggtagagtgtaattaaaataattacattttccatcttgcattatgtcaggactattattataaagaattatagctacgagcactataatcacacaggactggaaatgcagattgaattgaatgtctgttcatcccatgacttaacctgaaagatgctctatttttaaacagtgcatttctagtttttttgttttgtgttgttttcaggacagaacagaatgggcattttagtttgaaatagagaggctatttattaaaatatgaatctatacatattacattttttaaaaagttttgaacctagcacttacaaatttaagcaaaggtttatttttgatatggttacactaaaatctcactttgttagacagaaggagggatacacatgtagagtatagttctcattagcttagctttgtgagcagagtaccagatttgtgagaatacaagaaattctatccatttagtacttatagggatatcttagagagtccattagcaagggtagggatgaagggaagaggatacctcttgagggatgtttaggaataggcctgatgtgacatgggtgagaatggttccaggtcataaaaactctatggaatagaaagcataaggggagagatattgtaagccataaatatattctataccaaagaaggaatgagaaattaaaggacagtttgaatattgcaggatttgcagaagtcagcatgcttagccagcacatgcatgtatacatttacacttggaaccatgcaatcatttagaaattgcacgtttttcctatccattggaagcgatttgtgtcactgcaatagtattattttttaaaaccagctgcaaattctctagtcttttatgcttaaaattaggactctgaaagaagagttggtatattgcatgggaattaacataatgggtaactcttaaaaatccacgtatacatcaaaataatccatttagtcttggggactcttgggagactctgaacatcagtcataatggaggaaaggcaagatggtcaatcttttcaggagagatagttctttgttaattgagagccaagtatcatcttgagtcagaaaaacaatcattcataaacctcttactcccattgacagtggcattagtagatgcttttaggagagcaaaacagtataccatcttcaatggaatatttaacaaccaaaaggctatgacatcacccagtccgaatggatgccaactatatctgtgacaaggatttaccaatcagttcctggatcatgaaaagatctagggattttgggctctgggaagcagggcatgggttactcagggagtacggagtagcagccgcttaacaaccattacagacacatcttcataatacagttatttgaaaatcagtggttatggacataactgttgatgaactggcgatcagctgtgcttacactgctaacctttctaaaattgttcattataaattggtgaccaatggatgcatctcaaggcttctcaaactttaagtatttttggcctgaatgcagatcctttgtaatttttcatagatttatcatctactgaataagagtcttttttgcttatatgtagtaaaaaccatctttcaagcttcaaatagttatacttcagttctagagcttgattttgatactctggatataatgatcaggtctgtattaccctcagccattctcattcggattttgctctgattcccttttttgtcaatttgtgacatgaccttattcatatagacacaaaatatatctccctacccacatcctgctctcaaattccaggtttggggtggaggtggataggggaaaaccctgaccccagcattcctgtctgacattcagaaaaagctggcaaagctgagggcaggatgcagggagtaagaggggaaaacttgggttccaaggtcttgggtcaattttctgtggaattggaaatttgctatctagttataaatactttacttttcaggatatctcagagtacacagaaatgatagagatttcattcatctgaaatttaattttattgtaactttaagttgactgtttagataggaggtcaatgaactatggcctgtaggctaaaactgacctgaactatggccaactgtttttgtaaagaaaattttattgaaatatagccatgctcatttgtgtatgtgcttttgacttactcttttggaattaattttagagccagtcaagaaagttttctacatcatctctagtcatcttccaacatgatatcttaatattcttgtcataataaattatattaaaaatcttttaaaatatgtcatttcttttaaaattatcctgattatagatttgtgcagatcaggtaagtggtcaaaatggtataactgaaaagccataattttacagtggaatatcttgggaattggcagcataacattcccattccactctgcttaaaatgtggtgggatttctctgtgatggattctactgttagtcaattggagtaactttgatttagtcaagctatttttagtggggactgaacatttcacaaaaatacattaccactgtcacagcgaaatttattcttgcagtcagcctcttcaattttgcagagcttagatggaatgcatggttgaaaggctaccagaggcgcagtgcatggctgtcccccaaactgactgggacgcaagacagatctaactttagactgaaaggaaagaagagaaagatataactctgaggcagggtcaaggtcaaaatgtacctaagaaaactgggctcctcaatcacaacagtgatttttcctatggtaatatttcttatatttttactaatgattcttccaattccattattatgctcccttagggaaataatcacctctgtggatctctgtttcccaaccagtaaaatgaggaagtgggttaaaaaggtttctaaggcttcttataactctgaaaccatatggtttatacgttttcaaaataaaatatataaatgtttgctgagagtctcttgagtacagtaaattcctccaggccataacagtagcctttctgtatcttaaagatagtgtgaagggataaatgtgaaataattttgaggttcttttgcataagagagtccctgtgaaaaccaatgcgaatgtagtctacactttaaaaagattttaaatggcgagtagtaaaatggtgagtcaagggagaatagaaatatgataggactaaaaagtactgactttgaagtcagaaaattcaatttattaattaatgggtgtattcttgggcaaattacttaaccccaaatgagcaataactttctcatctgtaaaatgggtagagaaacacaatatgatgtgaagtttgaataagatgacacatgaaagggacctagaacagttcccctcagaaagtagctgttccacaaatgagtttctttttcttccctgctgtgtaaatgctcaacacggccctaactgtggttcacattggccgatgcccttacaggaatgagtttgtggtgggtaaatatttcaatggggaacaataaacaaattgagggactgctgtgaggagagggaatgtagaggaagggcaaggagtgaaagttttgattcatttccctcatttctgtctggtttaaaatcttggactgaaaccctgtttttgttgttgttgttgttgttgtttttttttttttttttttttttttttagtacgagttgagcatacctagtttgaaaacctaaaatccaaaatgctccaatatctaaaaatttttgagtaccaacatgatgccacagtggagtattgtatatgtaaatacttatcataaatttgtctcatgaacaaaattatttaaaatattgtataaattatcttcaggctatatgtataaggtatatctgaaacataaatgaatttcatgtttagactgtgtcccatccccaagctactacgttatgtatatgcaaatatttcagaatccacaaaacatccaaaatccaaaacacttctgataccaacattttggataaggattactcaatctgtatacacttttgctttcagaattctcagaaggcacaggcagtggaattcagaactgggtaagtacaatatcaatactgggagcaaaatttcctttttgtgttcttaagacagtaaaatacataaaataaaccccctcttccccccacaaaagtgctaaatggaattttccctcaatggaagctgagacagttgattttcagaaattgaagtaattcagcattactatgctgttaagcctgtcagggaatcagagccctctattgtgattcatatttcctggaaatgcccatggttgcctacctgtttttcaatacaagggtcacagtctgaccatggtccaaaatctcccaggaggcagttgatggggcatctttgccagttacattctctagtctcctgcttgctgcaaatctgttcacaaaagttttcctggtagtacttatctactactatttgtctgtaaccatgaagaagaagttgcttagaatgagtgtattcaccatatatcctgctccataatcaaagtatcattgagcattaactacaataaatagaaaagaaagaaaattttcatggaaaaattaggcaggttggcatatatgcagttctcaccacttaatagaactcaggacatactttgtgaggctcagcataaaatgaaaatgggaaacctcttgctcaaaactaagaacttcaagacagcaaaggcagatcattaagccaagcatgaagcccttctaagtgtggggcctgtgtggctgcacatgttacaccatgaagccagccatgctggagctcctctaatggactggaaggcaaggaaagatgaaaggagagaaagatcctgcaaactgcttggaggaggacaacatagggggctgtgaggctaaagattcaaagagaaagtggcatgagagaaacatcctgaataattcacgtgaattctccaggtaacagagggaagggaatttggaggaagcgacatgtgcaaagatttgaggcagatgagagcatgtccaggtagctctccagggaggagcttgtgtgactggccaggaatatttgctgttctttttaggcagcagggagctactgaaggactcttgaatagaggaatattgtaaacaaatctgttttcacatatatagtagatggtttattggggaagtaaattggtaattttaatgagattcacactacatatgtaaacatagttttctaaaataaggatcctaaaaaattctctaatggttaaaacacattaaatatatgcttttctcccctaacatgtgagcatttccatggtacagaaacatttaacagagttaaagaaactgtgggggacaagaagtctgaattggtgaaaagactgaattattaaatgttatcaagaaagaacagttttgttgccattttgtatatgccaacaatcaagctaatagctagcagttctgctcaattgaggtcctgttagactcgatttaatgagtagaaaattctctataattaactcactaactataggcaagcaaagttgtatgctgattgaaaaaagcttgggtagtgattctaagcaagttaaatattcaactgaaagtgttgcacagattcttaattaaatttctttgaaacccctcgttcttgtagaaagaacaaaagtagacttcctttcaacctcataagagagagacttcaaatttcatccaaatttgtaagttcttactttgatatatatatgttcccattgcttagtgttgcactcctgatgttgctgacttcatccttgagtccttccaggacacaaagaaaagccacaaagctcacacccacctgtgtctgctctgggttccagaattgcaagtttttgagcagctggtccactgagtccatgcatagtgatcacagaagcaggcttggcccttgttgatcagagcattcagcaggatgaagtacaagacagagcgtctggccatgccttgagagcctccaggccctaaaatgaaagaatacataacacatatcaaatgcttttttgaggtaaaccttcacaagtcatcctgagtcagagattcaaatgtgattttagaaaatatttgcatttttctgccttccttaaggcaagtcaacacctacaaattcacatgctcgtgagtacaaatcctatttttaaagatttttagggtggagattaccataggcacaacctccagtactagtaagtttcttcaaacggttagtgataggctacaagacaaagtatgtagcatgtatttgtaatccatttcattccaaaaagtattttagatttatacagtcttacccttctcaaaacacctgctccttttgtgtgagcaatagcctcaagtacatttcagctgttcctacttttctgggactgggaaagaagtttggatcattcttctggaagctctttttcatttcctgacatgctggaaacctgctaaagagaacgttcactgactccatataaagtcagagaaataagagctagtaaggatctttgaaacctccaggtcaaactccttcattttatggagataaaatgaggctcaaggcagtgcaatagtgttgaggctgcaggtcaagtaggagctcacaaaccctggttcttgaatgaggtgaagcccttcactgagtttctaacaatcctaagtactgtgttactgcagtatcaagatgcctggagctccaccactcaggccacaacaggttgagcggaaaaatctttgaccagtggttcccacttatggtcttgaagatccatgagttatttgcaaaaccatacccaccccgttattgccagtttaatcgttatatccctaatgaaacatgcaacattattaatatatgcatacatatcaataattctgctgtaattaatatagtagtaacttttactttaaaaagttaaatgccattcgcctaatttttctgtctcagtttcactatctataaaataagagtaatacctacctcataaagcttttgttaggattcagtaagaaggttcatgtaaactgcttagaacaattattggcatagaatcatcacttaataaatactagcttttcaaattagtaataacttttaagaatgttacaaatttaatagtagctgttggtcacacatttttaatagatatttccaaattgccctgctaaaatatggctctctcatgtcccagaggatgagtttctgattatatttctacgtgattagtttacgtttcttagttttcatgaaaggatacctcagtaaaaataaatggggttcatcatttgataaatcttggtttaagtcaagagcttgagatcagatataaaaattgttttttcagtatgttcagaaactagggtatttcttgttaataaatcagtaagcttttttttttctttttttttttttttttgagatggagtctcactctgtcacccaggctagagtgcagtggtgtgatctcggctcactgcaagctctgcctcccgggttcatgccattctcctgcctcagcctcctgaggaggtgggactacaggtgctcaccaccacatccagctaattttttgaatttttagtagagacggggtttcactgcgttagccagggtggtctcgatctcctgacctcgtgatcagcccacctcggcctcccaaagtgctgggattatcagtaagctttttaaactcttctacaagctcaaagaaaaatgccagaataaaagtaaccaaatccattgacgtatggctgaatatgtctttcaatttaaaatggaatgaacacacatttgggtattcattgtatgctgctaggcattgaatgagacacaaagaaatagaagcctttatcactgtctgggagggtagaaagaaattgaaaatactacctatgctttttacccaagctttttactccaactcatagatatgctgctagagtcctagattatttcagtcataaaaatgaggggcttttgggcattattcaagatggctgaataggaaaagttccagtctacagctcctagtgtgagagacacagaagatgggtgatttctgcatttccaactgaggtactgggttcatctcactggggcttgtcggacagtgggcgcagtccatggagtgtgagctgaagaagggcgggacatcgcctcacctgggatgtgcaaggggtcggggaattccctttcctagccaagggaagccattacagacagtacctggaaaatcgggacactcccaccctaatgaggcacatttccaatggtcttagcaaatggcacaccaggagattatatcccgcacctggctcggagagtcccacacccgcagagcctctctcacagctagcacagcagtctgagatcaaactgcaaggcacagggaggctggcggaggggtgcccgcctttgctgaggcttgagtaggtaaacaaagcagctgggaatctcgaacctggtggagcccaccacagctcaaggaggcctgcctgcctctgtagactccacctctgggggcaggcatagctgaacaaaaggcagcagaaacttctacagacttcaacgtccctgtctgacagccttgaagagagtagtggtctcccagcacggagtttgagatctgagaatggacagactgcctcctcaagtgggtccctgacccccgagtagcctaactgggaaacacctcccagtacgggccgactgacacctcatacagctgggtgcccctctgagacgaagcttccagaggaaggatcaggcagcaacatttgccgttctgcagtgtgggctgttctacagcctccgctggtaatacacaggcaaacagggtcaggagtggacctccagcaaactccaacagacctacacctgagggtcctgactgttagaaggaaaactaacaaacataaaggacatccacaccaaaaccccatctgtacgtcaccatcatcaaagaccaaaggtagataaaaccacaaagatggggagaaaccagagcagaaaagctgaaaattctaaaaatcagagcacctcttctcctccaaaggaacgcagctccttgcatgtaaaggaacaaagctgaacggagaatgactttgaccagctgagagaagaaggcttcagacgattggtaataacagacttctctgagctaaaggaggatgtttgaacccattgcaaagaggctaaaaaccttgaaaaaagattagacaaatggctaactagaataaacagcatagagaagaccttaaatgacctgatggagctgaaaaccatggcacaagaactacatgacgcatgcacaagcttcagtagccaattcaatcacatggaagaaagggtttcagtgattgaagatcaaatgaatgaaatgaagtgagaagagaagtttagagaaaaaagagtaaaaagaaatgaacgaagcctccaagaaatatgggactatgtgaaaagaccaaatctacgtctgattggtgtacctgaaagtgacagggcgagtggaaccgagttggaaaacactctgcaggatattatccaggagaacttccccaacctagaaaggcaggccaacattcaaattcaggaaatgcagagaatgccacaaagatgctccttgagaagagcaactctaagacacataattgtcagatacaccaaagttgaaatgaaggaaaaaatgttaagggcagccagagagaaaggtcgggttacccacaaagggaagcccatcagactaaaagcagttctctcagcagaaactctacaagccagaagagagtaggggccaatatacaacattcttaaagaaaagaattttcaacccagaatttcgtatccagccaaactaagcttcataagtgaaggagaaataaaatactttacagacaaggaaatgctcagagatttttgtcaccaccaggcctgccttacaagagctcctgaaggaagcactaaacatagaaaggaaaaactggtaccagccactgcaaaaacatgccaaattgtaaagaccatcaatgctaggaagaaactgcattaactaatgggaaaaataaccagctaacatcataatgacgggttcaaattcacacataacaatattaaccttaaatgtaaatgggctaaatgccccaattaaaagacatagactggcaaattggataaagagtcaagacccatcagcgtgctgtattcaggagacccatctcatgtgcagagacacacataggctcaaaataaagggatagaggaagatctaccaagcaaatggaaaacaaaaaaaggcaggtgttgcgatcctagtctctgataaaacagactttaaaccaacaaagatcaaaagagacaaagaaggccattacataatggtaaagggatgaattcaaaaagaagagctaactatcctaaatatatacgcacccaatataggagcactcagattcataaagccagtccttagagatctacaaagagacttagactcccacacaataataatgggagattttaaaaccccactgtcaacatgagacagatcaacaagacagaaagttaacaaggatatccaggaattgaactcagctctgcaccaagcggacctaatagacatctccagaactctccaccccaaatcaacagaatatatattcttctcagcaccacttagcacttattccaaaattgaccacagagttggaagtaaagcactcctccgcaaatgtagaacagaaattacaacaaactgtctctcacatcacagtgcaatcaaactagaactcagggttaagaaactcaaaacgctcaactacatggaaactgaacaacctgctcttgaatgactactgggtacataacgaaatgaagccagaaataaagatgttctttgaaaccaatgagaacaaagacataacataccagaatctctgggacacatttaaagcagtgtgtagagggaaatttatagcactaaatgcccacaagagaaagcaggaaagatccaaaattgacaccctaacatcacaattaaaagacctagagaagcaagagcaaacacattcaaaagctagcagaaggcaagaaataactaagatcagagcagaactgaaggacatagaaacacaaaaaacccttcaaaaaataaatgaatccaggagctggttttttgaaaagattgacaaaactgatagaccaccagcaagactaataaagaagaaaagagagaagaatgaaatagacacaataaaaaatgataaaggggatatcaccaccgatcccacagaaatacaaactaccatcagaaaatactataaacacctctacacaaataaactagaaaatctagaagaaatggataaattcctgaacacatacaacctctcaagacaaaaccaggaagaagttgaatccctgaataaaccaataacaggctctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacgaaaaaagagaattttagaccaatatccctgatgaacatcgatgcaaaaatcctcaataaaatactggcaaactgaatccagcagcacatcaaaaagcttatccaccacaatcaggttggcttcacccctgggatgcaagtctgtttaacttacccaaatcaataaatgtaatccatcataaaaacagaaccaacgacaaaaaccacatgattatctcaatagatgcagaaaaggccttcgacaaaattcaacagcacttcatgctaaaaactctcaataaactaggtattgatgggatgtatctcaaaataataagagctatttatgacaaacccacagccagtatcataccgaatgagtaaaaactggaagcattccctttgaaaactggcacaagacaaggattccctctttcaccacccctattcaacatagtgttggaagttctggccagggcaatcaggcaggagaaagaaataaagggtattcaattaggaaaagagggaatgaaattgtccctgtttgcagatgacatgattgtatatttagaaaatctcatcatctcagtccaaaatctccttaagctgataagcaacttcagcaaagtctcaggatacaaaatcaatgtgcaaaaatcacagacattcctatatacccataatagacagagagccaaatcatggtaaactcccattcacaattgcttcaaagagaatgaaatacctaggaatccaacttacaagggatgtgaaggacctcttcaaggagaactacaaaccactgctcaatgaaataaaagaggacacaaacaaatggaagaacattccatgctcatgtgtaggaagaatcaatatcgtgaaaatggccatactgctcaaggtaatttatagattcaatgccatccccatcaagctacaaatgactttcttcacagaattggtaaaaactactttaaggttcatatggtaccaaaaaagagcctgcattgccaagacaatcctaagccaaaagaacaaagctggaggcatcttgctacctgacttcaaactatattacaaggctacagtaaccaaaacagcatggtactggtaccaaaacagagatatagaccaatggaacagaacagagccctcagaaataataccacacgtctacagccatctgatctttgacaaatctgacaaaaacaagcaatggggaaaggattctttatttaataaatggtgttgggaaaactggctagccatatgtagaaagctgaaactggatcccttccttgcaccttatacaaaaattaattcaagatggattaaagacttaaatgctagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgctcagccaaagaaactaccatcagagtgaacaggcaacctacagaatgggagaaaatttttgcaatctacccatccgacaaagggctaatatccagaatctacaaagaactcaaacaaatttacaagaaaaaatcaaacaaccccatcaaaaagtgggcaaaggatatgaacagacccttgacatttgagaaatgtcttctcaaaagaagacatttatgcagccaacagagatatgaaaaaaatgctcatcatcgctggccatcagagaaatgcagatcaaaaccacagtgagataccatctcacaccagttagaatggcgatcattaaaaagtgaggaaacaacaggtgctggagaggatgtggagaaataggaacattttacactgttggtgggactgtaaactagttcaaccattgtggaaggcagtgtggtgattcctccaggatctagaactagaaataccatttgacccagccatcctgttactgggtatctacccaaaggattataaatcatgctgctataaagacacatacatacatatgtttattgtggcactattcacaatagcaaaaacttggaaccaacccaaatgtccatcaatgatagactggattaagaaaatgtggcacatatacaccatggaatactatgtagccataaaaaatgatgagttcatatcctttgtagggacatggatgaagttggaaaccatcattttgagcaaactatcacaaggacagaaaaccaaacactgaatgttctcacttataggtgggaattgaacaatgagaacacttggacacagggtggtgaacatcatacaccggggcctgtagtggggtgggggtaggggagaggcatagcattaggacatatacctaatgctaaatgacgagttaatgggtgcagtacaccaacatggcatatgtatacatatgtaacaaaccttcacgttgtgcacatgtaccctagaacttaaagtataataaaaaaaaatgaggggctttttttcccactccacttgcaagctgattctagttcgtcggtaagtaactcgcctttcctggttttcctcagcaacacagaaccacagggtattgggacaatagtagccagatagaatttaagtcgtgatcagacatataatgtgagtcccaaacatttgggagctgaggctcccaaataatgtgaagctttcctttcaaccactagatagactagagaagccactcccctatacccttcacccttgccccccactgccaaaattggaattttctcatacagggaccttttcagcaagaaaaactaaatagatactttgttgttgtttttttttcttattagatgttggacaagacagatatcttccagaatatttcctcaattgtagagaaaacaaattcttaaagcttctggtgaaattttcatgtaaataatttggagaagttaaattgcaagagattactaattctcagttctcagcagacactgtcttttaacttccaaaagcttgaaaggtatgggtgagttttattccaattatcatcaaaaactgcaaaaacagaacccttataaaatattctgatcgctctttaagctataactgttctgaggcaatatggagcctgatataaattaagatggtaacattaaaacttatttgatgaggtactaatgaaagagctaattggtagcttttcttttttaatattctattattaggaatacaaattgttttatgttaaaacaattttatttttatttatttatttttttgagacagagtttcattctttcacccaggctggactgcagtggcaggatctcagctcactataaactcagcctcctgggttcaagcaattctctgcctcagcctcccgagtagctgggattacaggcccctgccaccacacccagctaatttttgtatttttagtgaactcggggtttcaccattttggtcaggctcgtcttgaactcctgaccttgtgattcacctgcctcggcctcccaaagtgctgggattacaagcgtgagccaccaagcccagcaacaatttttaatcaaataaaaataattacttctctgaatttttttgttatgatggcctagcatattgtattatatggtttcttatttattaatttccacatctctaggcattctggaggtatctaaaattacacacaggcattttacccattactgtacaattttcatacaaacatagaataaaagaatgttcggtcaatagaggaagataggaaaaaagtcttccacttcagtgccatcgtagaaaagcagaaattcttcagttttctcatagttgccatcccctcttgagttttccaaaaatcagtgatcccattgaaccattgatgatagctttatgagcatttagagaatttcaattaaaatgaagcccatcttattctaacctgtcactttctaatgtattttactcacatgaaccatttgtctgcaaggcagttcagcatatcttacccaacagatttctgaggatgctctagtttatccccagctataggttcttcctttacatctccatgtaaacttactgaatttcttatttcttattatttttttctgtgcatgcccagaggctcaagaaatgagcctttctatctttctacctttactatcgccaaggtaagctgggtagtccaggtgcatgactgaccttggctaaagagtatgtttgctttacttttaactaatttaactcatagagaaacttgatctcaaatgtcctctggaatgacatttgtttaaaaaacatgacctctggttcttttcagatttaaacaaagcaattataaaaaagaaagacaaagaaatggttatagtctgagttacatatttttatgcatgaaattgtaattttgttggaaacatgattaacaattttgaaatattaagattgaaaatgaaatcatcatattactcacctttaagcagagtttgtggtgtcctcggacctaagctgcaaattattggggaaaaaataggtatgcagaatgaagagggtatatatgttaatccaaacaaagcttcttttcttattgctagctaacacaaggcaatgctgtcatatcccagaagcctagcaacacctagagggttgtcaaaataaatgttctctggaacttgaactttgcaaatgatt

SEQ ID NO: 2364 - DNA, 119293 bp, Homo sapiens
  source 1..119293: mol_type = genomic DNA
aatatttccttgcataagatgataattaaggatgggactcacccttccgtgttgtattttctccaaaacaattatcaccatcaaacatgctacatattttacctgtttatttcattttttgtgtgtctacccctgaatgaatgtatgcttcatgaaggcaaaggcttttgtctgttttattatctgccgagttctcaggactttggtcagtacttgacatcctgtatacacactcagaaattatttgttgaatgaagatatgaaagctgggcttcaagaatgtgtttcagaggttctggagatttctgtttattaactcattgaagaaaattatgggttttattcttatttctaattgcgagaatgcttaatgtcacaggctacataagggcctcagaagtcacattatttttgtacaatgtgaacaggagaatttacgagactgctgtggaagttggtacctaggggtatgctacagggcgtcatgagctggaactgaataagacatgcccaaacaggagagtcaggggagaataatgatctcaaactaacagaaaataatttttgtcagtaactttgagcatgccagtctgctgtttgtgcaagaattctcatttgtaggagttggttcttcgggatggtaaatctgttcattgtgctgggcctagcagtaattgtgctaggccaaacactttccaggatgcagtatttccatcttcctgtttgcacatcttatagttcccacttcacagatgttcaatgttttctcacttgttgatgatcccattttgacacagtagagttggtttccacccttgaagcactgtgggggcaataggcagacacatttggaagtggaggctgtaatgagagagagagagacagtgtgacttaccacagtacattagggtttggctttatctaaatcatccccagggtggcgagctccttgatggtgttaaattaagtttggtctaaagctttctctaatgaatgagaaagccaaaaaataaaaattaaaaacaaaacaaaacaaaaacaacaaaacaacccaccaaaggcaatgaccccaaagacccaactgtgactgaatagagagatctgtatataagagactagagggcactagtaagccagtaagcttaaagagttggcctatttctggcacttcccccgtctcactgtccacatccaatgaggatttgcactatctctggcacctcccttttactcactgcctacattcaatcaggcactagtcctatcaatccatttctccaatgtcttcagcctgtcctttctgttttattttatttttatttttaacattggcattgcctaactacattcatcgttatcatttgtagagcatgtactgtgaagccacacaatatgccaagcactttacatgctttatttttttgaacccttacagcaaacatatgaataggctatcatactaattctacagaagaggaaactgagctcaaagaatgtaagccctttgcgcattgccacacaattagtaaatggtagaagcaggatttaaataatacatgactcacaggcctgagctctttaacataactccatatcacatttgtttctttctttctagaatattattgggttatgcctggggatctgtatttttagtaggcagttaaattgagtgattctcctatgaggcctgcttttggaatcaccaaagcacttcataattcatttaagtcttatgttcatgaaataggtttaaaacaatcatttagagataaagttaccaaagttgagtatatcaaattaattttgaacaaaggtttataggctcatatattctacatgtatgttttagtcaaaggtcaaagtcttccactgtttggcctcaacttccattttcaacattatcttttttactttctccatttcaagtagtttaactgtctgtttccccaacaagaccccaaaagtgctccagtttttgttctttctcctatgtcatctgcctcttttgccagactgatgtgctctttcctacttctccccatacgtccagtttctacaagtcttgcctcctcaatgaagcatttcatagcaacataaccatattctgatcttttgatcgtttcttttctttttttttgagacagggtcttactgtgtctcccaggctggggtgcaatggcacaatcatggctcactgcaccctcgaactcctaggttcaagagatcctcccaccttagccacccaagtagctgggactacaggtgcacccaaccatgctcacctaatctattactctttgtagagatagggtctcattatgttgcccaggctagtctcaaactcctgagctcaactgatcctcctgccttggtgtcccaaagtgctgggattacaggcgtggaccacaatgtctgaccagattttctcttttttctttttcttaacttttattttagtttcagggatacatgtgttaagtttgttatataggtaaattgaatccataagggtttggtgtacagattatttcatcacccaggtaataagcatagtgcatgatgggtagttttttaatcctctccctactcccactatccaccctcaagtcggccctggtgtctgttatttctttgtgtccgtatgttctcattgtttagctcctgcttacaagtaagaacacgtggtatttggttttctgttcttgtattagtttgcttaggataatggcttccagctccatccatgttgctgcaaaagacatgatctcattgttttttatggctgcatagcattccatggtatatttgtaccacattttctttatgcagtttattgttgatgggtatttaggttgagtctatgcctttgctaatgtaaatggtgctacaataaaatacctgtgtatgtatctctatgatagaatgatttatacccctttgggtatatacccagtaatgggaatgctgggtcaaatggtaattatgttttaagtccttcaaggaattctgttttaagttctttgaggaatcgccacactgctttccacaatggttgaactaaagcagatcttttatttagctaaattttagtggtgtaaacttgtcattttacaaaaactgacatttttgtatacattcttattagttagattttcatatgtcttttccccaagacaatgataagtgcttttttggagagcagtgtggctcatctgtcctatcaactcttaacaaggcgctcaattaattcttctggatcaaccgacttgaaattctgaattgtgcatgcaggtataagtgtacaaaaaagaaatttatttaatggatctggaataattcatgttgccaaaatacctgagtcagcgtgagtattagcaatgaggtcatgaatgaatagcttattttaggcagacatcgattctttcccatgtgtctcaactgatggggaaaaatagggaaaggaagtaggagatactcatatgcaccacatgcctgggcatcttgcccttggtaggaaacattttatggaaaagcatgcatttccgtactatgctctccatcaaccagctagagaagattcttgttcattgttggaaagaatgttcttgtccattgatggaagggatggagtttggtgaaagacaggggactattccacctctggttaggacatcagttccttaggtttttggaagggccatggtcactacccttttagtatggatatagcttaaatgttctttgcttaattattttcagaactaccagcaccaaaagacccttcccaccacctctactaattcatccttcaacactcagttctcacgcttctatacttaagaaacccttccagaccagaagatatttctctctcttaatgctcttatcacatcctgacttgcactaaagtgattcatgtaattattgtctaatgttactcctccaaaaatttgacgggtaaaaagggtgcctcatcttaaaaccatcatcatggctgctaaatggatgttggctgaaaaaatttcccgttcctgtcggttggtggtagatatttctgaaattcagataaaatacttaatatctataaaataggcttctgggggatttcattcatgttgtaacttttgaaaggtgaccttcatattactttgaagttctattttaaagttttttaaaattccattttagatagagaaggaaaagagtagctaagagcacaatgtaatcaagaacacagtttaatcaaagtgacattcaattgaactgaaaattactaatattccaacttcccatgagtggcctgggtataaagtacatttttagctttctctgtcttcataaatgctatcatttgtatattgatacttttctatagtgctaatccaaacagaaccctctgtgacatttacttttgctcaccaattaaagaaagctagcagagaaagatcatatctttagaggaaaaaaatgctttgagtttcctgattgtgtgcagaaccaaaaaatattttaaattgcctaaatatatcttctattaagaagtgttcatgtattagtttgactacccaaagcattctgttaatttcacagtttttagtacttttttttttaaaacaaagttaaacacctcaagtatgtgaggatttagatatgtgtacagcaaagcggtaatagtaaagacaggtatttcgataaaattgtaaactgttatttttcactcaggcagatttgaaaaaaaatttgtgggaagatagcaaaaaaagggaagatagcaaaaaaaaaaattatttccaatagaagagttctctgaagactgcttctctatgataaataaggaagaatggaaggtaacactaaatacagccccaaatgcctgacctatctattacagtacagtcagggaacagttcttaacttccctgctgaccaaattttattttctctatgtatttttgacaataatgttcttatactacatttctcagataaaaagttgatatttaaaataaaaatgatgttgtataatactttcagctcttttctatcacagattattgtttgcaagagacgtcagttgagtaatggtgttgatcaagcatcaaaaaaatgaatagtagagtttttgtctaaaaagttatttaatagtgattagaattaagcaacgtgcatatcaggccctagttttctgtaacttatatggaattgctttgtttagacatggcatgaaggttgaaaaccccagatactggcatcctgagttgtcaccatcagatgccagctatgtccaccctctgtcatgtttcaatcttgtggcctgtcaagggagctgaagcttgataatcaaccttaagtggatcggaaaagaactggttttgagtaataagacctctcccctttccaggactgagctgaagaacactgggccacaaagtcaaaaaagagtcaagaggaacaatatggtttttgtctttctttttgcaaaagtaaggtggtttcagcaaagattcctttgcatactttatgctccaatttaagataatttttttggaaaatgttccacaaaggaaatatctctaactgtttgggttctgttgtaatctccaatccgtcttttgaaaaagaaataaagcttagttgggctatttcagggtcaaacttcatcttggagcaaatgtactgctgtgaagtccctgcctcgaaataattcacaactgtaatgtctatggccagtaaacttagggaaaatggaaatagaatgctactccttaagtattaaattggcagagatacaaaggagtgataactccaaggtttggtgagagtgtgggaaagcagtctttactatatgttctaggaaatataatatggcaaaaacatttctggataggcagccaacatattgtatcaataaaaaaaatttaaaaataatatttacctagaaatgtccctttctaagctatatctgaaggatgtaatcttagctcacagatttatttgtgatagatttaggtatgatggcactatttatgatagcaaaatacaggagaaaaaatttaaatgcctaaccagagattggttaaataaatcatagaatacccgtatagacttttgcagacattgagaattatgtggccgaataatatatgttgacatggaaacagttccatgacatagtaagtgaaaaaacagcaatatatagaataacatgtagagtatgctccgattttatattttaaaaatttgtagtatatacggggccactcctgaaatgttcaagacccaggggccaatttttttatggggtgcttatctataaactattagagtcaccccaaattagagtgtcagcatcatactggctttctaatttcaagcaatcttgagcaagaatgccctgctggctagcagcagcaatttgttcaccaagctgttttctgagaatgagggtctagtctgggccagagatgactccacaggcatgagccccagagctctttggggcatctggctgaccccacgcatggtggggaggagaagcagtagagagctggaaagtataacagtgcctgggttcatgtgggatgctgtctgggctcagggtgtcctgcctgaatagtattgtcagccttggctagactaaggcactgaaagaagactgaaagaaatttcaggaagatgctttggcaatgcaaaatccagtcctacctggacagcactattggcctcagacagtcccaaacactagaaggaaacttagacaattctggtgaaggccctccaaagctgggactcggaaggatgcctgaaacacgagatcgggacaagtgctcttcccactggggcctaagggtggtactgattacatatgcatagagaaaagattggcaagatatacacccacattactacagtagttatttctacttgtgggtgattataattttcctttctgtttaaatcattttatgaattttttttacaatgaaaaggaattatttttgattaaggataggttatttttaagaaagatgatgtactagctgagatgaaggttaagtgagagcatttagtatggtcaccattggaacttacctgaacatttttcccagtcatagcaggtgtcatagccacaggattctttctttgtgctgttggatgaaagtcttgtcctttcaagaccccattctaactggcggccgtcttggcaggaaccaatatgtagaaaatggagttgctgattatttaaacatttctcagccaaaaacttacaagcgggtgaagtaaagtaatcgttggagtctgtgtcaaacacacagagatcttctgaatgatggctgcccaagagaggaaagcaagcatttctatatgaagatcagaaaaaaacagggggcacgtagccaatgtagtgtgttcactcaccaaccagttttcttttgcctgttttccccaccccactccaagccctgggcttgagtgagaggaacaggaaagtgttgatataactgagtttaaagtttttacatgtgcagaagttaagtctttaaaaccaaaatgagactgttataatgaacaatctcattttaaacagggaactgggctgagagataattaagaaacttgctacccaatggggaaggaggaattcagcagagcacaggaatatcagttatgtggaaaattcatttatttcatgtctgtgcttcaaaaagctcagctcttccatcaaattggttacactagactggttttcccaatttccagacacagtctgtagggtatctcttacctacagtcttcttctggagacatacaaatgcattcagatcctgattgtttctgtcccagctgacaatggccttttaattttgttagagtatctgaaacaaaagaaaaaaggagaaaagaacagtgcacagcatggattctaagtgataagcttgaattcagagaagaggcagtggtaaaggattcatatttatctcttggagttagatcattcattttggcttctctaaatacattgtcattaaatattccacctgaaaggtcctttccagtgcacatgaggtgtcattttccaacctaaaattgcgattatgttcagataactaaagaaaatggaactgttgaaatttttgttcatttgtttttcaaatatttattgagtatacatgatattctcatcactctgtaaggttctggagagagtagattgagcataaactgacccagatcctgtgctcaccaagcttatagtcttgtgggtgcagacagacattaatcaaatgagcacactaatataaatatagaattgttgcctttcttagggctatcaaagagaagcatataataaaaaattgatgtagctagaaagattagaaaaagtaaaatgaagaaaggtgaggctgttcaatacagaggaaacataaggtatggaaaagttcaaatgggaggcagtggtcgggcatagtggctcacgcttgtaatcccagcattttgggaggctgaggcaggcagatcacaaggtcaggagttcgagaacagcctggtcaatatggcgaaaccccatctgtactaaaaataccaaaattagcagggcatggtggcatgcacctgtagtcccagctactcaggaggctgaggcaaaagagtcacttgaacccgggaggcagaggttgcagtgagccgagattgtgccactgcacccagcctgggcaacagagtaagactctgtctaaaaaaaaaaaaaaaaggcaggcagcatgtgagtttcctggaactgaaagaacccagtgtggttgaagtgctgaaaaacaagaggatggaacaagatgtggccagagaggtaggtgtctggtaggctgtgtgggaggctaatagggtctttgaagggttttgtcttcattttataaatagtagacagtctctgataggttttaagcagggagtggtgtaacaaaatcagccctcgattttgaaaaaaagaaattaattatggcttctgtgcagagaatggatttgaagaggcatggtggtcaatagggctccagggagctaatctatgaggttattgtggtagttcaggtgaaagaggatgataatttggaccaaggttccagaggtggaaatggagaaaagtggataaacttgagacacagctagcaggtaaaacaagtgatattacctattatgtaagttatgagagctgtcaattatatgattcttcggtttctgatttgcataaaagaatatacattagtgccttacctgaaatagaaaatattagaaaatgcttagttttaggaaggaagggtgatgaattaagagttccctactgtagatgttgaatttatggtatctttaagacatccaaacaacgtagatatataggaatttagatattcatgtctaaatctcagtggcgaagtctgtgctaaagatttaaatctgttatttgtctatgggggaatcactgaagctatgcatgtggatgagattcttcagtaggagagtgcagtgtgaggcgaggggacagatccaaaacttgggaaactccagtgattaatgtccaagcactggcaggagcctaccaaaaatagagggcaacagccagaaatgtcggagctaaacaagaatatgaagccaaggaaagaacatatgtgcagaaggtcaacattgctgaaggctgccgaaaggccacagaagataaggaaaaaaaaaaaaagtccattagatttagcaatatggatgtgaatggcttgaaattcagattttcttacaagaatcagtggagaaatgcagctcctaaatgtagctattaatccctgcatggcattctaggcactaggacattatggtgggaaaaaaaaaagaaaggaaggatggaaggaagaaggtggaggagaggagaggaaaggagaggaaaaaagaaagagaaaacagatgttaatcaagtaattataataacggatttataataaagggctgagacaagtattctgaagaaagggaacatggtttcaggagaccacataccataaagactccaactgggaagattagggaaggattcataaggaaattacacttgaaccaagatgaggaactgaatagcatgtcggtgagggagggggatgaaaatagagggagtgacactgggggtgtatttatgaaagagggaaccttggtttctttgctcatgttgaggcccacctagagaacctggacctgaagccgaactcctcagtctattgaatgaaacacattttcttgatctggatctgactattcaggcatcccaagaaccaaaatgacctcgtgagcaagttaattgtcaaggcaggactggaggctcagctcactcttcctcctcttagcttatcaagtagaaggtttgataaggaaaggtggctcacgtaagaagcaaaaataaagatgtaaaaaattcctaggtttcttattcacagttgttttcctttccttctattaccaccattttatctggtgaaacttggcccggaactctcctgaacttggagacctatccttccggtaaggctttagctactatggtttacaatgtggtgatattgtttacctgtgcctctttgccctttgtaattaggcctgggaggagcagcaaggtatacattgtttccaaaaagaatcaattcagctttcaagtggcacacagccttgctctatcactacaggtttgaaattgtcaatgatcttatgcaaggaatctgctcttccaatcagcctcaggttgaagcagtgctgggactcagctgcccacacctcccagcacaggagcaacaaatactccacagtctgtaaagtgctcagggcaagaggatcctctgaagggctaagggaggtgtccaggtctgggaggaaggaaaaaagtaacggtgtagcatctcacatcttcatgaagcagaactttttcacattgaaagaattaataatgtttccctgcctgaaagtgtctttacctcacagtgtcgggttttatttatgattgtctttctctttctgtgactccccttattggtctttctgtcaatattattggagagaaagtatatgaaataggctatgtatttcctttatctagctgtggaacatttcctatttctcagtttggattataattttaatttctaatctaagggcacgtgtgtgcacatgcatgcatatgcccttatgaggatactgcctacagtgtcttaaagatcctaactttctgaagtctatggcttccacatacattcattccactgacacttacattccttgtaatttattattatgatcaggagtctagtgaaaccaagacacaatacttaaacctgaagttctcactaatttccatgagatcgctttactgataattttatttaaggttattcaaaaggttaactttctccctttctttcacacgttataaaagcccagaagagaataaaggacgcaggatggcaatgagcttagggaattagcagagctattgcatagttccggtttgacccacactgtctaaacttgcatcttttttagcctctcagtgcttaagaaatataatggctatagaggctatactaccaatctcagggtgcaccaccttatcagaccccagaacactgagctgctactcacctttttcacaggtgagagagtttgaaatgggtggtgtccaggaattcccctggcatgtgtaccttgatggcccagcaacaacaaagcctttggggcaagttagctcaatggattcaccaattctatacaatctctgaaatggtgtaattgtcaggacttcctgcacaactggcttgatgcactccgtccctgcaagagagcaacatttcatatgtgtttagtggagcagaataaacaaaaaatttaggcaaattttgtgcaaccaaagaggtgattttgatgagatttactgcatctgttcagctttggtgcctccttttgatcagaaaacctgggggataagaatcctgggctttccctcagacccttcattgaaaaattccctttagtttcattatctgagattcccttgctaaagaactggctccagacacatccaacttttatgaaatcattgggaccttttcctttcaagaaacactttcttttctcttatccctagtggatttctccaaatgcaagttaccacgctatgactgatgcagagtgatgggcattctaattgacactggtctcaactctgcttcatggtctcccacaataagtctttggactctcattcaagccttatttgaatcttgtttttcactttactctagcacagatatgtgcagagcctaaagctcattcactctttctcagtaaagaatgtgaacatgaaccaaggagtagtgtcttggcgaaaactacgtcttacacaaaatcccatcttacacaaattcccatttctgttacataaagagtgtaaatatcatcttcttgagactcagcattttgcgtcaatttgaacattgggcaaagcagatgtctgtggttagatacagcttgcagacttcctggatttcttttgaagtgcatacttcacagtcctatgtgtgtgacagtaataggtaggagcaggaacactgaaatatggagataatctggaaatccagttttagcaaatgagcccttctatttattttctgcttcacaaaatctttcaccagagttactaaaaactagtaaaatgtattgatctaaggatgtgattttactgtttttatattgggcacattcattctgtaaagtagtcaagcaaaattgtttgcccagttctcacgttggcattccacatccccttgtctccaggtcccgtctggtaagcatctgaagtactggtatccaacagtttcaaagccagtaaggcatgaaatttcaacatcttctccaaccaagtatagttgcttttcattcttaattaaagcagaaaccagaaattattaatgctatgaataacactctctaaactctttagtctcacactgatcctttctatccttcacttctggatctactcagtcaccaagtcctctcaatttctacttctaaaaacctgttaaagttctctgcttcctgttgccatcattgtttttcttcatgatatttattctttcttactagggcaactttataactggtcactcttctaatccatctccctaaattggttagggttttgtttgtttgtttttttaacttgaaaacttgctcccctgctgggaatggtggcttgtgactataatcccaacactttgagaggctgaggcacatggatcacttgagttcaggagttcgagaccagctggggcaatatggcaaaacccacaaaatacaaaaatacaaaaaagtagccagacagtattttctgtctccacaaaaatacagaaaagtagcgagaagtggtggcatggcctgtggtcccagctacttgggaggctgaagtgggaggattgcttgagcccagaaggttgaggctgtggtgagccatgattgttccattgtacttcagcgtgggcaacagagtgaaatcctgtctcaaaacaaaaaccaaaaaacaaacaaacaaacaaaaacccaaaacaaaaaaaaaatagaagaaaccaaaaaactatatatgggatgtcctactattgctagaatagaaaaaccatatactcaccatgtagtgactataaactgaataaataatatatcttacatataaagcaaacatatgcagttgctattatgactgagtgcagatcatttaaaaatgttactcaattcctagtaacccattggtcattatatattttcccaattaatggattgtacaactaccttcatgttgctggggggtgggggtgattcactacaattttcaaggtaaagtgggtcttagacttcttagtttggaatatttattttaacttactttaccaccctcacctcctgccatttcctcccataaaacctatgctctagcaaaacaaaaccctgccattcttcgaacataaacttctttttcatgcctccatgtctccacttggttgtttcttgtatcctcaacaccttctctcttcccttctctcaagacccagctcaaatagaacatcctttgcaaaaatctttgatttccctagtatcttgaggtacaacgtcctttcagttctgagggaaactcatgcaaagctctatttttatagtgtttatcacgtttatcagccccacccctgatcctttagtggcaactccacaaccagatctctgtctcataaatctttacacaggccttaattctttgctgaaagaatacaaaacattatccttcttaaggagctagtaatgcaatacaattttcctttactgagaggggcaagagtaccaagaattgactaagcagttgttcttctgagaattgaagttgggaactttgagagcggtgaaagcttaattgtcagcttatgttgttacttggccatatggttaaacttgtctcctagaagattcttaattttctggatacaaaactaccatcctactgttggttattactgatatggctttgtttccaagggaaatggactaatgatttggatgttttcttcaaaggctgcacattttttcttgcatttcttctgaaataaatttttgccttaaacttttgtttctatttcttgtttcttatgaatctgtaacatataagtgtatgttgcaataatcaaacttagggaagtacatctagtagactgactaaacaaaaaaccttgccaaaagtccctgtcacttacagaggttggacttgtctgttactcattaaataaatatacttgtgtgcaataacatcattgctctagcctggaattaggcatatctgcctctatttgaatctatacaaggggcattttgccactagaaattccagaagatgcttattaggaaaaaataaaattttattacatttgagtaaaaactattgccagacagagaccaggcctttagtaaagagcaaaataaaataagaaatgaatttatccatgaaaatgggaatatataatctaaccttacgaaatgagttagaagaataatgcatcactgttgaaagccttcgtgtgttttaaaaatgagaatgtcaataattttaacggtctttgtatgcagccagaacaaatagattaaaagttattttggtatctggatctgccaatatgtgattttaaggataatgttctagggcaggggccagtaagcttttctataagtggcctggatagtcatctgtaggccatatggcatctgttgaaattactcacttctgccattattgtatgaaagtagccatagacgatatgtaaacatatgaatgtggctgtgttccaataaaaataagactttatttttttttaagtggcaggtcaaatttggcctttgggccatagattgatggctcttgttcaagagaatttgttcccaaagtgtggctcctaaaccagcagcatccatattacctaggaatgtattagcaatggatatttctgtgcccttcccaaaaccttctggatcagaaactcgaggagtgagacccaatgatctgtgttttaccaggtcctttggcgcattgttgagtttgagaacctattttctagagtaaagactaattaaaattaccttcctctgaaatatttcctccccataaactttaaggtatggtccttatgcatgggcagaagataagtgaatatggaagatacattagcccagactacactccatgaataaaactatttgctggacttagagaattgagtgttattgatcttttatcataagtgtgatacagttgggaaaagattaatgtaaagatattactaagtttaagaaaggtaaaatgaaataggaagcatgacttctgtgatcacttttagatatcatgtatcacctgtaaaatttatgtcaaagggcatagatctgtctgacaaaatgtattcagcttttaaaaaaatcatagaaacatgttgtggcttggtaaaaaaaaaagttgaaacttaaaggtatgtgaaaatggttttgactgattaagagttctacaggtttctaacctaataaaaacaatacagaattaacacctccatgattatagccagtctagtgtgtttctctaaacattccttaggtaagggtatcagtttgctcagactctgaaatagccagatcttacttgcaaattctcacaagtcatacaatcctatattatactgaagttctattacctttccaagaaacccaagcaatctgctatactttagtctaacaactggctatgaagacatctctaggaaattcaagatggaagagtggcaaagtgtttctaaatattattttgtacttttaaagtcaataggagattattcgaataggaaaacagtaactctaattaaaagacaagctatacttttcgaggtttttaaaactacaaaccaaaagtgaggtttaggatgctgacccggataaatccattttctggaggaactggctgaggacacccggaatctgcttctatctcaggaagatcgacctctttcatttcttcgtcatcattgatacatggttgtccactaaaagggaaacataaatatgtgtgtatatgtatgtatgtacacacatttacatgtgtgtatatgcttatgtgtatacatgtgtacacattgcatacatatatgtattaaatagaaaacattacacacagaaaaaggcacggcagtagacccagtggctcattaatattctgtgttggcataggtaaagttctaattatttctttacttagcagtagactaataaccatttgaactctcaatgttattgagagttagggcaaaatgacccattcttttcccttacccggccttacttgttttccatgattgaaaatgtgcagtcttcctcttgtcgcttctccccctcacagcgtttccctcctcgttggggggcaggattattgcattctcgggttctcgatctcttataagtagcatcacaggtactccaggaagaccaacaaccccactgtccgtctactgcatctggaacaaaggaagactcactcccatggatcatggtgcagctgaatttgggtttggaagtgaggccaacctggtttcctcactttttagctcagtaacttcctttgtgggatatgatagggttcttctaaggattaaaagaaattacctgtgcaaggggcctgacacattgcctgatttccttttagactttgttcccataagcctaaataaaatggcaacaaatggcaatcattatgaattattttcaactgttaagaaacctctgtattcttggctttggaggccttttaaaaatgtgcactcatatgtgtataaatataaacatcttcttaacagaatgcatattaaattacacttttaaaggaagtagtatacattcttactcccatgccttaccctgtttctaaggaggatttgaggtaactatgaacatacttagtcctgtatgaaaactttggttgtggcttaatttattttttattacaaagccatccttctatattacaatacataagaggcttataatatcagaatcatatattttatttgatgttatgtttgattttttatgttatgagcattgtatatgtattcttgatatataaatacgcatataatatattcatattccttagatagatactggtgttatcctcattttatggatgaacagattgaggcatagggaagctgggtaactttcccaagctcacatagttggtaggttacagctgagactcacactttttgcaggtttatcttccctctgagcctgtacaaggtggaggttgctaatagaagttttgtttctttttaattgaccaacttagaatactctttggaggggaaaacttatctacctcacaatagattcctgatacttactggatttataatctggagactgtttctcacagttctcaccataggtgccactctgacacacacacagacattcagtccctgagagggtgggtcggccattattagggcatggagcacactggcaaggatcgaacttggctgcatactcttgcaaagctttcctgaggttgttccgttttgtcactgcacaggggatgtttcttaccaagtccacgatgggggcaagctaggagaaaatgggagagaggaggtccagtcacatcccctttggtaataggttgccattactgcccagttctctgaaatgagagggaaagcctgaaaattttacacttcaaagggattattgcagaatatagtattgcacctgttgaaccagtaggcaaaagccttctacctgtggacaggtgtgatgtatatggcacttaccttccctacaattttactgtgaaggaagcatgggaggtgttgcttacttggttatatatcatgttatttattaagtattctatgcatgcatcaaagcactgagataggtgaccaagagttaggcaactctttcctgctctactgaaacctcattaaatttgattcaagcagcaaaaaatttagagaggataagagaagctttccatgttctttttttccaggacagttttggcttttgttggagttagatgagaaaatgtggagtgggagaaaatgaagaaataaacttgccagtaggatgaatggaagaattacagtaacaaataataggctaatgataaatcagtgctcattttattaacatcataaaacctcaaagaaatgaccttctagtgcaatatgacttgcaagtacccggaggggcagctgggtctcatttttctcccataacatgtagagctcaacacatcttcacgctgcaggcaaatgattctattttcataatgattgaaaccttttatcttcatttaaatgaaatgaacataacagcttctttggaggccttttaaaaatatggatatgtttgggggaaaacaggttctaaatggcatatggctgatacgtgggtaaagtattccataaataataaatatcaccttttaatgtaattacaacaaatacaaaactggtaaattcaatcaatagtaatagaaatggatctaaaatctcatttatctcacagagctacaaatgaagacttaggagtgttcatcaaataaggagttgcaagaagaacacagaaaccagatttattgtatacatgaaaaaataaaaagtactactcaaggaaagtttgagcatttttattcactaagttccatttcctggtgtttcatgcatgctaggaattctaaatactgtactgttgaatgcttgtttgaatagcaaacgcattagacatgcaatttaacatttaaaaaaaggtacattgtgcatgaatactaaagaaaggcatttctttcattgtctgagaagaaaatggaaaataaattgtgtgatgtgcaatttgggctgctagagaactactttagatctcttacctggaataatttttactcttacctcaaagtcaatcacagcaggattttccttcactgattctaaccactcagaaaatgtcttctcctccagaccagagctccctttctcccatgccaaagctgctccatattcactccttccacctcgaatcagggatatggatttctctgctccctgtataaatgaacctgcaaggtgtttcaataaaaatgcccatttaattttagtgcaaattcctattctaaaacaaacaaacaaaaacctatttgtacagaagggagaagtagatggtacagtatgtagctccattaagaaagctaagtgaaaaagcaagagaacactcctcctccctgtagggagtttaataatagaaataataataacagtactaacagctaccatttattaagcatctggtagatgccaggcactttacacacatcttatataattctcatgacaaccctgagaagtaggtattattataaacattgaagccgaaagtaatttgtcctggaacacatggttactaagagacaggactaggatgcaaatatagcccagtccttgactactctgccccttactctttaatgtcaaccgccctgcttctgatttatgttagcatatgttttgggtgcccagaataagataagtcacatggcttctgatagccagtcaattgactgtcatggtgaaacttccaattacagggaaaaaatggtggaatgattttatatttaaagacagaggtgaaagcacaactaacacagaaaaaaacccccatcaggttaagagttggcacaatgtttctttagacacaatgacatttactgttaaagtatatagcacaactcttttatacaaattgccataacaatttccactaaccaaatggtaactctaactaacagggatagagactgagtaataaggaattgccataagaaatagtagcaaataaaaagaaggctagtgatatgagcgatagttagtggcattaatttggtgtctatcagtaagaattagctatgatcccactatttagcaattctatagtaagatagtctagaatgattaggaaatggatgcaactgtcttcctatgaagaaagtagtatggctgcttttagagtcaagtgcataacacaacacaggtataaggcgtaacaaaacaaaggtatacaaggaaaattttagaggtttttgtatttatttttcatggaaaagtagaagccaaattagagtttgccaatatatcatgtacagactgacagtggcttcgtcatgttatttcatatttagattgataccatgtatttcataaatggattgacactggtaagggttatctgtgaggggcatgggatcctgaagaaagagtaagtctgtttactgttccattagcttactctcacaagtgagcaagtgccttaaaaagattccagaaagaaaatgcagattgaagataatgccaataatgcaaacaaaagaaaaaaaaaaactagtaaaagacagaatgaatatttctacttatacaatcttctcagaagccacatcgtaagatgaacaccaaagctgaccaaaagcatgtcaaaaatttcaagaaacttttgtaatatatgtatttatcaatgaactttttttttttttttttttgagatagaggtctcgctctgccgcccaggctggaatgcattggtgcgatcttagctcactgcagcctctgcctcctgggttcaagtgattctcctgcctcagcctcccaagtagatgggattacaggcatgcgtcaccaggcctagctaattttcatatttttagtagagacagggtttcaccacgttggccaggatggtcttggtctcctaatcttgtgatctgcctgccttggcctcccaaagtgctgggattacaggtgtgagccactgcgcccagcctgaactttgtttttaagtgtgtgcagccactactatgaggaagataaaagttctgtttgtttcatatatgctatttaaaaaacaatttccattttttacatttgcatattttaatgcacatttttgaataatacatttctacaattctttagtaaaaatgtataaattagtgatatatcctcaaaaaattttaaaaatgatataattacagatttgagaagtctgaagtccaatgatttaactgaaatagctcagggttagaaataggcaaatctatgttcttgtgtgtgttttgctcttcaatgtgtctgtgactttgactttaggcaaattgtcatcaataatttgttgagaatcttctatatgtcaggcccagataaatataaaatatcgtgttaagaactcagactctcaatgagtatatggaataggtatataaatatgctagcaagactatggagaaataaacaaggatggaaaagaagaaaggaaggaaggtagaaaggggggagggagggagagagggagggaaaatggaagaaaagaaaggaaattaaaaagaccaataaaatagtttttgcttagtattactcaatggtaaaaacaatgaacaattactgagttaggaaaatgaaataattctgtcatctttggcaattaaggaggatggcgctctgaaggaagactgacatgttcctggaaggaaaggtgagacctattagggagatcatggccctaatattagggagacaatggccttctaagcatgggcacaccatgggcaaggacctggagtcagggccgttgtgccatgctctggagacagcacatataggcatgagtttgagttgaaatggaaggtccagggagggggaagaacagcagaaatgagagagtctggatgtaaagccaaggaaattagacttcattcttcaggtttagaaacaattgcattccctagaaacaatgaaaggttttgaggtggggatttaaaatgattcaggaatattagcagtattgtgtcatctgggtagcaatgggtaattgaaaagccagcttggagcctattgcaacggtctctaactttgcaatgtcctcttgttcctacaggctgaaaactggggtccatatgtgatattttctcatgtcaattcctctacattaactcagtttcctaagttgccctgattccagtctagtattttcttatattttaagtaaatttttatactgaagtataatattgacacagaaatgtacataaatcattaagcatacagctcaattaatttgtaaaaagtgagcacacccatataatcactgcccacgcctggaaatagaactctagcaacaccggaaagcctccttcatgcttttatccagtcattattccatccccaaatgcaaacgccaattgtattattattgctatagattagctttgcatatttttaactttatatgtaaggttttaaaacatgtactcttttgtgcctggtttcttttgctcagttttatgtttgtggcattcatctatcttgtttgtagtagtagttaattcatatcataatttgctcattttactcttgatagacatttgagttgtatccaataaatgaacaatgtggcttttcttatttttgatccatgtgtgtgcatatttttgttggcgcatatctattagtagagtttctaagtcataaatatgtgtgcgtgcatttatgtttcactttagtagatattgccaaatagtttccaaaatggtattaccaatttatactcctaccagcaatgtatggcaggttgtgaagttctactgccaatacttgttaatttaaattttttcatcatttgcatgaggtggtattttatggttttaattttatccttttgattcccagttatctttatcatattttcatgtttattgctttttaaaatatgttcttttgtgaagggcttattctatatttttgcttattttacaatttcaactacaattttcctatattatatgtctttactacatgtcacttgtgcaactacaaaataattatagcagacatgtattgaatatttagtatagcctaggctttgtcctcatcaatttatatggattgtttatttaattctcacaataagcataagtaaatactattattatttttattttacttacaagaagaaagattaaactcttgatgttgattacatagccaatcaacagtggagccaacacttgaatataatctagcctgaaaatttaggcgatatgcaatgaacttaatacatcacagcatgaaataatttctataaataacattttactttcctacttggtaatttttactgctttcccactgaatcaatccagtaaagtgttctgctcaatagtaagtctgtgaatttcttggcaaggtattttaggggaaaactgcatagtatatcagcttcttaaaaaactacaatgttctttataattttaaaagctgagaatttctcttaaacactgttacactcaaagtttttcaatttaaagatggaactcccttttcacatgcagcacctattaacattctgtagatgatatgtgggatagtgacaatatttaataggattaagtctaatttttttagtaaggcatacaagccctgttttgtatggactaaacctaccttgtcagctttatttcacaaatttatgctcaagctaaatagaaatactcatttattcatttacacattcattcttttcctctctatgcctctgtgtcctcatctataaaatgggggtaataattgtaccagtctcatggggttgttgtgagaattagaagttaacacacacagaacacttaggacagtgcctggagcatagcaagagttcaataaatgttaattacccattcatttattctttcaagcattcatgtgttcaatgagcacatctattaaacatttataatgtgctaaacatggtatgaagtactgaggacataaagaccatgtcactgtcctgaatttgcatactgtggaggaaatagaaagtaaacataatacagtgtgatgagtgctatgatgttgtgaatgcaggttgcagtgagtacgtctaggagggcacctaaccttaattatgaacaacaatagagatggtaatcaggtaagacttcttggactgtctgctaaaaatttcaattttgaaatttttcaattttgaaattacaatttcaagattttgttacttcaaaatagctattacatctttagcatatttaacacttaagcaatgcagaaaagcacaataattattccccttgttgtttagtcttagttttatacagtaaatgaatccagttctcattgcttcatctttgctcactgtttctttactcctgggctctatatttatctgttggattaatgttttaatattaatttttttatgtgtttttatattttctttatctctattatttctctcataattgaagctgaatcatgggctttctatatatacagcctcaggctggagagagtcaagagagaaaaagagcaaaattttgtctttcgagatctcaagtatacttttataaatctagcaaaaatcatagatttgaaggctagggtttttaatgtcaagggccaggctcttgagagagaaaaagaattcttgagtccttaatgcttgaactaaaatatcaagagccacacattttaggattcagaatcacagaatttacaacatcaaccacagaatgataaaaaatgtatacaacagccattttccttctcaaaagtaggaaagattttgagcagctgggagaatgggggaatattggacatgtggtaactaaaatatagacttgatggattccttagtgcaggcctaagattccaccactttggggaaaatcttggaaataatagtttgacaagtagaagtttgatagaagctcataagaggctctgcaataagttaatggaaaatgtgtattatgaaaaaaatgcatagctttcaaatttttttgcacaaaaataaactcatactaacttatcataacatagctgaataggatcaagcttgaggcacaaagagggataagacatcagtttgaaaagagtccctatcagagcaacttgaaatttgctaaaatagaagtaagaccaaacatcaaatttatggtgaagcttgggaggaagaatggtgaaatcactgatgccttaggaaaagtttatggggacaatacttcaaggcaatcagcagtttacagattcataactcattgtaggaagggaagaaataatgttgaagagaaaactcctagcagtagaccatctacatgaatttgtgaggaaaaaatttaccttattcctgccctaattgaagaagactgatgattaacagtgggaacaagagccaacactgtagaaatcttaattagttcagtttacacaatcataactgaaaaattaaagatgagcaaactttccactcaatagctgccaaaactactgtgtccagatcagctgcagacaagagcagagctttcaataaaaattttaaacatgtaggatcagatcctgaagcacttttaaaaaagaaatgtacacaggagatgaaaaatggatttactagtatggtcctgaagacaaagcactatcaaagtaatggctaccaagaggtggaagtgggccagccaaagcaaaaatggcctagtcaagagcaaaggtcttggaaatggttttgtgggatgctcgaggcattttgcttgttgatttgctggagggtcaaagaataataacatattatgagagtgttttgagacagccaaacttttagcagaaaaatgcccaggaaagctttaccagggacaccttctctactgtgacgatgctcctactcattcctctaatcaaacaagggcaattttttagatgagaaattattagatattcaccttacagtctttctttgactccttctgacttcttttgttttctaatcttaaaaatgtctttaaagggcaccctttttttcagttattaatgtgaagaagattgcattgacacagttaaagtcctaggaccctcagttccttacggatggactaaatggctggcatcattgctaacaaatgtgtcaacttgatgaaacttatgttgataaataaagtttatattttctatttttatcttttacttccagttccctgtgaactttttgaagtcctctcatgtacatttaatcttctcaagtagtaggaagggaatggcaagccttgtagagaatcttttgtatccaacatggcacccaagcaagtagttccttagtagtctcaaggccctcacatttcactgtgatgtacagaaaacaggcaagggttccctaaagcctgaagaaggtgagaaagtcttgagaaagagtggtagacaaaagatggcctggcctttttgtgaggaagattcaaaggatatggatctagtaaccaaaagccaaggcaggaccatcaacattggcaataggtgccagtgcatgattgtgagaaccagaggaggcaaatgacctatcagatgaggctagccaaggcaaagagaaacatgctaacaaaggtctcattctccctgtgactctaggatactatctggccacccttccccaacacatatgcatatgcatatgcatgtgcatgtgtacatacacacatacgcacacacacacaggcacacacacacacgcactcttaaattatccctgacaagcagcaaaggagaaaggtgagggaatcctgagtttgactgaaaattgaaaactgaaacccagaacggctgggttacattacactggcaattttatactttttaccacttagaagaaataggaatttgagagtatatcagttcattctttcattgcaataaagaactacctgagactgggtaatttataaagaaaagaggtttaattgggtcaccgttccacaggctgtacaggaagcctggcaggggaggcctcgggaaacttgcaatcatggcagaaggtgaagaggaaggagtcacgtcctacatgactggagtggtaggaggagggtgaaggggaaagtgctgcatacttttaaacaaccagatctcataagaactcactatcacgagaacagcagggaggaattctgccccaatgatccagtcacctcccaccagacccctcctccaacattggggattacaattctaaatgagatatgggaagggatacaaatccaaaccatatcagaaagctatgttaagttccattaaaatatcctagctttgaacatctgaattattccaattggtttttcattcatgtctttgttgcatagattttatagttgagtagtttttttccagtaggacttaatactgtatttctagaatttgtcttgaagttgcatatttgaacaatatttccctgtatataatcaagaaaaaattcttcctttatttcagagacatattcttatataacattttttaaaaatacagtttttctatttcatttactgagatctctttttcacggatactaattttcacatattaaattacatttgtcattccatttccatcaaattttctttaataatatctaaatgtttttccatgttgagattacttgatatctttcttgtatgtgattaattttattaattttatttttaaagaattatattttgtccttgcattgtataatttatttataattataatgattatgtttctcaatgtttgtttttgtaccttagctttgaaatctgttttaattaattcttgtatttaatctgtctatctctgagttcttgatttattgaactcatattcttattaaattattttactacatgataaactgatatagaatctgtattcatattttggttaatattaccagattatttgctttgcatgctatatgcctttgtgccctctttttcttctttgctataaggagtgtgcagttgtcaagccagttcttctcattttgcttatgcataacacagtcatgtgtatgtagaccatctacctgttctgatatcatatttaaaattatctgtttattattatagtaaatattatattttatttgtttcttgtctgtcttctccatgagaaggtaagcttcaaatttgggaatgtctgtgattctgcttccctttattctaagtagtcaagcaaaataaggaaacagaattttacagagaggaaggagttatttataatggcaaggcataggagagagcatgacttgtttaggaggctgtataaagtttagctgtgcagagaaggacaggaacttatgcttaaggccatgtgaaacctgacatgttctaagtatgaaggtttcatgaataagattttccatagagaagattcctctcaataaaatgtgtagagtagactggaataaaacagactacaagcaggaagaccacttagggggcttctaagataatccaggttggaaatactgaatggaaagtttgccttccattgaaggttttatatccatggaaataaaaagaggaagacaacttgcagagacattcaggaggtagaatgaattgtgcatggttacttattagatatagaaagagggtagaatcaaggacagcagccaggtttctggtttggctgatttagttgacggtgatgccatcatcaaggctgggactgctgaaggagaggaaaggtgaaaggagccaaccactgctggtcactctgcaaggctccttataaacaccatgtcacttagtcttcacaacagtcctactgggctataatgtaaaggctatgctattagatatgagtgagaaccaacagcagcagggagagaatatgtgaagcattgtagcctatagactttccggtagagatgtttagtggacagtagatgtctggagttcagaagggatgtctgggttggggattgggatagaaaagtgaaagcctattgggattggggattgggatagaagagtgaaagcagtggctaaaattgggaaggagtaagatcattctgcaaaacataacttgtatcttcttttttcagtatttttttgcctggattttctttctcactctttccatttgccaaagtcttcagccatttttaatgcatggccccaaaataattcttttcacaaaatctgatgtatttcaatcccaggattttcttctgcccatagtcctttatagccttttagaaactatacctctcttagacccttgtcagtctgtatttttaatggatgtttatatgtttctttactttgtaaggtcctggttcacagccatatgcacttcacaatgcctaatattgagttctgtccatgagcaaaatcaataaattattcattaaacagcctaagtatgagataaagaaaaccttaacaatttccttttttaggtaatgctaatgctattttatttgtatcccctattccaacacacagggttctgaggaagagaaatgaaataaatgaaaagctaaaaatagcacagtcacatccaatatggtctgtaaatgacagccaggctcagggcacactggataagctgctaagagagagtactgttaccttcatgtttctctgacagcttgttggtggtgcacctatgttccacttttgttttcttagcaaataaaacgcgtttctttgtttcaatcctgacacagtgtttggcttcttcctcggttaaacctaggagatgaagtacaaacagaaaccactgagaatgcaccattgacaattcaaagaggaacatggtgctctggtcacttcggatctacagatactttatattagcccctctcttccccagtccccataatcttaagtgacagctcaagttagttttacctatagattcaatcctgcatgggcccagagatgatcctgaacaggagtcccgtgagtgcccatcatctcccctttcagcactgaccctcagaagcacatatgagccattttggcccttcccatggggatggtgatgtcctgtccttgttgcctgccacttgttgccacttaacacaatggagctttaagctctccctttctattggccgctgcactgtgtagccctgcaaatcaaaagattatgacgtgctctgatctgttctctactccaagacctactttccgggccactgctgattctgtgagacctgagtccacttcaattgcttccctgtttgtcacctaaaatgcaaatcttcttggccatgcttcttccgtgaacactcattctcatacctctctgggcttcttctccttaattcacctgctcactcagcccctacctccaaatcctttttattgtaatctcagaaattctgacttcctgacctatgaattattttcagactcctccttggctattctatctcttcatgttaattcaagcctgtacttgatactgtttccactgtcatctccagcagaagttcaaaaggccacattctcaccccattcatgtatgggaattgggaatgatatcttcctagtttctcactgctgctttcattggatgactccccatggtcttataacctgcgaaaaccttgatgctctgaggctcagccatccggttttaatacctttagtcctcattattctcctttatcaaactctctagcatcatttgttgaagatttgggcatctgaaccactcccaccacagtcctgtgatcattctcaatggcctcagaatctgtgtgttagtggaagagtgcagggaaacagatgtagtatttttgtaggctgagttagtactatctggggtaattgagggaaatcaacattttctttttcttaacagcttccccaggcacctgactcactgctggaaacatcaaaactaaaatccagctcttttgatgtttagttaaaatttgccttgcagaatacgagcacatgagaggtagagctgttaatataagctcttaagcacctaaaagcaaagtaggttatcaaatactagtatttggggttgcaggtcataatagcagggatgggtgtttttagagcttgaggttctgattaggtgtgatattgaaatggaaatctgaaggcatagatcgctgagaaatgaggctgggtagatgtgaactgggcctgtctacctcattttttgtgacagttttgaagagatgcattgttatttgggagtaaaaaattcttggtttgaagccctcatgcttagtttgcatattcaaccctaacaaaaagatggttgtttcagtctggttgaataaatataattcatttttcttctagtaggattgtttttataagtgggttagtcaaatatttaggccatactacgaatgtaatgcatttatagtgcatgactccttttcttaaccattctttaggctcttattatttataagtaataattaaattgtatgtgtccagttaattaactataacataatgaattaactataaacttaatttcatttttgagggctatagatgaatcttcaaagatttgaatgatgaatattttttatgacattggtcatgcagtgattaaaatatctggactttatcaatgaatttctgtgcaatccttttcttccctgcagtatgtccagctttttgctgctggacctctatctgtatgaactaacaagctacttgatactgcagtacctcatctcttaaacctcagtgttcctctgctgtggagcacaggaatgagtatttcagtaatgtctttagctaccctgatgcgtaaaagacaggagtgttagttgaaaatttcacattagtaagtagtgtggtgaataatttttaacctccaattcagtgtagaagatgacttcccaataaaaggagtttaaaattatcctcttgcatattaggatatttttattgtttgatgttttcactgtgtttatgaaactcttttcaccttgcacactgaagcaatgccaacttttattcaaggttttaacttgactatgggacattgaacaatagagaaataaatcaatgcatgcaaataaaaggcaatttaattttgttttctttttcttgagggaaagaaagtactatgaaatattcaagtcatttttcaaaaattaacaacaggggatataattcttattgaataaggcatagcaaaaattaaatctatactttagtttcatgttatgatgaggtaaagggagagagaataggaggagagaaaagggaagaggccagaatacatatttatctagagagttgggaaagccaggtaagcacatgaactggagaatttcattttcttgagaagtcatttctgtctgggtgtgcttcattttaacaacaattaaaattttacagataaattattccatataaacttattgaatacaagaatatcgaatacatcttactgagagcttgtttggaggttctagcaggggagtgcagctactcatatacccttgacctaagaccagtcctcctctgttggaggtggtcatcctctttgactgagcatgcagctttggagggacacacataaagtggtgagggaggaaggggacacccatccagccagccagatcagccaaatcaaccctggcgatcaaagaagtgacagatgtcacagctagatcatcctcacatccagaatacatcttactgaatatatatacacacatatatatgcatatatggacacactgtcaatacatgcatacagtgtatgtgtgtgtatgtatgtactgtgtgcatgcatgtatatatggatatgcatgggtatttatttggaatttcctatcacatcccaaactccttttctttccttcattatatgtaactgtcagtctctacctctacagagaaagagatggaatgtgagaaggtttccgtaggaaagtatagctcatcactcttcattttggtgatggggctttaactaatagttgattaaagattcacccagttctcaactgacctgatccctaagcatttaggggctctgctctgaatgcatgaggattatactcatcaagtgggaaattattttctgggctatagcagaagtgaccagaataatttcttctgagggtgagacaaaaccaagtcaagagcagagatttcccctaattacttctgctcagcattagtgttgatactatttgcagtagcagaagacatcaaattcacatgcaagagttactccagtggaaaggataactgaaaggaaacataaagcatgcaggcagtgtggaaagcctacaataacgcaaatcttttgcatttagtttcaggtttcatcaccagtaagtgctcatctggcccactctagcttagtcgcttgtcaagtttttaacttttctttcatcatatgtttcatcttggcttgtagttaaaattattacaggaaaaaattgctatttaattcgttataaggtattgctttatgaaattatatcctataaaaatgttattcataaattatcttttagaatttagtgccagtacaaagttggtttcccttgagatattggcatgcatcttcctctttgggtaaccactactgtgtaagcttatgatgttcccagatgttaggaaatttagagacaaatatgatgcctaaaatcacagtggttaagcatacttatttttctttattttttggtcttagttttctatttttgttttatttatttgaatgtgtattttttatcattcttcatatcattttggaaataaagcaggatctaaataaagtcaaagcagaataattaaaatgatagagtaagagaaaaatgtattgcatgctatcataccagttaaaaagagtgaggactgaagaaagttacctgagttctttagttcctcactgctaaactgatagagaaggtcatacacgcctcccagggagccagaggtgaagtaatgagtcccaaagtcatcgaatattcggctgtacaaagcagagttgtattctagaggcagatggttaagtgctttcaaaaagacatcagaaaggtgcagatctttagctttcgttgtgaagtttaagactttcatcactttatggatcctaataaaactagaatcctaaatggaagaaagaagtaaaaagatgattaaaggtaatgaaagtttgaagtacctagcatttaaatgtcattgatttatcattagtttcattcccaccacagaattacaataattctcactctctattgcatgttctcacgtacaaaattataattttcattttgctttccaataccaatgtccaatgtgcaaaacaggtaagattatctcaataatgtaaactgtgtaatgggggcacgtgttctctaagaaagaagaaatcagtgatcaaaaaagtcatctttctctcctgattgccaatcatggctgcatttctactgagtttttatttagaatatttgctaatgtgaataattgaaaaagaattgtgtgcattttgaactggaagttatgcaactgagatggaggttatgcaagtgagattcaagttacagctttgtcattctggaaaaagcgtttcgattctctagacttcagttgtcaaatgataagatgagggcttgcacctggtaacacttcacatctcctttcaactccaaaatgctgattctaaattacttagtgggtgaaattaagtaaaattatttatattctctctcctccacccatatgcagaaatatatgagtttttttgtttacaaacttatttatttatcatttctttttatgtcaggttaattgagaattagctggtcaatattatgcttaaaatctcatttcctcagattatctttctacatagccactgaggtttataagtgtatttatgtacattgttttaaaaaaaatttatatactttatctgatctctcaattttaacaaattgtagtaatagtaacagagtaaggaccatgttttagcaaaataactgtattataactgttaattattaaccgtattcctctttgctataagtatggcaaaagatgactgctgacacaaaagaaaaaaaataatcccaaggattgaaaaagaatcagcattaatctcccttctgtctttccttttccctgtccctctcttcctttattctaccttctggccttctatacattcattgcctacctatctgagatgctgtagatacagaagtgaagaaggcagacaaagttcgtgcctttgtggaacttccattttagtaagtgctcattaattctatttttaagtttaatacttgaattttgtcagagaaccatagttttcaaaagttggagagcccttgtgcttttaataagaagcacactcactccctgagtatctgaactgccctttctggaaggttcaatatttccaggtttctttaaggtctcagtcgtggaaaatacaagttaaactttggtagctcaacttagcacaataacctccatggtgttctacttgctggttcatgatacctgaaactggctattttagattaaaaaaatacattactataggttattaaaccacatataatctatttcaacaatgtgtgaggtcctgctttattttaataatattattgtggtttccattttgtaaagtatatcaagaaaatactgaacctgactgagttatctggtattttgcttggaaacagactgtttgtccaacaaatgtctagtttgatctgtgaatgacgaaacaactaaagctttatgctctactgaaagacttggattgattttcaattttgtggtatcttgttttctctacttgaagactaagagaggcttcagtagtattttcttttttctttttctttttcttttttttttttttttttttgtgagatggagacagagctagctctgtcacccaggctggagtgcagtggtgccatcttggctcattgcaacctttgcctcctgggttcaagtgattctcctgcctcagcctcccgagtagctgggaccacaagcccccgccaccacgtctggcaaatttttgtatttttagtagatacagggtttcaccatgttggtcaggctggcctcaaactcctgacctcaggtgatctgcctacctcagtcctccaaagttctgggattataggcatgagccaccgcgcccagcctcatttccttagactgaaattccttaattctgttcagaactaatcaaagatgacagtaatgatgttggattgaactatatgaagctaacaattttttgttgttgttgttgctctgtcacccaggctggagtacagtggtgcgatctccgctcactgcaacctccgcctcccgggttcaagtgattctcctgtctcagcctcctgagtagctgggatcacaggcgcacactgccacgcccggctaattttttgtattttagtagagatgaagtttcactgtgtttcccaggctggtcttgaactcctgagctcaggcaatctgcccaccttggccttccaaagtgctaggattacaggcatgagccaccgtccctggtgaggctaacaattttgtaaatcaaaaatggttgaataacagtagtttaatatgttccaacctgatattgtgaatagctctaaattttttaactttgggacagactattaggagatcaaacaatagctgtttatctacatataagggttttacaaacgttctctagcatgtttgaaatacatataaatcacatacgtgaagcaagacataggactgtacctatgtctcatacaaacatgtctatctatctcccttcatcattgactatgtttataagcagttatttccaatcctgcatgctatattatactgagctagggagctaaaaataaaaaaggccatattcccatgcccaatcccaggtattctgaattagtagattaagggaaagtgctagagatgtgtatttttacttacaagaaattctgatactatcttgtcttacaaagataatttgttaagtttggagggctctataggacccacagcccattctaaactaagttatatatatataaaatatatgttatattatatatataaattatatatagttatatataatttatacataaaatgaatctatttcattgtcatttttacatgtctgtgtcaccagaactgtgttctttctgtattttgctaaaattatgaataaataaatgaatgaataaagagtcaaatatcttgaagtgtaatacaatgaataagaaaagtaagcaaaaataagacaaacagatttcagttcccaactctagcatttatttactgtaagatcactggaagtcacttagcttcttggactttagttagtgcctgactcatggtaggtatttgataaatgttcgttgaattaaaaatgcgtatatgaatttcaatctattcatctgcaaaatgatgtttaaatattgactctgataatctcttagaattgttttgaggataaatgaaatacttgggaaaactatccacacagtgctttaggtcttatatttgtataagtgcataaatggttgactaaataaaagtagaagagcaatacgataaaagtaggagcaaccgtaatatggtggcctccagttgctgatctcattaactctgacattggtacctctatttcctccctctctagttccatgattcagggctcattctcctcattcatctcttgggaaagagcaaatgctacttagagtggtggttgtagtgagcaatagacagtattttaaaatatctttgtaaatgtctaaaaatttcagatagaaatgtgtcttctaaatcatttaaacactgtgagacatatctaagagatttaaaatgaaaataataggagaaaaaggaacacatgaagctgtagctttgtatattaaaagggttctctaagtccctggcaagattaacaggaaaagtccaatacttagacataccctaagttccaagtgcaaaaaagaattgtaacttttcaagcagggaaaagaaaatgaaaaaatttgctctgaatatgattgttcttatacagcaatggaaattagaagacaattgaataacatctactatcaagagaagaagattatgatacagtcaggatattctttatatttattgctcagggaaaaggcaggcaatgttagatacaaaagatttagagaatataccttgcatgtgtcctatatgaggaattaaaaaaaaaaaaaggcaactgaatgagaacagggatctcaagaaaaggaatataagaggaaaaaaatggagataggtaaatgtgcgtgtgtttacataaatgtagcaaaatacacattttgttatattttatatatgtatttgtatatgtgtacaaatatatacatctatacaaatatgtatataacatataacaaaaatataaaatacagattgtcatattacatgaaaggtcaaagttctgttgtatggagtttataagaagcacacctacaacaatatgaaaaaaaagtgaagataaaaaacataacaataacagtcaaatgcatgcaaaatggaaccattaatatacataatatttctataacttttgaagtgagatataacaaaaaatggaaaaattacttaaatctgtattagaagtcatactggtacaatatcaaaactctccccttcttattgcatgattactggaattactgttaattttcaagaaagaataaaaggttggaaaccatttttgatacctttttgtgagaggcttgaatggcttgtttgaaggcagaattatggttgatattttcacttctctttgaggaataaaaaattggtacactgaaagagctccccccctgacttgagaatgagccttgttgattttcattgtgtccaagagaagttaaatccttgtagaaatctgttttcaagtcatcttctgcagtttgtacctggagaaaaatccatgtaaaataaaatataatttaggaaatactggagcgacttgtggatatctaatgaaatgatgatttatttatttatgcactcagccagtatttattgaggacacattttgctagagaacaaagaatagtgttatttcctgcactgaggggttaatagtttagttagagagaaagataatcaccaacacttaatgaggtaagtactgtgtgaccagtggaatcccacaggaaatataagaccctgagaggcaatatcaggaaaccctccctcaaggaaatgccacctaagctgagacttaacagggtgataaacaatgaaggttatttttagcatgtctgtgattttgatgcagtgtgcagtctaactaagatacttttcagttctgacaactgggcttgttctttataaccaagtcccaccttgttttatactttttcaagagacgagtctgacttcgggatcacagtttctgaggttgggttcccattgcctgctaccaaagctcccagtgctgatcaactcttgattgacctttgtgttagtcattacgctgtttacaactactctagtctctttctgggcacataaaaagcatgcatttccctactctttttggccaataaaatgtaaatataaatggtatctgtcactttaagagttgatgggcaatatgtcacttccccccgcccctttttttttttttgcaattcatcatcacaccagtcaggatgtgtcaaagcaggatcccttaagtcccttgctttctaagtgactattatcagtagaacgtacagtatgagtggcactgttttaagacactgacatcttagtattgatattgcagtgtaacctaacttgtcttgattaaaatgctgagtctggtgtctgtattccatcatctgtcctgtagttattctaaggtcttctaactccctgcccagttgccttctcttcctttcatgagtctctttaatctttgtataccagccagccaattatttcatctatcttcataagctacaatactacaaaagaagggaagtgagatgcctgctgaatttctcctcctctattgttttcaataaggtatagcttaggtttgcatagctgcctgctaaaagcatgcctaaagaatgaagttatacagagatcagttaaaagaaaaccaatagcttgtgaccttgactctagtcattcccaaatttttgtttgaagaaataccactatgaccttcttcagccatatcactatgacttcagccataccactatggcagagttaaagattagctcaggtagcttcataaggttggacaagtcttagagctacattgataaggaaatgagtttaatctgctgtaaaagaattttcaggctgtatttcctcatgtaacttgttatccaggcttgtgttatcaagctttgtgggttaacccagtgatctgttagtaaatgtttaacaactagctctctgggaaggggaagaaagccctgatttgctatagcatttttcttttccattgtgcatatattcctaccatggctgatttcaagctacctatgtgatgccctgaattcatattgggaagagatgcacagtggcaaattacaaagtattttcataatacagatccaatagatgtaaataaccccaatagcatggataatggtaaaatgtagccaaataattgaaaagtgatcaattttgagcaattataacctttgtttttaatgtgtttacctgtgagataatatatttgatatttaataatggctgtgttttgaccaacaaatatatgaaaaaatgctcatcatcaataatcatcagagaaatgcaaatcaaagccacagtgagatgccatctcacacaagtcaggatgactagtattaaaaagtcaaaaaaacaacagatgttggcaaggctgtggagaaaaggaatgctaatacactgttggtgagaatgtaaattagttcagccactgtggaaagcagtttggatatttctcaaagaacttaaaacagaaccaccatttgacccagcaatctcattcctgggtacatatccaaaagaaaacaaattgttctaccaaaaagacacatgcacttgcatgtttatcgcagtactattcacaatagcaaaggcatagaattaacctaggtgccaatcagcagtggattggataaagataatgtggtacatatgtgccatggaatactagcagccataaaaagaatgaaatcatgtcctttgcagcaacatggatacagctggagaccattatcctaagcaaattaacacaggaacagaaaaacaaatactacatgttttcacttataagtgagagctaaacatcgggcactcatggacataaagatggcaacaacagacactggggtctactagggggggaagggagggaggggcaagagtcgaaaaactgttgggtactctgctcagtacctgggtaaagggatcatttgtacccccaacctcagcatcacacaataaagccaggtgacaaactcgcatatgtattccctgaatctaaaatgaaagttgaaaaagaaaaaaaaaaatctatgtttcacaattggattccaaaattcctgaaaagttaacagttgactcttgtgaactcaaagagctgggtccagcacatcattgtctaacttcaagggggatacattttaactgatagtttatgaaggtgctcagacttttaacccactgtgtggagttttaatgtctttcttgatatactacaaatgtctcatctaacataggccgcctccgactataagagccagaagccaggaatccttatttttctgtgccatttatttgctgtataactctgagagagttgtttaactccaataagcctaaattttcttttcttttcttttctttttttttgagagagtctcactctgtcgcccaggctggagtgcagtggcgtgatctcggctcactgcagcctctacctcctgggttcaagcaattctcatgcctcagactcctgagtagctggaactacaggtgtgcaccactacgcccagctaagttttgtatttttagtagagacagggtttcatcatgttgcccagactggtcttgaactcctgacacccaagtgatctgcacccccttggcctctcaaagtgctgggattacagatgtgagccaccacacccggctaagcctaaattttctgttagtaatgtggatgtaaacaattttctacctttctggggaggttgttatgggaatcaagtaaagcaatatatgaaagtactttgaagactctaaggtatcatatgagtatgaagtgttatctaagcctcaatttgctccagcctcatatacttcctttattttgttacttgtaaaactacatgaaatagatgtttgctgaaaatacaggcaatatccttttgtgaaatgaccatattttgaaagtaaacttgtggattggttgttttggaactggaaagcaacttccatcagaacaatattacatataaatgtttaggttttagctctgtctacaaagcctgttcaaatacaatatatcttaagagcagtattatcagtcttcccagaggtattcaaatttgacggttagttcccaaagacattccccacctatcagtatatattagatggttttaaattgagtgaattgaattggaaaatgcctgtatttatatgtatataaaggtctttttaaaggaaggattaaatgagtttttgctgaactcatattacccataaagtggttctcagaaataattacaactctgaaattctctctagcttgtcaaatttctatgcatgaacgtcaccattaaaacgtgtattttctgttcttatcacaatttaaaagaagcagattactcactttagtgcaacgagtatggagcacttacgtgtaaagcatgagttagattctgagagtaggtagtatgctgctcattataatttactaaaagaaacaaataaaccaaaccaactaataaaataggaagaaaagtaagcagaactatctcattagactgactcatcatgatttttcttatgagcctggcactttaaaaaaaaagtctattttttgtggttatctaagagcactacctaggttaggagaaaattctgaagaaatcaaactgtttatctgtgtggagctattttagagctgaatattcaatggagaaagcatggactcgaatcaggaaaacctggccctgaatcttgaattcacttcttgctagctgtttgacttctggaaaattagttaccttagttttttcatctgtaaattgataacactggcctcattgtgtgtgcatggataaaatacaaacacataacacgtgattaaaatggttcaccacctttttattctgtcccttcattcatcactaattttgcatgagaaatttagcttataatcactgacggtgttggagttgccaccatgctaggctgtcatacctcaaagccgacattttccagattggccggaacacggtatggattacttgtcctactgcttttgacagttttacatattcctccagtgaaagagttatcaaggacttctcctctgggctctcctgccagaaaatgaaacctagaaacaaagtaattttcaggaattcaacagatgtagaacaatctttaaaatttaccttagttatatgaaaggaattcctcttctaaacctttttgcctcaagacaaatgacttgaaggaatcccccacacctccgcttttttttcctagtccatggtgaggcatgcaaggaagctggaaagcccaaactcagcttctctggctctattaggttctcctattccacttacttaattgttcttggctttcaacatacaacaaaatctggatttataattttttatgacttacaaagccagtgcaaagtttggaagcagattatgaaataagttattatataataaatgctatcccaggtctacttctttctgagtggaattctaatagagagctcataataaaatagtaacagcaatattttaatggaattgtaataatattatagttttactaataactgactataatatttaaaatatattttatttaacaaatgcttatatactatttactataagccaagcaatagtaagtgctttacaaatattaacttggttaagtactttactaataataacttatatttattacaaccatatgatgtagatataattattatacctgttttacaaatgaggacattgaggcacatagagattaattagcttagcataaatcaactatttaagaggttattttgttatagataaaaaaacttctccaagatgctaatgcttttccaaattctaagagatattaatatgtattctgtgaaaaaagtagtttttttgtcaaacagtttggtaatgctgtattacatagattataaaaatcgttttctacaggtcatgtcacagccttaaaaatataaattgtcagtctccaagtacatttgaccaaataaccttgtctttcatagaacatgtagtgtagttctacagaatatcactggaaaattccatgtagcagaaggaatagcaccaatgcccttcccttctcatgacccttcagtacacccatcccttctgatagttgtgggggctcaagggaactctaaacatcctcaagaatgtcattgaccacttacatgtctgtttcccttgtacttctatggcattaactcacaagacaaaatgtacctgaaaggcaccacctttaccagagctgaaatattaagttttgtaactatcacaaagatctgaaaaaaagacaaatagactcattcatttgtgagggaatcaagaagcagttcactatgggaggcttttgcgatctattagacatttggatttaaagcagaaaattcgaccaattactcaggcgcttctaaccaaggggcacaatatttttctatcaaagaggagcaaggatagtttgaaagttgtaaagtgatgttagaatactgaaaagaaagtaaggctaatataaatacttgtaaattctctaccaataaaattgtgttaatgtaaaagtacacagacacacacatacacacacacacacacacacacacacagcttttaagtttctgaaatggtttcttcacttgaaaatggagctaattgcttttttatagtagttgtggaaattaatagtgactagcacaggcctggcctgccctatgaaaggaaacaatacatactatctctcccattttttccaccagggaaagtatattttaattttattaaaaggttgcatactaagttcaaaagtaattgcttgcagaaacaaaatcaacaaacaaaaatcaaatgtatttccctacaaatagcaatgaacaatccaaaaataaaattacagaaacaattccatttataatagcctctcaaagaataaaatcctcaggtatttatttaacaaaagaagtctaagactcatatactgaaaagtataaacaatgttgaaagatattaagtgaaatctcaatgaatagaaagacattccatattagtggattggcagaatttgtgttgttgagatagcagtacttcccaaattgatttatagattcaagacaatcattatcaaaatctcagctgcctttttttggtaaaaattcacaagacaattctaaaattcaaaagacccagaacagccaagagaatcgtgagaaagaaggacaaagttcaaggaattaccttcctgatacacaatttacttcaaaattagggtcatcaagacagtgtagtagtactggcatgaggatagacagacatatagatcaatggaacagaaatgcatctagaaataaacccatacatctatggtcaattgattttcaacaagggtgccaagacagttcaatggggaaaatagtcctaaatgaatggtgctgtaatgacctaatggttatattgcaaatgaatgaaattgggcccctttctcacataatgcaaaaaaattaatcaaaatagataatagaacctaaatttaagagctgaaactatagaacttttagaagacaatataggactaaatatttgtgaactccagtaagacaaagccttcttagatatgacattaaaagcacattcaacaaaagaagaaataaatatattgaactccaccagaattaaaaactttagtgctttaaaggacaccaacaaaaaagtgaaaatacaactcatataatgggagaaaatatttccaagtcacatatctaatgaggaacttacacccagaatatacaaaaaatgcttggaactaaataaaaaaaccaaattactcaattaaaccatgagcaaataatttgagtatctaaatatatagttctttgaaaaaatatgaaaatgactaataagcatgtgaaaaaatgctcaaagttattagtcattaggaaatacaaatcaaacctgcgatgagataccagttcatagccattagaatagctttaaccaaaagatgaacagaaacagttttgatgaaggtgtggagaagttgattttcaatcatatgtaactgggggaaatgaaaaatggtgcagctgttttggaaaatagttgggagttcttcaaaaattaaatgtataattaccataagaccctgcaattccattcctaagtatatatgaaagagaattgaaaatatatatcaatgcaaaaacttgtacatgaatgttcatagcagcattactcatactagtcaaagtaggaacaaaccaaatgttcattagctgatgaatgaatcaacacaatgtgatagaatgatacaatgggttgttattctctcatacaatggaatgaagtattaacatatgctttatatgggtgatttttaatattacatttttaaaaattgtcacataattgtacatatttatggggtacgtagtgatgtttagatacatacaatgtatagtaataaaatcagggtaattagcatattcatcacctcaaacatgttgggaatattcaaaattttctcttctcggtatttgaaaatatgtactaaattattgttaactatagtcacctgcaatgctatagaacactagaacttattcctcttatctagctgtaattttgtaacctttaaccaatctcttcctatcctccccttcccctactctttccagtctcttgtaacccttattctaatctacttgtatgagatcaactttttaagcttctgcatgtgagtgagaacatgtagtatttatgtttttgtttctggcttatttcacttaatatcctccaggatcatccatgtttctccagtgacaaggtttcattctattttatggctgaatagtactccattttgtatatgtaacatgttttctttatccattcatctgttgatggacacttagactgattccatatgttggttattgtgaacagtgctgcaaataaacttagggatgcagatatctgttcagtataccgatttcctttgctttggatgtatgctcagtagtgggattgctggatcatatggcagtgctgtttgtagtttttttgaggaatctccatactggtctccataagagctacattagtttacattctcaccaacagtgtatgagcttccttttctccacatcctttccagcatttgctatttttttgtctttttgataatagtcatttcaactgtagtgagatgatacctcattgtagtttgattttcattttcccgatgattagtgatgttgaacattttaaaatatatttgttgggctccttttggtaaatgtcttattaagttcactggtgaacttaatccgttaaattggattatttatttatttttgaggtgagttgagttccttatatatcctggatattaactccctgtcagatgaatagctggcacatacttttttccactgtgtatgtttatgttgtcttttcactctgttactgttttctgcactgtacaaaaagctttttagtttgatataatcccatttgcttttgttgcttctgcttttgaagtctttttcataaaatgttttctcacatcaatgttctaagggttttcccctacatttttctctaatagtttaatagttctggaattttacatgtaagtctttaagctatttggagttgatttttgtatagcatgagtggtgggggtccagtttcattcttctgcatatggatatccagtttttccagcaccattaattaaagagactcttgtttccccagtgcatgatcttggcacctttgtcaaaaatcagttggttgtaaatacatggttttatttctgggttctgtattcggttccattggtctatgcatctatttttatgccaatagtgtgctgcttgggttaccatagctttgtaacatgtaacacatgtaacatgtatattttgaaatgtagtagtgtgatgcctttggcttttttttttttttttttttgcagagtctctgtgtgttgcccaggctggagtgcagtggcacgacctctgctcactgcaacctccacctcccgggttcaagcgattctcttgcctcagcctcccaagtagctgggactacagatgcccaccaccacgcctggctaatttttgtatttttagtagagatggggtttcactatgttggccagacttgtcttgaactcctgaactcatgatccacccgcctcggcctcccaaagtgctggcacaggcatgagccagcactccaggcctgttctttttgctcaagattgctttggctattaaggttttttgtggttccatatgaattttagagctttgtttctattgctgtaaagcaagtcattcgtgttttaatagggattaccttgaatttgtagattgcttcgggcagttgagtcactttaacaatagtaatattccaatccataaaaacaggatgccttcccatttcttttgtgtcctcttcaagttctttcatcagtgttttatagttttccttgcagagatctttcatctccttggttaaatttattcctaggtatttttttgtagctcttatagttagctctcttgatttcttttccctctagctcgtgataatatatagaaatgctacagatttttgtatattgattgtgtatcctgcaactttactgaattcatttatcatttctagggcctttttttttttggtggagtctttagtgttctcgctataaaagataatgtcatctacaaacagtgacaatttgacttactcctttccagtttggatccatttatttcttttccttgcctaattgctccagcaaggacttacaggactatgctgaataacagtggtaagagcaggtatccttgtcttattccagtccttggaggaaaagttttcaacttttctctacccagtatgatgctagctgtgggtttgccatatacagcctttattgtgttaagtttcttctatttctaatttttgagagtttttatcatgaaaggatgttgaattttatcaaatactttttccacaactattgaggtgatcatatgttttgttctctctgttgatgtgatgacattattgatttgcatattttgaaccatccttgcatctctggattaaatactacttaattatagtagatatctgggatgtactctggggttctgtttgctagtattttgctgaggatttttgcatcagggatattgacctgtagtagatttgttgttgttgttgttgcatctttatctggttttggtatcagtgttatactagtcttgtagaatgagtttggaaaagttccctttcgattttttgggatagcttgataataattggtattagttcttacaaagtttggtagaattcagcagtgaagccatccagtcctgggcttttcttttttgggagactttttgttattgatttaatctcattactcacaattggtctgttttctatttcttcttgattcaatcttggtaagtttttttttgtatccaggaatttatccatttcttttagattttcaaatttgttggcatattgctgtttataatagtctttaatgatcatttgtatttctgtagtaccaattgtgagtattgggatgaatcttaaaaacattatgctaagtgcaaaaaggcagacacaggctgcatattgtagaatttcatttttatgaaatgtctagaatacacaaatttacatgaacagaaagtgaattagtggtttcctagggttaggagtcaggtagaagggggaaagaaatgaagcttgatatctaatatgtacaaaggttttactttgggtatgttgaaaacattctaaaattatatcatggtgatggttatataagtctttgaatacgctgaagatggttgaattagacactttcaatggatgaattgtatggcatgcaaattacatctcaataaggctgttttttaaaatgagtgaattctgtgggttgtctaagatgcatattatattcaaatagctgaaagcataacagcgaggactaaaaaaccattgaccttatactgctttacactatgtacttatgtttgtcacaagcaaaaaagggcttgagaaaaatggctctcaggtcatgaggaatctatgaaggtgacagctatttgtggagaacctgaagataggattttatggaggtatttccagcagaccatgcctgagaaatcttttaggagttaagccagctatgaagaaattttcagtcttattctttccttcctcctctcagatgttgatactgacttaaaataatttagtgtttcacatacagcattgtttctaaagtgctttgatctaatctgatttatgtgtcatactttgtaactttttgaatataactagaaatatataaatcaaaaatatatatttgtgtgtatgcatgtattttcacatatatatgtgtgtgatccctactcacagatctcactattttgccacatagatgaatgtgtcctttcaactgtgtgtgtatctatacacacactaagcctgggtaaaaacaaatagcatgctattattgcctgattcttgcttcatatttagaacctagtgactgatgttggcaatgtagaaatttttatatctcttgttaaaatttttcttggagaaatatcagttaagaaggtcagccactcaggaagctattttttttttttttttttgtggttagaaatatgttggatagcaggattggagaggcagagattctaaggccagcagattagaacaagattacagtaagcaattctcaaaactctcagtctctggggaggcaaggagaggactggttgtcccgagccggcaggctttgctcatttctcagaatcactgggacaacagctctggttggcagagggccacgtcgtccttcagccaaagtacacatagcatgtggtcctccccatctgtaactctagagtctagatcaactgaacaaaaggtgattttgtaatgtcacccttcatcaatcagaacattagaaaatgtgattatcagtgggagtttttggctgacgttttcttgtaggcaaaccaagagaaggaaaccatttctgcacatggataagaatatgttgttgaagcactttcatcgaaatcagcactaattagaaattcttaggacagaacatcacatcagtttatagtcatccaacatatagatgaggaaaccgaggcccagagttgttaaataactcggctgtggtgtagtgagataatgtagaactggttctagttctacattagaaccagctgagttatttagaactcagctcctcttactttcagactaatggtttttccattttactggtgtcctcgggtttggttcaatattttctgggttttattctaaatcaaataaggttgtatttgcaattgtggctgtttgtctttggtgcctcgagttttcatattatgcaactctggcagcattaagtgaagattctaattttctaaagtccaatatgaagcaatagaaattgatagcaaactatctgccttctggccaaaaatttaagaggggtttctttattatgtaaaggggagagtataggagattatctttactgattttttcttatgtttcaaattaaggctcagtttttctgttttcatagccttctcttatatttcctaacatcatctaaaacacaggttcagtctaatgaatttagaacccctggtaaaacccccagtgtgctcatgattgggtattcctgtagtaggaacactagaagaaagagctatgtgatctcctgaggtttcttccagggtgtctcatttgtaaggtagatgtagtcctgaatcagcatgaaatcatggaaaaagcctgggttttgaagtctggatttgaatcctggttccaccatttgctagttggtagacttggtcaggttatgtaagctttctgggactcgtttctcagtttgtaagctgagactggatggtaatataggtctggcttctgccattaggctctgctgacctacccacacgtcacacagcctatgggagagaatacctagctatattcacttcacctcttactctcttacgttttcacacccttgttgcttagccctctctttttttctatatttgcttaacttctttccttttggctttatcgctcattatttgactctgggtttgcttttcatgctggaagactggttttgtttctctagtgttttggctttcaacccacccataggcatacttttatcacaccctctttctccatttgctcctgacatttctgagtggttactcacccattcaaggcctacctccaggaccccaccctggcacctcccagcttgatgggcttagaccagtctgctctaatccattccaaaactttctgagagatgtatgagaaataaaacaagccatgtttatgaagggcccatagcattgcctggcacaaactatatttggaaatgctaacttttacttctcaggagtgaggatcatggccacatacctcctgaacatggtagctaagtatcagagatagggctggtaggagtagtaagaagttaatgaggaagatggacaatgatgtatctcattgctccctctgactcatttgttctgatacctgttctccccaagatgataaaaagatgttacatacccattgcccatcaactgtacactagggatgggattatacttccgtgtgcatactgcctttgtcctcccacagtccctttcatctgaattgtctccacagtcattttctccattgcattctaactttctggcaatgcagcggcctagtcaagaaaagcaaacaaaatcaatgcaacaaattatcattttagaaagtatttattaatttgaaactcaaatgctttaaatttcaaggtaaagttgaaggcaagtcttcactgtttttgatagagttttagggagcacataaaaatggagcgataaactgataaatttccacttgtaagattataagggtcaccacagaattatttagttgctgattgtctttaaaaagagaaataatcctagaatataattcccattacagtgagccgctatagagatcatgttcagtaggagaaaattaacaagaggttcagaattttgttttgatctaggatgggagactcaaggtcactgtttttatttaaaaacctgtaactttatagacacacacacagatgcacagtcacacacaataacatggttggatctctcaaattttatgttgggtgaaaaaagccagacacatgagtcatgtcatgtgattcctttatatgatgtccagggagaaggagggggaattaactagaaaggagaaggagggagctttttgggtttatgggaattttctatatctcgatatagaaatctgtattttctatatcttgacataggattgtttacatgattgcataatttgtgaaagcaaaattgcacacttagaattgcatattttactatatataattagtacagattttattaaatatattaaatatatctactatctattttactatatataattactgtatataattgttttcctgcatataatttgctatatctattttttggacaagttaagtgtctagatactacagtagcaagtagagtgagcaaatttagaaaatggtacaaattccatgtacccaaataattaccttccatttctgacttactgaatttcataaggatccttggaatcagtatataactatatattatagaaattgaaatacttatgtgcaatgacagatatctcctctcctgccttttaccttcttgcctgtagtcaatgatgttggcatctgtaccagtatgtacaggtccaactgacaatgattaaaggttttacttgagattatctggttgattattttaagatgtgattagcatctcactacaattatgcatgactgttttgactaaaattcttgggaaaattgggcattctgttgaattaatttttttaattaatagtgggttcccaagaaagtacttggtttcaacttttttggttaataatcttcacttagaaggtagagtgtaattaaaataattacattttccatcttgcattatgtcaggactattattataaagaattatagctacgagcactataatcacacaggactggaaatgcagattgaattgaatgtctgttcatcccatgacttaacctgaaagatgctctatttttaaacagtgcatttctagtttttttgttttgtgttgttttcaggacagaacagaatgggcattttagtttgaaatagagaggctatttattaaaatatgaatctatacatattacattttttaaaaagttttgaacctagcacttacaaatttaagcaaaggtttatttttgatatggttacactaaaatctcactttgttagacagaaggagggatacacatgtagagtatagttctcattagcttagctttgtgagcagagtaccagatttgtgagaatacaagaaattctatccatttagtacttatagggatatcttagagagtccattagcaagggtagggatgaagggaagaggatacctcttgagggatgtttaggaataggcctgatgtgacatgggtgagaatggttccaggtcataaaaactctatggaatagaaagcataaggggagagatattgtaagccataaatatattctataccaaagaaggaatgagaaattaaaggacagtttgaatattgcaggatttgcagaagtcagcatgcttagccagcacatgcatgtatacatttacacttggaaccatgcaatcatttagaaattgcacgtttttcctatccattggaagcgatttgtgtcactgcaatagtattattttttaaaaccagctgcaaattctctagtcttttatgcttaaaattaggactctgaaagaagagttggtatattgcatgggaattaacataatgggtaactcttaaaaatccacgtatacatcaaaataatccatttagtcttggggactcttgggagactctgaacatcagtcataatggaggaaaggcaagatggtcaatcttttcaggagagatagttctttgttaattgagagccaagtatcatcttgagtcagaaaaacaatcattcataaacctcttactcccattgacagtggcattagtagatgcttttaggagagcaaaacagtataccatcttcaatggaatatttaacaaccaaaaggctatgacatcacccagtccgaatggatgccaactatatctgtgacaaggatttaccaatcagttcctggatcatgaaaagatctagggattttgggctctgggaagcagggcatgggttactcagggagtacggagtagcagccgcttaacaaccattacagacacatcttcataatacagttatttgaaaatcagtggttatggacataactgttgatgaactggcgatcagctgtgcttacactgctaacctttctaaaattgttcattataaattggtgaccaatggatgcatctcaaggcttctcaaactttaagtatttttggcctgaatgcagatcctttgtaatttttcatagatttatcatctactgaataagagtcttttttgcttatatgtagtaaaaaccatctttcaagcttcaaatagttatacttcagttctagagcttgattttgatactctggatataatgatcaggtctgtattaccctcagccattctcattcggattttgctctgattcccttttttgtcaatttgtgacatgaccttattcatatagacacaaaatatatctccctacccacatcctgctctcaaattccaggtttggggtggaggtggataggggaaaaccctgaccccagcattcctgtctgacattcagaaaaagctggcaaagctgagggcaggatgcagggagtaagaggggaaaacttgggttccaaggtcttgggtcaattttctgtggaattggaaatttgctatctagttataaatactttacttttcaggatatctcagagtacacagaaatgatagagatttcattcatctgaaatttaattttattgtaactttaagttgactgtttagataggaggtcaatgaactatggcctgtaggctaaaactgacctgaactatggccaactgtttttgtaaagaaaattttattgaaatatagccatgctcatttgtgtatgtgcttttgacttactcttttggaattaattttagagccagtcaagaaagttttctacatcatctctagtcatcttccaacatgatatcttaatattcttgtcataataaattatattaaaaatcttttaaaatatgtcatttcttttaaaattatcctgattatagatttgtgcagatcaggtaagtggtcaaaatggtataactgaaaagccataattttacagtggaatatcttgggaattggcagcataacattcccattccactctgcttaaaatgtggtgggatttctctgtgatggattctactgttagtcaattggagtaactttgatttagtcaagctatttttagtggggactgaacatttcacaaaaatacattaccactgtcacagcgaaatttattcttgcagtcagcctcttcaattttgcagagcttagatggaatgcatggttgaaaggctaccagaggcgcagtgcatggctgtcccccaaactgactgggacgcaagacagatctaactttagactgaaaggaaagaagagaaagatataactctgaggcagggtcaaggtcaaaatgtacctaagaaaactgggctcctcaatcacaacagtgatttttcctatggtaatatttcttatatttttactaatgattcttccaattccattattatgctcccttagggaaataatcacctctgtggatctctgtttcccaaccagtaaaatgaggaagtgggttaaaaaggtttctaaggcttcttataactctgaaaccatatggtttatacgttttcaaaataaaatatataaatgtttgctgagagtctcttgagtacagtaaattcctccaggccataacagtagcctttctgtatcttaaagatagtgtgaagggataaatgtgaaataattttgaggttcttttgcataagagagtccctgtgaaaaccaatgcgaatgtagtctacactttaaaaagattttaaatggcgagtagtaaaatggtgagtcaagggagaatagaaatatgataggactaaaaagtactgactttgaagtcagaaaattcaatttattaattaatgggtgtattcttgggcaaattacttaaccccaaatgagcaataactttctcatctgtaaaatgggtagagaaacacaatatgatgtgaagtttgaataagatgacacatgaaagggacctagaacagttcccctcagaaagtagctgttccacaaatgagtttctttttcttccctgctgtgtaaatgctcaacacggccctaactgtggttcacattggccgatgcccttacaggaatgagtttgtggtgggtaaatatttcaatggggaacaataaacaaattgagggactgctgtgaggagagggaatgtagaggaagggcaaggagtgaaagttttgattcatttccctcatttctgtctggtttaaaatcttggactgaaaccctgtttttgttgttgttgttgttgttgtttttttttttttttttttttttttttagtacgagttgagcatacctagtttgaaaacctaaaatccaaaatgctccaatatctaaaaatttttgagtaccaacatgatgccacagtggagtattgtatatgtaaatacttatcataaatttgtctcatgaacaaaattatttaaaatattgtataaattatcttcaggctatatgtataaggtatatctgaaacataaatgaatttcatgtttagactgtgtcccatccccaagctactacgttatgtatatgcaaatatttcagaatccacaaaacatccaaaatccaaaacacttctgataccaacattttggataaggattactcaatctgtatacacttttgctttcagaattctcagaaggcacaggcagtggaattcagaactgggtaagtacaatatcaatactgggagcaaaatttcctttttgtgttcttaagacagtaaaatacataaaataaaccccctcttccccccacaaaagtgctaaatggaattttccctcaatggaagctgagacagttgattttcagaaattgaagtaattcagcattactatgctgttaagcctgtcagggaatcagagccctctattgtgattcatatttcctggaaatgcccatggttgcctacctgtttttcaatacaagggtcacagtctgaccatggtccaaaatctcccaggaggcagttgatggggcatctttgccagttacattctctagtctcctgcttgctgcaaatctgttcacaaaagttttcctggtagtacttatctactactatttgtctgtaaccatgaagaagaagttgcttagaatgagtgtattcaccatatatcctgctccataatcaaagtatcattgagcattaactacaataaatagaaaagaaagaaaattttcatggaaaaattaggcaggttggcatatatgcagttctcaccacttaatagaactcaggacatactttgtgaggctcagcataaaatgaaaatgggaaacctcttgctcaaaactaagaacttcaagacagcaaaggcagatcattaagccaagcatgaagcccttctaagtgtggggcctgtgtggctgcacatgttacaccatgaagccagccatgctggagctcctctaatggactggaaggcaaggaaagatgaaaggagagaaagatcctgcaaactgcttggaggaggacaacatagggggctgtgaggctaaagattcaaagagaaagtggcatgagagaaacatcctgaataattcacgtgaattctccaggtaacagagggaagggaatttggaggaagcgacatgtgcaaagatttgaggcagatgagagcatgtccaggtagctctccagggaggagcttgtgtgactggccaggaatatttgctgttctttttaggcagcagggagctactgaaggactcttgaatagaggaatattgtaaacaaatctgttttcacatatatagtagatggtttattggggaagtaaattggtaattttaatgagattcacactacatatgtaaacatagttttctaaaataaggatcctaaaaaattctctaatggttaaaacacattaaatatatgcttttctcccctaacatgtgagcatttccatggtacagaaacatttaacagagttaaagaaactgtgggggacaagaagtctgaattggtgaaaagactgaattattaaatgttatcaagaaagaacagttttgttgccattttgtatatgccaacaatcaagctaatagctagcagttctgctcaattgaggtcctgttagactcgatttaatgagtagaaaattctctataattaactcactaactataggcaagcaaagttgtatgctgattgaaaaaagcttgggtagtgattctaagcaagttaaatattcaactgaaagtgttgcacagattcttaattaaatttctttgaaacccctcgttcttgtagaaagaacaaaagtagacttcctttcaacctcataagagagagacttcaaatttcatccaaatttgtaagttcttactttgatatatatatgttcccattgcttagtgttgcactcctgatgttgctgacttcatccttgagtccttccaggacacaaagaaaagccacaaagctcacacccacctgtgtctgctctgggttccagaattgcaagtttttgagcagctggtccactgagtccatgcatagtgatcacagaagcaggcttggcccttgttgatcagagcattcagcaggatgaagtacaagacagagcgtctggccatgccttgagagcctccaggccctaaaatgaaagaatacataacacatatcaaatgcttttttgaggtaaaccttcacaagtcatcctgagtcagagattcaaatgtgattttagaaaatatttgcatttttctgccttccttaaggcaagtcaacacctacaaattcacatgctcgtgagtacaaatcctatttttaaagatttttagggtggagattaccataggcacaacctccagtactagtaagtttcttcaaacggttagtgataggctacaagacaaagtatgtagcatgtatttgtaatccatttcattccaaaaagtattttagatttatacagtcttacccttctcaaaacacctgctccttttgtgtgagcaatagcctcaagtacatttcagctgttcctacttttctgggactgggaaagaagtttggatcattcttctggaagctctttttcatttcctgacatgctggaaacctgctaaagagaacgttcactgactccatataaagtcagagaaataagagctagtaaggatctttgaaacctccaggtcaaactccttcattttatggagataaaatgaggctcaaggcagtgcaatagtgttgaggctgcaggtcaagtaggagctcacaaaccctggttcttgaatgaggtgaagcccttcactgagtttctaacaatcctaagtactgtgttactgcagtatcaagatgcctggagctccaccactcaggccacaacaggttgagcggaaaaatctttgaccagtggttcccacttatggtcttgaagatccatgagttatttgcaaaaccatacccaccccgttattgccagtttaatcgttatatccctaatgaaacatgcaacattattaatatatgcatacatatcaataattctgctgtaattaatatagtagtaacttttactttaaaaagttaaatgccattcgcctaatttttctgtctcagtttcactatctataaaataagagtaatacctacctcataaagcttttgttaggattcagtaagaaggttcatgtaaactgcttagaacaattattggcatagaatcatcacttaataaatactagcttttcaaattagtaataacttttaagaatgttacaaatttaatagtagctgttggtcacacatttttaatagatatttccaaattgccctgctaaaatatggctctctcatgtcccagaggatgagtttctgattatatttctacgtgattagtttacgtttcttagttttcatgaaaggatacctcagtaaaaataaatggggttcatcatttgataaatcttggtttaagtcaagagcttgagatcagatataaaaattgttttttcagtatgttcagaaactagggtatttcttgttaataaatcagtaagcttttttttttctttttttttttttttttgagatggagtctcactctgtcacccaggctagagtgcagtggtgtgatctcggctcactgcaagctctgcctcccgggttcatgccattctcctgcctcagcctcctgaggaggtgggactacaggtgctcaccaccacatccagctaattttttgaatttttagtagagacggggtttcactgcgttagccagggtggtctcgatctcctgacctcgtgatcagcccacctcggcctcccaaagtgctgggattatcagtaagctttttaaactcttctacaagctcaaagaaaaatgccagaataaaagtaaccaaatccattgacgtatggctgaatatgtctttcaatttaaaatggaatgaacacacatttgggtattcattgtatgctgctaggcattgaatgagacacaaagaaatagaagcctttatcactgtctgggagggtagaaagaaattgaaaatactacctatgctttttacccaagctttttactccaactcatagatatgctgctagagtcctagattatttcagtcataaaaatgaggggcttttgggcattattcaagatggctgaataggaaaagttccagtctacagctcctagtgtgagagacacagaagatgggtgatttctgcatttccaactgaggtactgggttcatctcactggggcttgtcggacagtgggcgcagtccatggagtgtgagctgaagaagggcgggacatcgcctcacctgggatgtgcaaggggtcggggaattccctttcctagccaagggaagccattacagacagtacctggaaaatcgggacactcccaccctaatgaggcacatttccaatggtcttagcaaatggcacaccaggagattatatcccgcacctggctcggagagtcccacacccgcagagcctctctcacagctagcacagcagtctgagatcaaactgcaaggcacagggaggctggcggaggggtgcccgcctttgctgaggcttgagtaggtaaacaaagcagctgggaatctcgaacctggtggagcccaccacagctcaaggaggcctgcctgcctctgtagactccacctctgggggcaggcatagctgaacaaaaggcagcagaaacttctacagacttcaacgtccctgtctgacagccttgaagagagtagtggtctcccagcacggagtttgagatctgagaatggacagactgcctcctcaagtgggtccctgacccccgagtagcctaactgggaaacacctcccagtacgggccgactgacacctcatacagctgggtgcccctctgagacgaagcttccagaggaaggatcaggcagcaacatttgccgttctgcagtgtgggctgttctacagcctccgctggtaatacacaggcaaacagggtcaggagtggacctccagcaaactccaacagacctacacctgagggtcctgactgttagaaggaaaactaacaaacataaaggacatccacaccaaaaccccatctgtacgtcaccatcatcaaagaccaaaggtagataaaaccacaaagatggggagaaaccagagcagaaaagctgaaaattctaaaaatcagagcacctcttctcctccaaaggaacgcagctccttgcatgtaaaggaacaaagctgaacggagaatgactttgaccagctgagagaagaaggcttcagacgattggtaataacagacttctctgagctaaaggaggatgtttgaacccattgcaaagaggctaaaaaccttgaaaaaagattagacaaatggctaactagaataaacagcatagagaagaccttaaatgacctgatggagctgaaaaccatggcacaagaactacatgacgcatgcacaagcttcagtagccaattcaatcacatggaagaaagggtttcagtgattgaagatcaaatgaatgaaatgaagtgagaagagaagtttagagaaaaaagagtaaaaagaaatgaacgaagcctccaagaaatatgggactatgtgaaaagaccaaatctacgtctgattggtgtacctgaaagtgacagggcgagtggaaccgagttggaaaacactctgcaggatattatccaggagaacttccccaacctagaaaggcaggccaacattcaaattcaggaaatgcagagaatgccacaaagatgctccttgagaagagcaactctaagacacataattgtcagatacaccaaagttgaaatgaaggaaaaaatgttaagggcagccagagagaaaggtcgggttacccacaaagggaagcccatcagactaaaagcagttctctcagcagaaactctacaagccagaagagagtaggggccaatatacaacattcttaaagaaaagaattttcaacccagaatttcgtatccagccaaactaagcttcataagtgaaggagaaataaaatactttacagacaaggaaatgctcagagatttttgtcaccaccaggcctgccttacaagagctcctgaaggaagcactaaacatagaaaggaaaaactggtaccagccactgcaaaaacatgccaaattgtaaagaccatcaatgctaggaagaaactgcattaactaatgggaaaaataaccagctaacatcataatgacgggttcaaattcacacataacaatattaaccttaaatgtaaatgggctaaatgccccaattaaaagacatagactggcaaattggataaagagtcaagacccatcagcgtgctgtattcaggagacccatctcatgtgcagagacacacataggctcaaaataaagggatagaggaagatctaccaagcaaatggaaaacaaaaaaaggcaggtgttgcgatcctagtctctgataaaacagactttaaaccaacaaagatcaaaagagacaaagaaggccattacataatggtaaagggatgaattcaaaaagaagagctaactatcctaaatatatacgcacccaatataggagcactcagattcataaagccagtccttagagatctacaaagagacttagactcccacacaataataatgggagattttaaaaccccactgtcaacatgagacagatcaacaagacagaaagttaacaaggatatccaggaattgaactcagctctgcaccaagcggacctaatagacatctccagaactctccaccccaaatcaacagaatatatattcttctcagcaccacttagcacttattccaaaattgaccacagagttggaagtaaagcactcctccgcaaatgtagaacagaaattacaacaaactgtctctcacatcacagtgcaatcaaactagaactcagggttaagaaactcaaaacgctcaactacatggaaactgaacaacctgctcttgaatgactactgggtacataacgaaatgaagccagaaataaagatgttctttgaaaccaatgagaacaaagacataacataccagaatctctgggacacatttaaagcagtgtgtagagggaaatttatagcactaaatgcccacaagagaaagcaggaaagatccaaaattgacaccctaacatcacaattaaaagacctagagaagcaagagcaaacacattcaaaagctagcagaaggcaagaaataactaagatcagagcagaactgaaggacatagaaacacaaaaaacccttcaaaaaataaatgaatccaggagctggttttttgaaaagattgacaaaactgatagaccaccagcaagactaataaagaagaaaagagagaagaatgaaatagacacaataaaaaatgataaaggggatatcaccaccgatcccacagaaatacaaactaccatcagaaaatactataaacacctctacacaaataaactagaaaatctagaagaaatggataaattcctgaacacatacaacctctcaagacaaaaccaggaagaagttgaatccctgaataaaccaataacaggctctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacgaaaaaagagaattttagaccaatatccctgatgaacatcgatgcaaaaatcctcaataaaatactggcaaactgaatccagcagcacatcaaaaagcttatccaccacaatcaggttggcttcacccctgggatgcaagtctgtttaacttacccaaatcaataaatgtaatccatcataaaaacagaaccaacgacaaaaaccacatgattatctcaatagatgcagaaaaggccttcgacaaaattcaacagcacttcatgctaaaaactctcaataaactaggtattgatgggatgtatctcaaaataataagagctatttatgacaaacccacagccagtatcataccgaatgagtaaaaactggaagcattccctttgaaaactggcacaagacaaggattccctctttcaccacccctattcaacatagtgttggaagttctggccagggcaatcaggcaggagaaagaaataaagggtattcaattaggaaaagagggaatgaaattgtccctgtttgcagatgacatgattgtatatttagaaaatctcatcatctcagtccaaaatctccttaagctgataagcaacttcagcaaagtctcaggatacaaaatcaatgtgcaaaaatcacagacattcctatatacccataatagacagagagccaaatcatggtaaactcccattcacaattgcttcaaagagaatgaaatacctaggaatccaacttacaagggatgtgaaggacctcttcaaggagaactacaaaccactgctcaatgaaataaaagaggacacaaacaaatggaagaacattccatgctcatgtgtaggaagaatcaatatcgtgaaaatggccatactgctcaaggtaatttatagattcaatgccatccccatcaagctacaaatgactttcttcacagaattggtaaaaactactttaaggttcatatggtaccaaaaaagagcctgcattgccaagacaatcctaagccaaaagaacaaagctggaggcatcttgctacctgacttcaaactatattacaaggctacagtaaccaaaacagcatggtactggtaccaaaacagagatatagaccaatggaacagaacagagccctcagaaataataccacacgtctacagccatctgatctttgacaaatctgacaaaaacaagcaatggggaaaggattctttatttaataaatggtgttgggaaaactggctagccatatgtagaaagctgaaactggatcccttccttgcaccttatacaaaaattaattcaagatggattaaagacttaaatgctagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgctcagccaaagaaactaccatcagagtgaacaggcaacctacagaatgggagaaaatttttgcaatctacccatccgacaaagggctaatatccagaatctacaaagaactcaaacaaatttacaagaaaaaatcaaacaaccccatcaaaaagtgggcaaaggatatgaacagacccttgacatttgagaaatgtcttctcaaaagaagacatttatgcagccaacagagatatgaaaaaaatgctcatcatcgctggccatcagagaaatgcagatcaaaaccacagtgagataccatctcacaccagttagaatggcgatcattaaaaagtgaggaaacaacaggtgctggagaggatgtggagaaataggaacattttacactgttggtgggactgtaaactagttcaaccattgtggaaggcagtgtggtgattcctccaggatctagaactagaaataccatttgacccagccatcctgttactgggtatctacccaaaggattataaatcatgctgctataaagacacatacatacatatgtttattgtggcactattcacaatagcaaaaacttggaaccaacccaaatgtccatcaatgatagactggattaagaaaatgtggcacatatacaccatggaatactatgtagccataaaaaatgatgagttcatatcctttgtagggacatggatgaagttggaaaccatcattttgagcaaactatcacaaggacagaaaaccaaacactgaatgttctcacttataggtgggaattgaacaatgagaacacttggacacagggtggtgaacatcatacaccggggcctgtagtggggtgggggtaggggagaggcatagcattaggacatatacctaatgctaaatgacgagttaatgggtgcagtacaccaacatggcatatgtatacatatgtaacaaaccttcacgttgtgcacatgtaccctagaacttaaagtataataaaaaaaaatgaggggctttttttcccactccacttgcaagctgattctagttcgtcggtaagtaactcgcctttcctggttttcctcagcaacacagaaccacagggtattgggacaatagtagccagatagaatttaagtcgtgatcagacatataatgtgagtcccaaacatttgggagctgaggctcccaaataatgtgaagctttcctttcaaccactagatagactagagaagccactcccctatacccttcacccttgccccccactgccaaaattggaattttctcatacagggaccttttcagcaagaaaaactaaatagatactttgttgttgtttttttttcttattagatgttggacaagacagatatcttccagaatatttcctcaattgtagagaaaacaaattcttaaagcttctggtgaaattttcatgtaaataatttggagaagttaaattgcaagagattactaattctcagttctcagcagacactgtcttttaacttccaaaagcttgaaaggtatgggtgagttttattccaattatcatcaaaaactgcaaaaacagaacccttataaaatattctgatcgctctttaagctataactgttctgaggcaatatggagcctgatataaattaagatggtaacattaaaacttatttgatgaggtactaatgaaagagctaattggtagcttttcttttttaatattctattattaggaatacaaattgttttatgttaaaacaattttatttttatttatttatttttttgagacagagtttcattctttcacccaggctggactgcagtggcaggatctcagctcactataaactcagcctcctgggttcaagcaattctctgcctcagcctcccgagtagctgggattacaggcccctgccaccacacccagctaatttttgtatttttagtgaactcggggtttcaccattttggtcaggctcgtcttgaactcctgaccttgtgattcacctgcctcggcctcccaaagtgctgggattacaagcgtgagccaccaagcccagcaacaatttttaatcaaataaaaataattacttctctgaatttttttgttatgatggcctagcatattgtattatatggtttcttatttattaatttccacatctctaggcattctggaggtatctaaaattacacacaggcattttacccattactgtacaattttcatacaaacatagaataaaagaatgttcggtcaatagaggaagataggaaaaaagtcttccacttcagtgccatcgtagaaaagcagaaattcttcagttttctcatagttgccatcccctcttgagttttccaaaaatcagtgatcccattgaaccattgatgatagctttatgagcatttagagaatttcaattaaaatgaagcccatcttattctaacctgtcactttctaatgtattttactcacatgaaccatttgtctgcaaggcagttcagcatatcttacccaacagatttctgaggatgctctagtttatccccagctataggttcttcctttacatctccatgtaaacttactgaatttcttatttcttattatttttttctgtgcatgcccagaggctcaagaaatgagcctttctatctttctacctttactatcgccaaggtaagctgggtagtccaggtgcatgactgaccttggctaaagagtatgtttgctttacttttaactaatttaactcatagagaaacttgatctcaaatgtcctctggaatgacatttgtttaaaaaacatgacctctggttcttttcagatttaaacaaagcaattataaaaaagaaagacaaagaaatggttatagtctgagttacatatttttatgcatgaaattgtaattttgttggaaacatgattaacaattttgaaatattaagattgaaaatgaaatcatcatattactcacctttaagcagagtttgtggtgtcctcggacctaagctgcaaattattggggaaaaaataggtatgcagaatgaagagggtatatatgttaatccaaacaaagcttcttttcttattgctagctaacacaaggcaatgctgtcatatcccagaagcctagcaacacctagagggttgtcaaaataaatgttctctggaacttgaactttgcaaatgattacaccaatcagtagtaaccctgaaactctgggtgttggatgttacacagagtcctgaattttcagtgagttttcaattcaagggctattgtagtagctattgctactgcatagaaatctctctttccattttaaagaatcctttagattaattgcttaaaattgctgccccccttaggaatgtatagattcttagtttttgattatagaatagttattggtaactatttaagaaatgtttttggagacaatgtgattgtgtatgtagaaaattcaaaagaatctacaaacattagaattaataaatgaatttagtatgatttatcaacacaagtttattatagtaaaaagtgtttctatatgccagcaaaaccaaacagaaaatttaatttggaaagaattaaaatagcaatgatcaaatgggctctttatatgtaatgatgattacgcttctctgaaatggttgcaatttaactttagattgaagtaaaatggatttcatcctaaggtgaagcagaacaaaatagtgcaatagaaaagaaaaaaaactatagggactgagaatgtggatacatattctagtcttgtttctgcactaagcagctaccagctatgtgagcttcaataaatcactatacctcattggaacactggtccctcatttgtaaaacaagtgtttttcaaacttttttcaaagcagtagaaaacaactaaaacaaatattccttagacagcttagatttttatcacatggtgggaaatgatgatctcagcaagtctaaagattacttgaaacacagctgggaacccaccactcaaaggtcacatagtttaatatacatggtagtaactttcccaaggccagagtaagtcagaactggaatacagatgatctgatttccagtcttttttctctctcttatactacattgagattttaaagattgaaatttgggcctaaagagaaagtagagtggtgtgctgcagaccagtgttgaagctagtttggggctgggatagcagcttcacccttgattacctgagaagataaacaggaaaagaaatatttggtgattggacaagaatatatgtcatttaatttgcatatttctttctttaattggtctttgaggtcctaaaataaaattcatttgtcctgagttcaaggtgtttggagctaaaggcaaatactggaagtcataatacagagagatgcaaagttaggtgccagtaggatgagcttaaagaggactttatttgtaatgtgggctatgaagaggacagagaagtaagattgtatgctgtggcactggaaaaacacaggtggagagagttaaggatggtaaggggaaatccttgagatggaatgcgaatgtctgtgatccaaacactagaattgacccagcaccaactaagaatctagaatcttttcaacaatgtatttgggttctccatcttgggttcttttggaaggttaaatgacatatctcactcatgagtcctttttctagagcagggattggtaaactagcctgatgcccgtttttgtaaataacgttttataggaataaagtcacacaattggccattgtttatggttgcttttgtgctacaatggtagagttaagaagctggcaacagaggctctccagcctgaaaagcctaaaatatttaccgtctggcccttataggaaaagttgcaacccagagagaaatatttctggtctgatacatacaacaaagtgtccagtggctttgggaagtagaagtaggctaattgggactgatgagtaggtgattgtttcagagctaggaattgaatacttgtgtgcagttgtgctcaggtctgactctgtgcatgcaaagaatataggtgttctctaaacaatatttagatgtgtgctgctgaaaaacaaagtctgctatgaagtttactggcactggctgagttgcttcagcaactgcaggccttctgaagttttggctggtaacacagaagaccttctcacacaaaatctcctattttcataaggtagatagttgctattgactgaccagtagaaagcatataattgtaaaaaaacagaagggtgcaggagaaaatgagggccaggacatggagagttaagatggagcaattatcattttaccagaaggagaatatgtattctgttaaaaaccattattcctcttttaatgataatagattcatagccaaatggtattttctgccaagaaaataaccacaaatataaaataatgaacaatggaagctgctatctgaaggctttttcacatgctaagtattcacatgccaacttatcattatagcaaaagtactataatttcttattagagccaaggctaatgaccccatctatttcaaaaactcttcagagtgtgctttgtcagtcaatatgtgagtagataaagtgaaatggcagattgaactatttcaattgggggatcatagatcaaaactctcaaatatggaggaaacagaaggtattttggacctcaggcttccacactctttgtgtcttctctttcctactaaaattattagaaagatagtctaaattgactgcatttgatgttttgccatctactcctcattcacttcactctttgaaatctatgtgataaatacaaccagcctacaccaactattctctcaatgaccaccattaacctcctaattgccaaactgaatgacctcttctaaatccactattggcttcctggacaaaatataatacatgtgtttctctgaacacttaggaaattcctcttctgccttcctctatgattctcttcctacacccatctaggattttatcctcaccccttttctttcatttgagatttcatctacttccatggggttattgatcacctttgtattgattgcttcctagtccacctgtcttagtattctaatgttcagacagataatagaaacatcatatcacagagatcacatcctcactccctgactcctcctatccttttagatgctaaatacatgaggcaattttatcttttatttagcttttatctttgaagtatctcttctatgcattcctcatttttccaccttgccatcatgtctatggctacagttccacttccagccattatgaaaccataccttgaagattgcatcagtggcttagctggtctctgagctttagaactcctcctgtaatttcttctaatctactctgcaaggatactctagagttcacctctcagtagcacaaccctattcaaaatctcagtgttattcttttaaggaaaccacgaaattagctacagagtcccagtccctaatattggaaaccttgagcaattttattccatattaccctttagactcattttctctccttcattttgcatagtccaccatctagccaaattggataacttgctgatcctcaaaatggcctatggtttctcttgccattatattttttcccttgaaactttttcttccccaatcacaaatgtagtgtattgtgtacctcttctttgggggccattccaaatgtatttccttcttaaattttttctacatttcacaatcattttcacactttagatcagatgctacatgattcctccaccctttaaacatatgaatctctttttacctttcatatggaactcacttactattgccggatattatgatcattgtgtgctttattattgcccactcttagtccacttaatagattcaaagttcctttatactgagcctgaataatatttatctttatatttgataaacataaaagttaaatcaatgttgattgaattgagttgtctacacacaaagagtttgtgagaaaattgctgaatacgcctctacaaatgtgcccttagctaaattccactatgtagattctcatgtgtttggcaataagaggtaacaatctttcatatagcaaaatgctccaagaattgcttttatttatgtgtttgttgagttgttgaacaatgcataatgatgatattaaatggaataaactctttggtgattctttggaatggaaagaaaatgagctacaatttagtctccaaatctaaaactggtctaacatagtaatagaaatctagtttgagacaataaagccaaacttctgccaagttttgccccttctaggattatacagaaacttaggttggattccaatttagagctttgtgggaaaaggcagaaaaaaaaagcctattgaagtcagatgaattgtacctagactcttgggtcagctttctagtttgtttcttgtcctcctgttgtcccaaacatcttgaatacattactaaggtattttttctaaagcactactacaatgaaaatcacaatctaatgttttggtagcattttatggtttgcaaagcactcttcaaagtgccataggaggaacagtatcttgattcatccatttcactcaattcacaaatatttactgattatataccaggcattatgctgggacttaagatacaaagatgaatactttcggttagttctttcaagaacttcacctcatagtaatagtagttggataggaaagaaaaagaacgtcaagaagtactaaaaattataagaaatccgtctattcacagaaatcgtaacttcccttgtttatgcagtcacgtattctcttatcttttcatcatattcactgtaattaccactgttgtcattatccaaaggtttttattcacgaattttgcaaaaatttactgcaaggaactgttctaggcacttgaacagtaaacaaaacagaaaaaaaaatcctgcctttgtaaaatttacaatctccataaagacaggagagagaaaacaaaataaataaatgaattatatggtttttaagaaatatttctttaatgtttatccaactattgtgtcttcttaaaatgcaggtcattctttctgcctctttttttcctgggtctatgctttcttgaagaaaatctgtccagcccgatctcacaaaatttaatcctgtaggacccactgagctggtttcagatctcatgattctgccccttggacaaagtgataggccaggattgggtatgggtcattcggatttcatgtgccagggttggggagtgggacttagaaatactatttaaacacagtgtgaagcttgcttaagccgcatgcagggagaagaagagaatgcctctgtagagagaaaaaagaatgaggtaaggactggaaaaaatgtacatgtgagaacatgtggccttagagaatataaatactgtccctgtgaaactcagctgcacttccttctcttgtgtttcataaggcccaccttttccttctagtaaactatactttgaatacatttttgttacttgcaaggaagttatcctaactaggatgtattttatgattttcaaacaattgcaaacaatttcaaaaaagatactccaacaatttcacaagtggcactgcttaatcagaatggatgctgtccagtttattcaagccatgtgtgctggctgatgccagccctgagcctgatgccagccctgagcctgatgcacaattatgtcacacaatctccagcaaatgtagaaattaataaattagttgaatatttactaagattctttacctcctagggtggtatagaaaaaggaagctggaaatcatgcttccaaatctggacctcttcttttaggtagggtcatctagatttgtctgtaggatggaagtggggagactgagaaagaaaggccattctgtggtcagataaagctgttgagagagctttgggagggctgtattgagcgccctttgttctctggggtgtaagtagctaataaatgaggcaatgcaagcaatgaagggacatgtgaagtccttgaaataactctgacaaagtgctttgagggaaaattgttattctgagttctgaggttgtgggaaactactgaaaaactaatgatagcagtgatataatcctctgggcacagggcaatacctaaagcatgaagaaaagaaggaagaaataattccaggtcagaggttattgaaatcttagctaagttcgtagttacaaggcaaagaaagacatgctgtgttgtcatgtaagcaactccaagttttaacatctaagggagaaaaaggcagtgagagatagaacaggccactctttgagacatgaatcacacaaataaatatcaatttttaaaagttcttccaggagaaaggttgtctcagtcaaatgcttgaacgcctgacaatcccattaacatcacatgctctgtgtattgaatcctgcatgggaagacagcagtttccaatcatctttctacatattatcaggagtgtggccaaagtaaagagggaaatgaaagaacaggaacaaattgaaaagtgtttgaggtggtcattttttaaaataatcaaactctgatgaatagttgtattttttattaatgatgacaagaaatagtctcacagtaacaaaatgtcaacatctactgacctggggtagtgtgtaatacaaagacaaatggtttcctgatttcttgccatgtttttcaaacacttgcaaaaatgaggctggccatttagctgtgtttattctttttatgataaaaagctactttgtcttaccaaccttccctggacagccctcatttttatgcagatagtgtattatttaaaaaggagaatctaaggctctggatacttaagcaattagtcaaattaatgcaacaaataaatggtagaagaggaatttgaggtcttctgctctctggtggaacttgttttaccttgttctttattttaatcttccagtattccctagctccctcaaaccatcctgttttgcttactttccttcaacagacttactaacgttttgtgtgtaatcagaaagaaggcgtttatataaatcagatttattttttattaattattttaactgcctatcttttttactataaccatatgagtgaggtgcagtcatatctcattttggttttgatttacatttctctagtgattaatgatgttgggcctcttttcatgtgcctgttggtcatttatatacattctttggatcgctaattttttaaaaaatgatttcaacttttattttagatacaggaggtacacatgtatattgtgtaatattgaggtttggggtacaaatgatttcattatttaggtagtgatcataatactcaatgggtagttttccagccttttccctactccttctcccctgacccaataggccccaatgtctattgctctcatctttatgtccatgtgtgcccaatgtataaacagattttttaaaaaaagagcaagcatctaacatacattcttggcagtttaattttaatatttcattaaaatgttatcttttaaaactaatatatttatgtagctaaaaaaaaaaatagaaacacaagacttaaagcagcaaaccaaagccactactccaccctgtcccagccctgcagttttctttctagtaccagtcactttaaaattagagctgttttatttttttgctgttgttggttttcatctccatatttcatagtacttgctaccatgtaattacatttatcctgagcccaggcctttatgctatagttttcatgaaaactctacaatacactgtcatgatttttgctttaagctatacattctcaacagggatgatatttccctccaaaaggatgaaaattgatgttcgtggggttggtgaaatattctcagttattacaatggtgtatagccctgtaaagctcaaccctatctgatgcaatcacattctttagaatttaatttctcctgtgtcgttttcatgggtatcccatgagcagcactgacattgggctcagggaatatacataaaatgtatataagatcagtgctacagcaagtagatggctttctttccttaatagattgctagaaatggcctagcctactcaagtttattggctgccattggctaccttatggatgttgtttatgtttgatcctcattgttttggtgtgtgactagggctttgagaattaaataaaagcagtgttttaatagttatttggaataattattcaatagttattcaaaaaagttattcaagtctataaaagttattcaatccatcattatacaggtgaggaaaacaaaaaagtatcaacaatatataaatgaatatctggcagctagttaagttaaaagttattttcttatattgagcagaagttaaaagttaagttcactggccagcgtggtggctcacacctgtaatcccagcactttgggaggccaaggcaggtggatcacctcaggtcaggagtttgagaccagcctgaccaacatggtgaaaccctatctctactaaaaaatacaaaaattagctgggcatggtggcgggcacctgtaatctcagttacttgggaggctgaggcagaagaattgcttgaacccgggaggcagaggtcacagtgagccgagatcatgccattgctctgttgcctgggcgacagagagagactccatctcaaaaaaaaaaaacaaaaaaaagaaaagtaattttgtaattattttacttttgctcaaagttaatagttttgaaaactattactgtgtatttatatatgttgctaactttcataattatataagtaaataaattatattgaaatttgcaataatcatgcagttacaaagttgttatatgctaatagctttttaattttttaaatattacatttaacttgtaaaatttagtcattctgaagtttgcattaaacagaaaagttttatattttttattttaatgtataaagcacagatgtatctataacatataaacaagagcacaacatatcttgggtataaaaatgtcaaggaaggaatgaacaattacaatgtaaagtttctaacaagtttccttggggggaaataatggaaaaaagtttgaagagttaatttaaacaattgcattatttcaaagaaattaaaagaaaaaatagtttatttatatgaatctctatatatttactatttctgatacctttgtgcatatagcttcccctgctcttacgagtcaggtagtattttactactttctgttttccaaattttgttaaaatattatgtttagtgggatctcctctattttccttgtccttcgggtttatagcattttatttcttttctcttgtattgaaagagtaatgaaataagcccacatggctaattacaacgttcaatagaaattcatttagccttttaaatgggaataaatttaatatcctaactgtgttcatttaaccagaaactttccctatcccctcttccattttaaacttaaatatgcttaaattctctggaatttctattgtaaataaaaccttccaatttgttttgatcacagatctaaattatgtaatttatgttattgtgagggataaatttgtactcagcctggagctgaacttacttcagataccactgtaataaacaaaagcttggtttctatggtttctcctataactaacatttagagattaacaggtattgttaccacactgggcactggggcgatatatgtcaggggaggcaggaaacaaagaaagcaccagataattagagaaaaaaaactgtgatgatttcgttattctccaaggactagatggttgaataaatctgtacttgaataaaaatgctttttctgctcttctctctggagtaatttaagagaaaaccaatgaggaacaacaattacacaataggctgggtgtctgggcaatctcaggtcccagggtaccaagcaaaactctcaagctggcttggacatggtaccttcatagccctactccacagtaaaggataaattgaaataccttttcttgtcatcaggtaatatgtttaattggtcttttgtgcgattgtattggcttaatcttttctaactggttaagttggaggtgggtgagaagcagtttattttaataagaactgttctgttaggcttagatgtatgaaagatagcaaaaatacatgtcattgaaggaaattcacagtttatttatgcaatctacttttaaaccaagtatagtaatcaaatttagaaaagctggcaacagaaaccgtacttttatttaatataaggtttattttgttaatatttcaacaatgtttcaataatattctttattttccttctccagtacaggatccagcccaagatcatgttctatttagttatcatatctatctctttaatatagagagcagtgcctaaattttcattgtcattctagatattgacaattttgaacaataaaagcaaattatgtttagaatattctttactttgggtttgacagtatcacatctggaaataatgtcaacaaatctactataattttctttaattgacaaaaattgtacatgtttgtctatatttaaagtgcacgacatgatgttttgatatatgtatacattgtgcaatggctgaatcaaactaattaacatatctattacctcacatacttaccattttgttttttgcggtgagaatactaaatgtgctgtcagcagttttctttttttctcttaaaatagctttattgagatgtaattcacttgccatgcaatgcacccatttaatgtgtacaatttaatagtcttcaatatattcacagagatgtgcagccagcaccacaatttaattttagaacatttttatcactcaaaagaaaccctgaacccattagcagccactccctatttttccctatccctcctccccagtcttaggcactaccaatctactttctgtgtctatagttttccttattcttcacatttcatataattgaaataatataatacgtcgtcttttgagactgattctttgactaagtgcgttttcaaggttcatccatgttgaccatgtattagtatgttccttttttttttattgctgaataacactctgttgcatgggtatactacattttgtttatctatttatcagttgatggtcatttgtgttatttcctctgtttggctattatgaataatgctgctgggaacatttgtgtacatgttttgtgtgaatatatgttttcaattctactgaatatatatctaggagtggagttgctgggtcatatggtagctctatctttaacattttaaggaactgtcaaattattttctgtagcgattgcaccattttgcatttctaccagcaaggtattagggttccaatttctttgcatccttgccaacacttgttattttcttttttttcttcacatttccctgggaatttacatttacaggaaatttgcgtatccttgatggctaatcatgttgagcattttgtttcatgtgcttactggccatttgtatgtcttcctttgagaaatgtctattcaaatcctttagccattttttaaattatactttaagttttagggtacatgtgcacaacgtgcaggtttgttacatatgtatacatgtgccatgttggtgtgccgcacccattaactcatcatttaacattagatatatctcctaatgctatccctcccctctcccccaaccccacaacaggccccagtgtgtgacgttccccttcctgtgtccatgtgttctcattgttcacttcccacctatgagtgagaacatgcagtgtttgtttttttttgtccttgcgatagtttgctgagaatggtggtttccagctttatccatatccctacaaaggaaatgaactcatcattttttacggctgcatagtattccatggtgtatatgtgccacattttcttaatccagtctatcattgttggacatttgggttggttccaagtctttgctattgtgaatagtgccgcaataaacatacgaatgcatgtgtctttatagcagcatgatttataatcctttgggtatatacccagtaatgggatggctgggtcaaattgtatttctagttctagatccctgaggaatcaccacactgacttccacaatggttgagctagtttacagtcccaccaacagtgtaaaagtgttcctgtttctccacatcctctcccaaaacagcatggtactggtaccaaaacagagatatagaccaatggaacagaacagagccctcagaaataatgccacatatctacaactatctgatctttgacaaacctgacaaaaacaagcaatggggaaaggattccctatttaataaatggtgctgggaaaactgactagccatatgtagaaagctgaaagtggatcccttccttacaccttatacaaaaattaattcaagatggattaaatacttaaatgttagacctaaaaccataaaaaccctagaagaaaacctaggtgataccattcaggacataggcatggacaaggacttcatgtctaaaacaccaaaagcaatggcaacaaaagccaaaattgacaaatgggatctaattaaactaaagagcttctgcacagcaaaagaaaccatcatcagagtcaacaggcaacctacagaatgggaggaaatttttgcaatctactcatctgacaaagggctaataaccagaatctacaatgaactcaaacaaatttacaagacaaaaacaaacaaccccattaaaaagtgggcgaaggatatgaacagacacttctcaaaagaagacatttatgcagccagaagacacatggaaaaatgctcatcatcactggccatcagagaaatgcaaatcaaaaccacaatgagataccatctcacaccagttagaatggcgatcattaaaaagtcaggaaacaacaggtgctggagaaggtgtggagaaatagcagttttcaactgtagagtacattgtgattaactatagtctccatgctatacagtagatctcctgaacttgttcctcctgtctaactgaaattttatgtctcatgaacaacatctcccccattcctatcacctccctcctgcggcccctgctaaccaccattctagttgctgcttctgcgggttctacttttttagattccccacataagtgagatcacacaatgtttgtctttctttgcatgtcttattttatttagtgtagtgtcctccaggttcatccatgttgcctcaaaagatgggatttcctcatgttttaaggctaaatagtattcatttttgtatatacaccacattttctttatccattcatctgtcgatggacacttaggttgattccatatcttggttattgtaaataatgccacagtgaacataagagtacagatatctctttgacatactaattttatttcctttggatgtatactcaataaagagaatgctggatcatatggatttctatttttaatcctttgaagaacctccatactgttttctataatgtctgtacaaattaatattcctaccaacagtgtgtaagagttttctttcctccacattctcatcaaaacttgtcatcttttatctttttggtaatagtcaatttaacaggtgtgtggtgatacctcatgatgattttaatttgtatttccctaatgattagtgatgttgggcagtttttcaaattcctgttggtcatttgtatgtcttcttttgagaaatgtctgttcagatcttttgcccattttttaattgtttttttttctagctattggattgtttgaggtttttaatacattttgcatataaactcttcatcagacgtatggtgtgaaaatactttctcctattccgtaggttgtctgttcactctattgattgttatcttgactgtgcaggagatttatagttggatgtaatctcatttacctatctttgcttttgttgcctgtgcttttggggtcacatccaaaaaaatcattgcccagaccagtgtcatggaacttaccccatgatttcttccggtagttttatagtttcagagttttcttccaatagtttcaaatcttatgtgtctttgataacttttcagttgatttttgtatacaatgtgagataagggtctaatttatttctttttatgtggatatccatcttttccaacactacttatttaagagactgtccttccccattgtgtgatcttggcatctttgtgaaaatcaattgacctcaaatatgtggatttatttctaggttctctattttgtcctattggtctatgggtttgtttttatgcttgtgccattctgtttgaaatactattactttgtagtgtattttgaggtcaggtagtgtgatgcctccagctttgctcttttggctaaagattactttgctatttgaggcatttttggttccttacaagttttaggatttgtttttctgttttctgtgaagaatgccattatgattttaatacagattgcattgaatctgtagatcgattttggtagtatggacattttaacaatattaattcttccaatttataacatgggatatctttccatttacttgtgtctgcttccatttttttcagcattaatatatagttttcagtatacagctcttttacctccttgtttaacttcattcctttatttttgtggtagcttttgtaaatgggattattttcttgatttcttttttggatatttgtcattggtgtatggaaatactatgatattttaaatgttgatttcatatcctgccactttaccaaatttgtttattggttctaataatattttaagtgcagtctttagggttttctacatataagattgtgttatctgcaagcagagacagtttaccttcctttcccatttggatatcttatttctttctcttgcttaattgctctggctaagacttccagtactacactgaatagaagaagaaagtgggcatttctgtcttattcctaattgttgagaaaaagctttcaatctttcactgttgagtatgattttagctgtgggtttgtcacatatggtctttactgtgttgaggtacattctttatatgcctaattcattgacacttttttatcatgaaaagatgttaaattttgacaaatgttttttctgcatctattgagatgataatatggtttttgtttttccttatgttaatgtacatttattgtacatttattaacttccatatggtaaatcatccttgcatcccatggataattcccacttgatcatggtgaatgattgtttaaacatactgttgaattcagtttgcaggtattttatggaaggcttttgcacctatgttccacaggaatattgacctgtagttttcttttcttgttgtgtctttgtctgattttgcacttaggctaatgcttacattgtagaatgagtcagggagaattcctagctatttatttgggaggctgaggcagaagaatcacttgaacccgggagacggaggttgcagtgagccaagatagtgccactgcactccagcttgggcgacagagcacgactccatcaaaaagaaaaagaaaatcaactcttaattttattgatcatgttaattttttttctattttctatttcatttatttctcctctgatatttgttattttctttcttctgctaagtttgagtttagtttttctttttcttgtttcttgaggtggagtttgtttatgtgtgatccttctttttgttttaatgtaggtgtttatctctataaacttcattcagaactttttttttttttgctgcatccataagtttcagtaagttatgttaccactctcattgtgtcaatatatttttagcttttctttttgatttcttctttgacctgtcagttgttcagaactgtgtttaatttacacatatttataaattttcaaattttcctcctgttattgatttctagtttcatattattgtgatcagaaaagatggtgcaatttgatttcagtcttttttgatgtggtaagacttttttttgtggcctaacatgtgatctattctcagtaacgttcagtgtgtgctttagaagactgtgtattttgttgctgttggatggaatgttttgtatatgcctttaaggtccatttaatctgtagtgttattcaaatcttcggcttccttattgattttctatctgtataatgtagttactgttaacagtggggtattaaagttcaatactattgttttattgcagtttattctttcagttctgttaatatttgcttgatatattttggtgctcaatgttcttttgttgtgggaagtcagggaccccaaacagagggaccagctggagccgaggcagaagaatataaattgtgaaggtttcatggactttcatcagttcccaaaattaatacttttctaatttcttatgtctgtctttaccgcaatcgctgaacataaattgtgaagatttcatggacatttatcacttccctaataatactcttataatttcttatgtctgtctttactttaatctcataatcacgttatctttgtaagctgagaatgtacgtcatctcaggaccactattgtaaaaattgattgtaaaacatatatgtttgaacaatatgaaatcagtgcaccttgaaaagaacagcataacagggaagataaccataaggtctgactgactggggggttgggcagaatagagccatatttttcttcttgcagagagcctataaacagacgtgcaagtaggagagatatcagtgaattcttttcccagcaaggaatattaataattaataccctggggaaggattgcattcctggggggaggtctataattggccactctgggagtgtctgtcttaagtggttgagataaggactgaaaaagccctggtctcctgtagcaccctcaggcttactaggattgggaattccagcctggtaaattctagtcagactggttctctgctcttgaactctgtttcttgttaagatgtttatcaagacaatgtgtgcacagcaggacatagaccctcatcagtaattctaattttgcctttgcctttgtgatctttattgccctttgaagcatatgatccttgtgacctactctctgttcgtacaccccctccccttttaaaatccctaataaaaacgtgctggttttgcagcttggggtcgtcatcacagtcctaccaatatgtgatgtcaccctggaggcccagctgtaaaattcctctctttgtatgctttctctttatttctcagactggctgacacttagagaaaatagaaaagaacctacattgaaatattgggggctggttcccctaatattctttccatatatagtttctattgttatatctttttgatggattaaccactttatcatacaataaattctatttagtctcatctaagtatagccattcctgctctcttttgtttactatttgcatggagtatctttttctattctttcactttcaatctatgtgcatctttaaagctaaagtgactctcttgtagacagcctacagttggatcttgttttcttaaaatacatttattttttatccacttagctactcttttaattggagaatttaatccatttgtgtttaattattgaaagataaggatttacttgtttcatttttaaaattgcttcttattttgtagggttttttgtttcattctttctcttactgtcttactttgagatatttatgattttttatggtgacatgtttcatttctttttaatgtacatactatatggctttgctttatggttaccatgaagctcacagaattcatcttaacagttacagttaaagttacagaattcatcttacagttaaaaccagtccatttttaactgatgacagcttaactttgttcacatacaaaaactacacttttgcttcttccattatcgtgtaatcataatacatgtaatatctaagctaatatgctgttacaaccatctagtttgtttttaataggttatagttttcattttggggtttgttttatctttttaaaaataaattctgatcctctggtaaaattctccattttgacatttatttttttaaagtactaattagacttattttaaagtaagtggtgtgcctatgattctgtttctaacatgttattcccctcttgtttgacatttggttctgtgtcctgtcttgcctggtaattttttaaaaatgatagacactgtgtgtgaaaaaatcacatgttcctaattaataattttctttaatataagaatttctttaatatactttctttaatacagttttttttttctggcacagttagagtagtgacaaataatactgctttactcagtgattgggataatttgtgctgaagtttagtgtctgtggagatgactatatctgttttttctgtcttcttcaggttttaccttttaagaatctcaaaagtttgttgttcttgttaggactcctaattcatagctgtctttgttgtatccctgtaactatgagattttcaaaaattcttcttagctttgttatatattgctttctgctttgtttcttaacccttcaggaatgaggaaatatttgaacataaaaagctgaaacaaatactgagtttacttctttgtatgtttccccctctgcgtatcccttgagttgtggccgtcttagtagcccttactcacttctgtttcctactacactactctgagatagtggaaagctctgatctgctgctctgtgctaaatcttttggcctacttcaattatcagttagtaaatcccttaaaagaaaagtggcagagaatttgtcttaaccacatggatttttctttctctggtttcttgatcagtaaagtatattttgccttggatattctctttttaattttagcttttatggttgcttttgctaggaagcttgttagtactaataagtatcctgtcagtcagaatcagaagtcatacgaggttgttttttaaaaagcaggtatgcattgtttctgattagtaaagttatgtgtgttttcttaggcatttggaaatacagaaaagtaaaaaaaattttaagtcattcatgatcttttttgcttcattaccctctcttgattaattcctgattatttttctgttttcagtctcaattaacttcctcagagtcaaatcaactctcatattaattagatgctattcatagcaccttattttttgttcttttttctcatattgtgttgtcatgtttctttttgtgtttattttattagcatttatatctctcattacattattagttttactgtgacaaggaccatgtctactctttctgtaaacccagtatctattacagccttaaatacagcagatattttatatttatagaatctgctgcactagcattatttctgctttgtatgcatatattttcaattaatattctattatgtatataattttcatgtgtattactgtattttctgtatttaaaaattaatttgacaacatattataaacatttattcatataaagttttgtttctaatatcagctcagtcaccaattatttgatcttggaaattttaattaacatttttagcagtcagttttcttatctgtaaaatagggaaatgataactgctctaactactcattctggtcattatcaaaagtaaatgagaccactgatcttcatggatcttgtggcacaaaagatatgggatatgaaatggataaacaataatgtcttaaactattgttaccattgtttcttgatggatattctacaaaaagtgtaaatgggctatatgatgtaaaatctatgttcactttagaactctaaggaaggcataattctttttcactatagatggagaagctcttcacatatagaatatttacaagatggcaaagggaagactgtcaggagcaattgtgtaacaaaacaaaataaagctaaaacgagatgcagctattctcattacagcaaagtaggcaataagatttttgtagagcactttggaaggaggcagacacatttgtagatttgtaataagcactgagttgctccaatttagtgcatgaacaaaaaaataattgtagttattaataagagctgagaataaaaaagacctatctaatcttagaagatttgaaagaagaacactgagacaaacagcaaaatccaaatgagacctgatcatttgctctagccacgttaagttattggcaggttatatgagaactccatctatctctatatttacagtttatttagttcttttataaaagtttttattattttcttttggtcataataaatatatgacagcattaatagtatcaaatatcgcttaaatgatttccacaaatatttctgtttccatagtaaatctctaatattaaaataaaaaccttcaaagtattgctatatatgatacatagatgagtgaactttgcttaaccatagtcaaggttttggtaagccagaatttacaaaacaaattatataatattacctacagaattctttcccacaggggtcattctttccaggtggatctcacattactacttttgaaggagaaaagtagaaaacactatgtaattgcaatgtatcaatatcaataacttccaggtgaagtaaattcctcgtaacaatgatagaaattccactttccaataatgttcatgggaaaatcctagaatattccagtgtgggatactttgttattctaccctttcgtttttttttttgttttttgttttttgttttttttttttgcttggaagatgttgcataacttagggaatggaaatcattttgccagataatttggcaataaatatatttcccacatgcttggtcttgtaaatcctatctggcaaagtagccatttaatcaatagagtaagaaaacagagatttaatctagaaagtgattgaattagcactgagtgtagaagctggacaaaagtggaaatatcattgctctgtagtttctccaattttataaatgattactaatgactaatgaaccaattgcctagttcctctgcacagtttgggaaaacagaagagcagaaaaccctctgccttgagattgctgtactgtggtgactacaagggaatacaattagtcatgttcactagtaacttgttaaatcagctttataatcatgagaaactaagaaagttatgaggagccaataatgccaaggtgataaaatatgaaggcacatttgtaaatgtgaattactcagaatacaaggtagataatttattgttgcctgttgctataataattccttactaatgagactttattaatttgtagtttgagatgatttggaatcttggctgagatttgtccttctattcactgtgaagatgagatttggaaagcaagttagcagccaaaaatgaggataatatttttgaaagtccaagtcctacattctcattctttttttttttttttaatgtttttttttttattatactttaagttttagggtacatgtgcacattgtgcaggttagttacatatgcatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgcgtgagaatatgcggtgtttggttttttgttcttgcgatagtttactgagaatgatggtttccaatttcatccatgtccctacaaaggacatgaactcatcaatttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatactcagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgatttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaagtgcctacaagagaaagcaggaaagatccaaaattgacaccctaacatctcaattaaaagaactagaaaagcaagagcaaacacattcaaaagctagcagaaggcaagaaataactaaaatcagagcagaactgaaggaaatagagacacaaaaaatccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctatgcaaataaactagaaaatctagaagaagtggatacattcctcgacacatacactctcccaagactaaaccaggaagaagttgaatatctgaatagaccaataacaggctctgaaattgtggcaataatcaatagtttaccaaccaaaaagagtccatgaccagatggattcacagccgaattctaccagaggtacaaggaggaactggtaccattccttctgaaacttttctaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcaggctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattaaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaagtctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattcgaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccttcagaaataatgccacatatctcattctttattaataaataataaatggcattattgccttcttttaacccaggcgaagaggagaatatggggcaagtctattcacaccagaagcgaaagtaataaaacccttagaccactggagaaaagaggaagagaagagacaaagggttcaggaagtgatggagaagaggtgagacatgaccagtgttgtgctgacaaatgattaacacttgcagcatttgataatttttatggtgtaatatctgacatcatgaataatttcaagttaccagcctgatgtcattgaaagtagaattagaaagataaaatatacacaaataacctgaagggcatagatattagtaaaacctattttgttagtaaaaattggtaaaaatgtattaaaattattagaatatggtgaattagagtttttattacttttgtttttaatataattaatttaaattgggttcataaaatttaatttaaaataacttacgtgtttaacagcaggctaataacattcctaaaaatctaaaagtcaacttctttgaatttttgttgatacataatgtttgtacatacttatggggtaaatgtaacattttgttacatgcatagaatgcataattatcaagtcagggtattttgggtattcatcatctggcacatttataatttcttttcttttctttcttttttttttttttttttgagacggattcttgctctgtcgcccaggctggagtgcaaatggcatgttcttggttcactgcacctccacctcccaggttcaagtgattcttctgtctcagcctccccatgagctggggttacaggcccgtgccaccacgcccagctaatttttgtagttttagtagagatgggattttgccatgttggccatcctggtctcgaactcctgacctcaagtgatccacctgcctcggcctcccaaagtgctggggttacaggggtgagtcactgtgcctggctgagcatttatcatttctatgtgttgggaatgtttcaagtcatctcctctagctattctgaaatacacaatacattgttgttaactatagtcaccctactatacactatatatagtatatagtcaccctactatactatcaaacattagaacttactctaactgtatgtttatacccattttccccatcccccacccctcaaaacacctccacacctttctgagcctctagtacctatcattattttatgtctctctataagtttaatgatttttagatcccacatatcagtaagttttattgttctgtgttttgataatagcagatatcttcctttcacttctgggtgttggactccctgaagcatatctttcaggtctggtttagtggtgataaattccctcagtttttgcttgtctaggaaaggctttatttctctttcatttatgaaaggtaactttgctggatatagtgtccttgtctggcaattttcctttcatcactttgtatatatcatcccattctctcctggcctgtagggtttctgttgagaaatctgctgttagtctgtgggggttctcttatatgtgactagacacttttctcttgatgtttttagaattcattttttgtctttgacttttgacagtttgactataatgtgttagggaggatctttgagcttcctgtatctggatttctaaatctcttgctaggcttgaaaaggtttttagctattattttgttaaacaagttttctatgccatggatcttcattggtcaggctgcattgttagtggaagctctggtgaggttttgctggaaacagggacaccagtccagttttgttgccccataggtgctattggtgggccaagaatgcctgttcttggacccctgagcagtgtacacagccactggtggtagcaggtttaggcaggccaattcttgagcctccaggtggctttcttgggtgccagtaggagcagctgtggatcaagcagatgggtgagtccttgggccgctgagcagcatgcatagtatgggccatggcagtagggtggcgggataactcttgggctttcaggcagcattctctggtattaatggtggctgtgatgggccaggtgggccattccccataccctcaggtggcacatgtggatgctgatgttggtggtggcagcaggctgggctgacccatcttcaggcccctgggaggactgcacagataccagcagtggtggacagggtgaggcaatcctcaggctttcaggcagcatgcttgagtgccagctgcaggttttctgggcttgtggttggggcctctggtggtgcacacatgtgcccagagtgaccgatggggtggggtgataccccaggtcccttagtggctagatggggaataccaggtgaggtgggcttctctttaggtctcccctccatagtgtgcatgggtataaggtgtagtgggcacagtagggaagtccttaggtctccaaattgcgtgctcggatgaccggcattattgggctgttattagagcccctgatgctatgtgtgtgcacctggggtgacttacagggcaagacaacttcccagatctttgggcagcatgctcgcaggagtggtggtggtgccaggccaggtgtgcctgtcctgaggcccccagtggcatgcataggaataggctgtggtgggcaaagtggggcaattcccaggccctggttggcatgccccagcagcagcaggctatcctcagcatgtatgcaagtgtgtggcaaccttgctgctggaggcggggtggggttctgccagtggcagccagtctaggtaggtggctctcaggctctgtggagctcatgctacagctctctggcagtgataacagcagtggtagtgggtgggaagattctaacaataaaattttatgagcttatataagctggcgctagcacaccactggatcttggcttcattctctttaccagggttgagcccctgggagatagtaaaacatgtccaaataaatttggaggaatcaaaaaatattgtacattgaactgtgattccctggacatagactaaagactttacgggtcatgcagagaaaccatgaattcagaatggaccacaagcagcatggttggagaacaagaaagcagcaatgttggaggaagtgaaaggatatggggtaatatttcaaatttcataaagcctacttgtggtttccacaagctcagtgtgctatatggggtgacaaaaaattgtgagaaaattcatggaacagaagagacattaactagatggtatgataggaaatgtgggtttcaaagtggatgctactacatataaagcttcaaaagaccagatagcaagactggttcaatatggatattgtttgaggatgcttagtacttaggtaggacagaacattcacaatagcagccagcacagtgtgaaaagacagctggtggaccagtgtccccatcattcctcttccatgagtatttggatgaatcttgaaaaggagaaggtaaaataaaaaaacctatagcaagacaaaaatagtcctaagagggagcttaagtttgagctcattatatagttaccttgaataatattaattgaaaagtttaagacttttttcctcattaattggcataggagcagaaaggaaaaaaaaacttggagaaaataaagttacatttttggactatgatatggtttggctgtgtcctcccacccaaaatctcatcttgaattgtaatcaccataatccccatgtgtcaagggtgggaccaagggtagaggtaattggttcatgggggcggtttcccccatcgtgttctcatgatagtgagtgagtctcacgagatctgatcatcttataagcgtctggcatttttcctgcttgtactcactccatcctgctgtcctgtgaagaaggtgcctgcctctcctttgccttctgccatgattgtaagtttcctgaggcctccccagcaatgtggaactgtgagtcaattaaacctctttcctttataaattacccagtcttgggcagttctttatagcagtatgaaaacagaataaacagggtacatctgagttctagcaaaagttacattttagaatacatctgagttttgatttctctgtagttagcacacattatatggagaatgttttcttaattaagaaattgttttcaaacatctttatataaattatgtttcatttcaaaataaatttctagccaaaatttttctttcaattctctcatgtttgcaataaccttagaaatcccacatttaggctttcctgtcacctccagaatggtacgtcaacagatgaatggattaaaaaaagtatgtacactcaatggaatactattgatccttaaaaaagaaggaaattctatcatttacaacataaatggaattgaaaaacattatgctaaatgaaataagccaagtacagtaaaaaaaaaaaaaaatactgtgtggtttaacttacatgtggaacctaaaacaatggaactcatagacgcagagagtagaatggtggttgcagaggctggggatgggaggaggaatgggaagataatggataaagtatacaacatctcagatgggagaacttttcttttcttttgagttctattgtacagcttggtgaatatagtgaataataggatattgtacatttcaaaattgctaagtgactaagtttcaaatgttctcatcacaaaaaaagttaactatttgagatgatgacatgtcaactagattgattaactaggttgatttaattattccacattgtattcataaatcataacatcactttacctccacacatttataccattataaattatctattaaacatttttattgtgtgatttttatgttgacactcatatctcatgatttgtgagcacattttctattattttgtgccattacaggcatttcaaataattgtttacttagtgatttgttatgttaaaaaatttttattctaggctctttaaacttgtgtagtgcttcataataatccattaggctttttgagcagaatttcttgaatctagctgctttacacattttttttaaagttctttttgatttataaagtttctttgggaacaatgagactagttactaagctagacatgactgttattacttagtatatccttcgcagagtgtggatatagcaatagctgtaggtggtctgtcatatctccttagctctcacttctacacaccaaagcctacttaatgaaatctctgctactctctgcctgaaggctttttaacagccttggggaaactcttagcatatgtaaaaggcaatccagaaataacagagagttaatgatgctaagtagcactcaaacttggacagctggggaggtggtagaaaaatattctcactttctctttcctcagttggagtaactctgagatgtgttctacattgtcttctaaatgtggaattaagtcacatttgcctacactaaaaaccaaggtcataacacacaatattgtcttcatttctttcccagtcttatcaccttccattctataccattaattcttggatcaccatccatgtaaactacatttatctctttgactcaggacctgcttttgagaaaacataatctaatattaaaagggagtcacaactatagaaaaagatacttttgaacttaatgtgtgaaaaataaagttttataataaagttgcaaaagcaacgttgtaaatatgaacattctaaaccaaataacttattataagttcctctcttctttttattacgttttctttcttttgagacaacaataacagcagcaaaagctaaaatttttatggtgtttagtagttccaggacatgctctaaatattttacacataaaattctgttaattcttataacatctttatggttggtaggtgtatgataatggtaggcatacagagaaaaagtgataagttgaatttcatgcccaggatcatacttcacaaatggtaaagactgggtctaactcaagcagtgagatttcaaagcccatactaataaataccttgctatgtagcttctatgcaacctaatctgcaactattgcttcaataactacctgcacagacgtggctcccaaatttataattctaatctatgccttgtgtctatgaccctccagaactgtcaaccactgtcccccttggaaattgttcttagatgtccccaggggaagagcacttcaaagccaaggtattaaaagtcaaacacattttttttttcctttaaatgtgattctcttctacataataaactttagttaatatcacaaaattcaatgagtgaatgtagaaaggatcaggatattaccttatcttcttaattttctgagagttttaaatcatgaatgagttatgaattagcaatgaatttttctgcatgctttctctgcatctaatgaaatgattgtatggtcctcattttttcagttaaaatggtgaatcatgttgattgattttttaatgttaaactaacctcacattcctaggatttattgcacttggtcatggtttattttcctttttgtgttttgctgaattctatttgttaacattttttataattatttttgtatctattttcattagtggtctgtgattttcttttattgcagtatcttgtctcatgttggtatcacagtaatgctgatcacataaaataagttgtgaagttttgccaccttccctacttttctgaaagagttcatgtaacattggcatttttttcttccttaaaaatttaacagccatgtgtggtggctcacgcctgtaatcccagcactttgggaggccgagatgggcagatcacctgaggtcaggagttagtgactagcctgactaacatggtgaaaccccatctctatgaaaaattagctgggcgtggtggcagacacctgtaatcccagctacttcggaggctgaggcaggagaatcgcttgaactcatgggtggagattgcagtgaactgagatagcaccattgcactccagcctgggcaaaaagaaaaaaaaaaatttaacaagattcactagtaaagccatctggaccttgatatttttttcctgtgggtaagtttttagttaacatttcaatttctgtaccttaatttgcaaagtggctttcaaaaaaaatcacaatcagttattgagttctatcaaatgcttttccttcatcagttgagataatcgtattattgtctctttattgtattaatataggaaattacattgattgatttttttttaaatcttgaaattaaaaacttggaaacctggagtaaacccaggttagttgtcatgtattatctttttaaactactgaaaatccttgcttgatgatattttgtttaggagctttgatatttattcatgagagatgttgacctatgattttccttttttaaaagtaatgccattttagtttggatgtcacaattattctggcctcctaaaatgaataggaaattatccctctgaagaaggtttccttccctttaggagggcatttagagtagaggtagatcatcttaataccctcgaaggtagagatgagttgaagaattagtctttgacaattcttaacttgtcaaagttaagacttaaacttgactcctatgatgtttaccagggcctccttttcggcaagccatgaactccaaattttagtcccagtctaaaagtctgctactctcttagtatcttggtgctacgtttctcttggattccatgcctcttggcttctttgctgttagatctctgtttctaggccattgcttgtaaatcaacagatgcctccaggttaaaagctggccaaatgctaggctcatttctgtactttgcttctctctaggatcttgttcttttacatcctcactgatgccttcacacagatgtttttgaaattgcatccaactattctaattattcttagtgggagtgctgttctgataaaagcttctctgccatatgtgcaggcagagagtgtccaaagtaatcttcaggtgcaaaaaaaattagtcataccacttaaagcaatattagttacatcagcgtgacagcacagtcataggtgactcattgggccagggtgcatctaactaggagtttttgaaaaagcctggagatgctgtgggcccataaaccagtccagggcagtctaactctaggctgtttctttgtgagaaaaagacattcttatgtgtttatactgttgttgttggatgtctactcccagcagctaaatgcaattcctacttgattgagaagagggcaagacaaacaaacttacttgatgaggactaaaatgatgactgtatgtttgagctagaaaaggaaaatttgggataaataagagcaatacatctttaccttctggggagtaattcagtaaaatatttacctctagaagtaacataataaatttatatggttataaaatcagattcagaaagttaaatctgtgcaataatgacagatatcagttaagtattaataataaaaattttggttagatattatactctgatcattacttagatcaaatgtgagaaaacctgtctttccttgtgcctacatgccatataaagtactaggctgactgggcacagtattaggcctagattatgctatgtttatgctgattctacctctctaaataagccaattcaaggaagtcctagccagaacaatcaggcaaaggaaaaaaaataaataaaaggcatccaaataggaaaagaagaagtcaaactatctctcctaattgacaatatgatcctatatctagaaaaccctaatgcctcctccaaaagtctcctggaatgacgtcagtaaaattttagggtacaaaactaatgtacaaaaataaataacattactatacattaataatgttcaagctgaggaccaaatcaagaatgctatctaatttacaatagccacagaaaagtaaaaataaaataaaatatttagaaatatacctaaccaatttgggtggatcatgaggtcaggagatcaaggccatcctggctgacatggtgaaaccccatctctaataaaaatagaaaaaaattagctgggcattgtggcgggcgcctgtagtcccagctactcaggaggctgaggcaggagaatggcatgaacccgggaggtggagcctgcagtgagccgagatcgcgccactgcactccagcctgggtgacagagtgagactccatctcagaaaaaaaaaaaaaaaagcaatatatctaaccaagaaagtgaaagatctctacaaggaaaacttgtacaagtgaaaacaaaatactgctgaaagaaatcaaagacacaaacaaatgtacaaatattttatcctcatatattcaaaccaaaaaagagccagaataagcaaaaaaaacaaagctggaggtattatattacccaacttcagattatactataaacctatagtaaccagaaaagcatgatactggtacaaaacagacacatagaccaatggaacagaacagagaacccagcttgtatgcctatagccatttaatcttcaacaatgttgacaaaaataagcaatgagggaaggactccctattcaataaatgatgctgagatagctggctagcacatgcagaataatgaagctggacctgtatctttcaccatatacaaaaattaactcaagttagcttaaaattttaaatgtaacaactcaaaactatgagaatcctagaagaaaacctaggaaataccattctggacctcagccttgggaaagaatttatgattaagccctcaaaagcaattgcaacagaaacaaaaattgacaagtgggacttaattaaactaaagagcttctgcacagcaaaagaagctatcaacagagtaaccagataatctacagaatgggagtaaatatttgcaagctatgcatctgacaaaggtgtaatatccagaatccattaggaacttaaacaattgaaggagcaaagaacaaacaacctcattaagaaatgggcaaaaacatgaacagacatttctgaaaagaagacatgcaagtggccaacaaacttatgaaaaaacattccacatcactaatgatcagacaaatgcaaatcaaaaccacaatgagataccatctcacaccagtcaaaatggctactattaaaaagtcaaaaaccaacagatgctggataagccgtggggaaaatggatgcttatacgctgctggtgggaatgtaagtagttcagccacagtggaaagcagtttggagatttctcaaagaactcaaaacagaactaccattacccagcaatcccattactgggtatatagccaaagaagataaatcattctactaaaaagacacatgtactcacatgtttgttgcagtgctgttcacaatagcaaagatatggaatgaatctaggtggtcatcaatggtggattggtatatatacactgtggaatactatatagtcataaaaaagaacaaaatcatgttcttttcagcaacatagatacagctagaggtcattattctaagaagtttaatgcagaaatagaaaactgaatactgtatattctcacttctaagtagtagctaatcattgggtacttatgtacataaagatggaaacaatagacactggggactactagaagggagacagaagtaacaggacaagggttgaaaaactaactattggtaccatgctcagtacttgggtgaggggatcaatggtaccccttacccaggtaacaaaactgcacatgctttccctgaatctaaaatacaagttgaaattacattaaaaaaaagtcagttcaagtttttaaaaacataacaataatacctgagtatttctttttttcccaatagttaaaataataacaatttaaatgcttgtaaatactgaaaatgatagtagaactgttatatttgtatttgctcctatagatatccaacctctactttactttgatgtagtaaatcaactttaattttaaagctctaattttgagagccacagaggagattttctttcatccataatctttctgctataaccttcagcaaagcataagagaaattaatgttagggattagccagatgtgttttgaatattggctaaattgttttcacagctcaatctatcataccttcggctttatttgagctctcccttgctgatgagctgaaattctacatgtgggtaaaaagtgtattttatctgaaagccaggagtcagaactgaataaagccatggatattgattattcctcattaactttgagttctcagagcaaataggctcatttcagatctaatccatactatggacagaatgactaacttacaggagtactcataagaaaactgacaaaaatgtgtttcagagtcatgtttaaaaaaagaaaaagaaagaagaaaggaaaacatggatggacagcttttcataaataatgtactaccctcttaaatggagataattatatgctccaaattctttgggtgggtttagatttggactttttcagctgcatgcacagagtcaattccttcccaccttgtggtcaacagcttttaactagggacaaattatccatagttaatggtatcgggggaatttaatatgtggctccggctttgcagcgtcacaccctatttaacagactagactatatattccagaatggaaaattccacctccactctcaccctaggcttgaggagaaacttgaagttatgttacccaatagtggcaccaaactctgcggaatttgcatatgtcacataaccttgtgggtctcagctttccatcctttaaaattaccggcatgagttagatgatttctaagcacgtttttagagctgttgtctacctgtggtcctagaattaatgattccactccacaaatgtcctttaaacttaatttgtacccagttatattttagaccctgggatgaaaaaaatgaaagttattgtctctatcttctctgtcccattcatgttgggcctagtcaatggaatgtgaactgacctgaagtacatcatatctgagcaggatttaaatgtcctggcagagtttgatttggcttcttgcattcctattatccactatacacactatataaagtggcccccaagagccactggtcctctagctgggacctagaatgagatcacatagagtatagccaagcttgagcccagatgaccccaggtgagcccaggtaagccacagtaaaccttcagacttgtgagcaaggaacaaatatttgctgttgtaagccactgagattgtgtagttgtttcttgctacctcagaagctgactaatatagtggtttattatttagtaggaaagagatgtcaccttcccagaaataattttagtgtaatgtgaaaagattctatgtttaaagcctttcaatatcttaatttggtataaagaaaataatttgacacattactttttttgtcaatcgtttgatcagattattttctctactttatatctgaagaccttgaagctcagagatgatttattactggccacaaatcacccatcttgagtgcggagaactataataaaatttagaatctctgagttttgaattgaaactctaggtccatcttacatattattctcctgcctctggcataagtattttagttattatgcattgaatcaggtttacatgcaagttcttaaataaattgacaacagctgattcaggccaaaaggaacttatttaagaaaaggttgagtagtccaaataaacaacaagcaggctgaaaaatctggataggggcagcctgaaattgtaccccaaatcatcccagaaccatatatatatatatattttctaccaagtaccagatgcaataggttggatcactggcaccactggcactagacattgaatgctattgctgttattagtgtggcaggcatattgtccttgaaaacttgatcttgttgccaccaaccctgtagtcatgaccaaagggaattcttcctgatatcctcctctttgtgtcccttgccctagaagaaaagtttggaacagctgaatcttaggtcaaggacctaggtcttcgaattttcagctttatgcttacactaagaagtttctcccaagttaagaaaagggttctgatgctagagagctaaaacaatgacagacgctaggcaaatacaaaatatatttttgcaaatgctcttcttgaagctgcaatgtaggacagactaggctgcgtgtgccttcctttcattctgggatactaggtagttcagggattttactgtgctggagtctctgcatcaaggctgggtatatgggaaatgcaaattttatctgtggttagaaacatgaagcaaaaagcaagtaaagtctctgctaagggaaaagatatggttgggaaataaaggggctgtaaatgcatgaaactcaaggagagaggcaagaagctaaatccatatcctaagtaaaccttatggcaaaagattttatagcgtggctatcttttccagatgcttgggccacatgtgtgtacacagatttgttaaggtaatatgcaaattcagatacctaagaccatttaaaggtggtttgcaaatattctgtgattcactttcaaacttggccctattttaactaatataaatagacattcctaaagcattggaaagcatgagcattgtgtattcaaagaaatatgttaacctcatttggctggtagagattctggaaacaagatgtaagccaaaaattaaattcttagccttccaccagtctgcatggatggcccccctccttggccaagaggatctcaaagaaaaattagttcaggccttgttgggaggggaggtcagttatgcctcattatacccctccctttggagttgaggcaaaactgaccagcactaacattaaaatagagaccataagacctacaagacagactctttgtagcagtgagatacccaactccaacctgattctgatatagatagcatctaatgacagatagcaggtcctgaagaaaagaaaaatattttacctcaaaatgtaattctttgatgtattttgaaatggccctgcaaagccatctcttttgggagaattttaccttctgtagagagtctccttccctttccaggtcttttcctgattcaggggaaatttaagagtttgataccttttaagttctgataagagacatttaccatctattctttctgaagcttgctacctggaggcttcatctacataacaagaaccttggcttccacagctccccttatcttaactttttcaaccaattgccaatcagaaaatctttgactccaccgttggcatgtgagtgggctgaaccaatatatacctcacatttattgatttatgtctttgcctgtaacttttgtctccttaaaatgtgtaaaaccaagctgtaactcaaccaccttgggcacatgttctaaggacttcttgaggttgtgttccaggccatggtctgtcatatttgagtcatatttggctcagaataaacttcttcaaatatttttgaagaggggaagaaggcatgggcttgaattgaaatctgattatatgttaagaatgacatgtaattgttttaagcatttgattatgaagtcccttggtatacttttcttcatttatgttatgcatgggatttttcctttctggctggtaggaatataaacatctccaaccttgtttgagctctgtggttttcacctgtaatccaacctcttgggtggttctttgctgggcctcaggtggtttcctcatacctgtgagctgactgatactcacccaaaggctggaggagggccctcaccaaatttttatctcataaatctctctctgtgtagctctctcctttttgttaccctgccctgtgaactctagttggctgtacatccttacagtcccaagtctgttttcttaactctgggagactcccaggctccacttgggattttcctccttttcttgaggcctaaaaacttttatcaaggctgtaaactagggcaattgtaggacccacctaatttgttttctctctcccaggaatcactgctctatagagtgtagggtccaatggctgaaaaaccattgttttatttagcttgtttttaggttattttggattgtccttgttacgctttcttgatccagagtggaatgtaattgtacggataatatgtgctattgtttatatcaacatcaacaataaagaaagtgttttttaaaaatatggtatttttattgtaatttctccaaagctgtaattaaattgatagtgcttcctaaaggtgtttttgagttgtaaaaaatacattgtatgcaacagtgaaaaaatattttgataattatgcccaaaaggcaatgtgtaatttgggattttataacattccaagttctctaagtatagatcccaaccttaaaagttgcaaatatgggcaaatttcacacagttggccttatttattaatagtacatgtttctaggaataacttatgtataaaagtacgttcctgactgcaatatatataggaaaaaattattacatagaaaagaaagaatagttttggccaggcatggtggctcacacctataatcccagcactttgggaggccgaggtgggtggatcactaggtcaagagatcgagaccatcctggctaacacggtgaaaccccatctctactaaaaatacaaaaaattaaattagccgggtgtggtgatgggcgcctgtagtcccaactacttgggaggctgaggcaggagaatggcgtgaacccaggaggtggagcttgcagtgagccgagactgcaccactgtactccagcctgggcaacagagcaagactccatctcaaaaaaagaaagagaaagaatagttttataatttttgtcttctccttagctagtaaaatagagtttctacagaagtacctacatgtatagcctccatttcttaggtttaattaaaatattacttatagattatatcaccagcctcattatatagctaccaagtggagagtgaagagaaccttgataactccctttacagaaccttcacaattattctaattattatctgatagatcagagattaccactgtgtatttcagctcaatgtaaatgttaagtgatccctatagaaaggaaatcataatacagtgttggaatagactttaatcaaattgacaacattttatctttataaaattttaactgaagaacagttgcaatccagaaagcaagatttacaggaagcacacagtgactagtcctgcaagagtttatgtgacttctgctactatggatctcagtgaaagcgttttagtctcctagataattttgcaaatgagtagacaggtatagagggattgtgtcactttaaattttgcaagaaattggtgaagacccagagtataatgcataggtgctcatgtctgattcctggtcatccacatcaacttcccagagaacaaatgctttgaggggccaactagaaattaactttaaaaaaggataagagtcttggccaggcatggtggctcatctctgtaattccagcactttgggaggccaaggtgggcagatcacttgaggcaggagttcaagaccagcctgaccaacatggtgaaaccctgtctctactaaaaatacaaaaattaggcgggcatggtggtgggtgcctgtaatcccagctactcgggagactgaggcatgggaattgcttaaacctgggaggcggcggccgcagtgagccgagatcgccccactgcactccagcctgggagacagagtgagattccgttaaaaaaaaaaaaaagataagagtcttaacatggttacacaagatccactttcattctttcatattcttggtagaagggaaattggactctttgggctgcaagtaacggagacaagggcttacttataggaaatatatatagtagtacaagtgtgtcttatggaatcaatgacagtcatgaagccaagccttgggaagggactctaatcaggaaataggaaactgtgaagcctgaacatatctccacttctctctgcctacaatatgcattcttatacctgccctgattggcttttgatttttgtggtctatgaagggaagacaatgtttcacaactgaatttacgtgctataggtctgtcaaaagtaaaaacaaattggcagttccaattcttaattcccagagaagggaatatgagtggccagcttggtcaggagttgacctgtggtccaataaggagattatattactgtaaagagcttatttttatagttcagcctctacagagggaatagttcccaggtaaggcaaaatcattgtgaaaagatgtctaagcatctgtgagtggagatgtgctaacagaaaggaagtatggggttacattcccaacttttgacaagttagtatcatgaggttgctgtgcagtgagagcaaatgtcatgttagatgtaatttggggttaagagtcttagattcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtataggatagcattgggagatatacctaatgctagatgacgagttagtgggtgcagcacaccagcatggcacatgtatacatatataactaacgtgcacaatgtgcacatataccctaaaacttaaagtataattaaaaaaaaaaaagtaaaaaaaaaaaaaaaagagtcttagattctacaggcctcaggctggactgcaccacccagactgctaagcttcccttaacgtcaccttttcagttactgaaatcagagggccccactgctgagagaattttgtggtttgatgacagctaatctttgtatcacacaggggtttctcaatgttggatataagttctctggcataaagcttgcctggttttatgttacgatatcctgcctctaatgacctcaataatgttgccaactgcaccgtattccaagccaaccttctttttttctggaatatctgtaccttacgagcagattgagtctcttattagacagattgaaggccagccagctccttgataaaagggaacacattttacaaatgggtaaaggaacaattgcctcatggtgcaatatcagtgggaggttcccatacccactttccatccccaagtccaatgaggtgtgttttgttttctgaatgaggtaggctttctgcagtttggatgaggctttcatctttgtttacactaaaaatactacagagagtacttccaagttttatttatttatttattatttttcaacttttattttaggttcagtgattacatgttcaggtttgttacaacggtaaattgcatttcacgggggttcggtgtacagatgattttgtcacccaggtagtaagcataggtagttttttgacctttacactcctcccaccctccttgctcaagtaggccctggtgtctattgttcccatctttgtgtccacgtgtaagcaacgtttagctcccacttataaatcaaaacatgtagtatttggttttctgttcctgcattaattcacttaggataatgacctccagctacattcatgttgctgccaaggacattatttcattttttcatggctgcatacctttccgtggtatatgtataccacattttctttatccagtacactgttaatgggcatctagatagatcccatgtcttgctattgtgaatagtgctgtgatgaacatatgaatacatgtatctttctggtagaatgacttattttttggggatacatacccagcaataggactgctgggttgaatggttattgcacttgatgaataaagtgtttgggagtaggcttcaggcttctttagctttaaggaagggttaccactatgaaagtagaagccatcggaatagaaagccacaaacaaccatatcacatctactcacctacctgcttttgtaggcacatactctgccctccctgttgttaacagtctattctcccatctaaggctgacatatatactacctcccagccccctcatgctgaattaggaagattccaccgacatattccctttttatttttttggctaattatcaaattttcttgcttttctggattgttcccacctacatgtatgtatttgatattatttacttaaaagaaagaaataagcttaacaaccatcagcataaattttttaaatcaaatttaaaatttcacatagaaaaaaatctttttacataattaactcatttttttctacccaatcataaaactttactttttatgacttaaaaacaacaacaaagaaaaaacccaccaggcatggtcttcacaagcaaaaattaaattgctttaatttttcttattattctataataacatagtcttggtattatctaaatgttgacttaaagctcttgttaatgtattatgaggaaaggaaacataaaacacatttgaaagtcattattattgcattgctgtacagatctgaaaattcaaaggtgacttgtgaagtcaaatttcataaacttctttattctatatgaagtgaagaaggattctgacacttattcaattgttttttgtttttatttttggctgaagtatctacactgtagtaatttcatgatttggtttaatgattttattagctgaaatatgagacaaccacatttaaatgaaaataggaaggttatatgttaacagaaaaagtttctaactggaaggcagacatgcccttttctaaatgtcagatcttggaacccagtcatttaagtgttttgatgctgtttgagtccaaaaaatatttttgaaagcttcaaagaatttacttatattgaacaggtcttagagggaaagacctgttgaatgaaagtaaccacatctatacgtactgtattagcccattctcatgctgctatgaagaaatacctgagactgggtaatttataaagaaaagaggtttaattgaatcacagtatcacatagctggggagaccttaggaaaattaacaatcatggcggaaagcaactcttcacagagtggcaggagagagaatgagtgcaagcaggggaaatgccagacacttatagaagcatcagatctcatgagattcacttattgtcatgagaacagcattggggacccaccccatgatccaattaccttcatctggtcccacccttgacatgtggggattatgaggattacaattcaaggtgagatttgggtggggacacagaaccaaaccatatcacatatacagtgagatcaactaacatgtttatgggttttaagttcactaataatgaactggagtctgggtcactgtcacagatgagaagtttcattttaaaagctttaaaaaagagaatgtaataaattggtgttgcctttaggggatcttgctctaatgtacttgaaaacatttacttattcaaattcaaaatgattaaatcaaatgtttgatgaaattatgaaaaagatataaatctaaccttagttcttcttaatggggaaacaaagagtaaaaatagctggcaaagtgtgaactaaatacgtggcttattttactttgcattccttggtgaatgtatatgggtttctagaatctcttgtattttattccattgttaatataagcaatgatgtccaggctcttgacaaatgttaatttcaattttaaattctatttttcaggtcagtccaatgccattaaaaactgcatagttgtcccaattttcagcccctgaaattaccaaaaaaaaaaaaaaaaaatctctgttttctgagataatagcactattttcctacaacaagacttaaactgttttcagcacattaccaccttaaaaaaatcaataaaccccttggcataaatattgagaatttaaattaccaattgcttataagtgggccttaactctaattttaggaagaggtttctgtttcctaattagttcattttattggcctgaggctgcacttaaaaagaataaaattatccattattttttcctaatatctcccaaatgtcgtacctattaagaatagggacaccgtcagctttcagctttcaataggggtgctgttggcattatgatgcgtcagttcttccttaaaccagaatgtctcacagaaattgaggattatttggcatgtctggcctgaacccactaaaagcctgggctgtccccacacatttccaaatgtcctgtagagaacaaaccactctcagctggaaatctaaacacctctgaggagaaagaattgttttattcaatttatctacttattatccagttatggataatgatttctaggttattcatgagttgcagccaaagcttcctatagtttaatttttttcctcaaaagtaattcagatgaatattttgcttttcgtccactataagcttattataaggtacaaaacacaagttgattattttttaaattttcatttgcctaggcaaatgaagtggtaacttgaacacacacacaaacacaccacacacacacacacgccagctttgtgacttagttacataactttcttcagaaaaaggacatactacaaatattggaggcacagactttcaaacacgttatatcaaaacttgtaattagtgctttcagatcccttctcttcagtaaatccagaattgttcagtaaaaacaaacaaataaacccccccccaaaacaaacaaacaaataaaaatgctgcaactgctggcgcagtggctcatgcttgtaatcccagcactttgggaggccgaggcggtcgtatcacctgaggttgggagttcgagaccagcctgaccaacacggagaaaccccatctctactaaaaatacaaaaaaaaattaggtgggcatggtggctcatgcctgtaaattccagctactgaggaggctgaggcaggagaatcacttgaacctgggaggtggaggttgtagtaagccaagatggcgccattgcactccagcctgggcaacaagagtgaaactccatctcaaaaaaaaaaacaaaacaaaaacaaaccaaaaaaacccctgcaacttctctagtcttaaacacaccagtcctatagatggatactgtgggtaaggagaaacagaatgaatgaaaatgaaaacatgaacaagttagatttgacaaaattacacttcaattagtaatgacaagatactacacaaaggtttgttttccaaatgtgaaatctccattgacttcacaaagacattgtcacacagcaatcacatattataaaaagcaccatcgcaaatgtacccaaaaccatattctataaaactgaactactgcctttgtaaactttcatctggaaatcttttaaccagccatttcaagaagcaccaacctcatatgcatgcccaccaattaaaaaaaaagaagaaaaaagtagaaaacttactatgcatctatgacttgaagaaataccagcagatacttcagcacatcaaaatccaagtccagagtaactggtttcatatttcttattatgagctctcagcaggaatcttactatatgatgaaatatttaagctagaaacatctctctttaaaagtatttcagtttttaagactcagtttcagaataaaatttaatgaatgttatgttgaagacatacaaaattaagagagacgggtatattttag

SEQ ID NO: 2365 - DNA, 73443 bp, Homo sapiens
  source 1..73443: mol_type = genomic DNA
agggagaggcagagaggcaggcagcctgctgggctcttcctgctgttgaaaacttacccggcccttacagaggaaatcttcctcctctcttctgccctgaatgttttcccaaacatgaaggtaagacaataaattcattacttttgtaaatgaagctatcttttcaaatgaacgggggtaatataaatgtaatttaaacgaagaggtgtaatacctaactgaaagacatcaaataaatagaaggccagaggaaaatacagaagaaaaagacctgggggtgatgtttagaaatccttatttaaacatatttaacagttcagccaaagtgaattcctttttcttatcttgtggtgaaattataggtccagaggtctgggaatcaggaattggagacaatgtttatgaaagtcccgataaagtcataaagaaatacaatagtactattgttatttcttgggaaaaactttcctctggtgtattttttttttttttttttgcttgtttggattaggagccatgcagtagggtcctgcgatttatctaagagctaatagaaaagcaaatttgcaggcttggaacttgagaatttgaaatcctggatgaaagagtcagcattgtgagaatagaagatatgagtagatggaataaaactaaaggtctaccaagtatacatgttggcccaatgcaaaaaggccaaatattaaaaaacaaaacaaaacacaaccaaaaagctattcaacaaaagataagaccaaagatagaaatcgctatcatagactaaatctctggaatgcaaaaataagttgagattgctattcaaattttattattgtaaattttggtatttaaactttaaaaatgttgcattgtaagactgtaggaataatttcacagatctgtcagtggctagattgcttccatagtcactgtattgtccattggggcaccgaatccaagctcgctcattattggggttagaggaggagcaagatatggatcttgattaagccatgccttctgtgaaattaaataattaaaattaaacacaaataacaaagttaatttgtttaaagttatgatgggcagtcataaaaaagaatgaaatcatgtcctttgcagcaacatggaggcagatagaggtcattatcctaagaaaattaacgcaggaacagacaatcaaataccccatgttcttaatttttaagtgggagctaaatattgggtactcatgggcataaagatggcaacactagacactgcactccagcctgggcaataaggtgagactctctctcaaaaaaaaaaaaaacaaaaaaaaaacaagaaaagaaaatgatgctcttctgaaagttatctagccaaaatgttttttcctaatatttgtgttaactattaatcttttactttattttacaataagaaatcttaataattgctttgtgcttaaaaacatgtttacaatcattattataatattttactgctgtaataataaatatacttctatcctttaattagttgacaaaatatcaacaaataaagcaattaattttttaaaaattttacatataggggctttccagcaaaaattgggaagcctgatagacaagttctaaaacaactgtaacactaaagcaattatttcactccaagtcgcatgtagagttcttacctgtatttgaaagtggacattcatatttttacagtaaacctgaaggacatgctttggtgatatgtgacaaagaagggacacttgtgaaagccttgggctatcaagaagctagaaatggtttctatgtcagactttttaagaggaagcaatgttttggccccacagcccccacgtgaactaaattcagagagacagtcacaggattccctttggttctctctgtgttcttggataggaaataacttggatctgaggtgttggagaaggatgtcagggacaagggacttccctcggagctggctgtggcccagccatttgttccgtccctccaggagagagctgagcttggggcctgtgaatctagggaatggtcgtcacagtgcccaagcacagtgatggtcaagcacagtaatgtctcaaatcaggattgtagctgggacatactggaagaaggaggtagagctaatgctcattcattgatgataaagaggagaagataattcaggggaatgtagttccagcttagctacattgacacagaacaaaaataccacacactttttctttctttcttttttttttttttttgagacaaagtctcactctgttgcccaggctggagtgcagaggtacgatctctgctcactccaacttccgcctcctgggttcaagcgattcttctgcctcagcctcctgagtagctggggctacaggcgtgcgccaccatgccttgctaatttttgtattttttttttttttttagtaaagatggggtttcaccatattggccaggctggtcttgaactcctgacctcatgatccacctgccttggcctcccaaagtgctgggattacaggcatgaaccaccacgcccggccccacatacttcttcaaccaagcaattcttttatagagtcagttcagatgtatgtctatcactgtcattcacatgatttatttgtgtttgttctatctctcttgttcatttataaggtattttttccaaaggtaattatcctaaggctagccaaatttcaagaaatgcttttggttagtagattcactttgtataacatgaacagaactggtcttgtaataagcagaccttgatgggttataatgagtatgtatatgaagaaggtgatgacaaaggcatccatgatgataaaaagtatatttcctaaaatttcattgaaattctttattttaaaaaatgcttttaaatttgagacaagatcttgctctgttgccctggctggagtgtagtggtacaattatggctcactgcagctgctacatcctgggctcaagtgatcctcccaccttagtcttctgagtagctgggactacaggtgcccgccaccatgcctggctaatttttgtattttttgttgcaacaggctggcctcaaattcctgggctcaagtgatcctaccactttgtcctccccaaatgccaggattacaggcatgagccaccaaacctggctgaaattattttaaaacacctgtgacagaatgttagaaataattattttcattatccacattttggctgagagtcaaaggccaagaacaagtactcaagattttttgaaattttatggttttttttggaaattttattcatttagttattttatttgtatacatttaaggggtacaagtgcaattttgttacatggatatattgggtagtgttgaagtctgggctttcagtgtatctatcttccaaataatgtacattgtacccattaagtaatttctcatcactcttcccctttctatccccaactcttctgagtctccaatgtctattattccatactttttgtccatgtgtacacattatttagctcctacttgtaagtgagaatatgaggtacttgattttatgtttctaagttgtttcacttaatataatggcctctagttccatccatgctgctgcaaaagacatggtttcattcttttttaaaaaattgaacagtatttcattgtgtatatactgcattttctttatccaatcatctgttgttggacacttaggttgcttctatatctttgctattgtgaatagtgttgagataaacatacgagtacgggtatctttctgatataatgatttcttttcctttgggtagatacccagtagtgggattgatggatccgatggtagttcaatttttagttctttgagaaatctccatactgttttttatggaagttgtactaatttacattcccaccaatagtatatattggtgggaatatatactattccctattctcacttatctctgcattcctaccaacaactgttattttttgacatttttaaagagagatggtgtcttgctctgttatccaggctggagagtaatggtgcaatcatagctcactgcacctttgaattcctgggctcaagtgatcctcctgcttcagcctcctgagtagctggcactatctgggcatgtgccaccatgtgcaaatatatatatatgtatattttgtatatttatatattttaagatggagtcttgctctgtcacccaggctggagtgcagtggcatgatctcggctcactgtaatctccacctcctgggttcaagcgattctcctgcctcagcctcccaagtagctgagactacaggtgcgtgccaacatgcctggttaattttttgtatttttagtagagatggggttttaccgtgttagtcaggatggtcttgatctcctgacctcatgatttgcccgcctcagcctcccaaagtgttgggattacaggcgtgagtcactgcgtccgaccgccccaaataattttttaagaattattttttgtagagacagagtcttactatgttgcctaggctggtctcaaacttctggcttcaagcaatcctcctgccttgtcctctcaaagtgttgggattacaggtgtgagccatcacattcagccagtttttttactttttaatagtagccattctgactgtgtaagatgatatctccttgtggttttaatttaattctctgatgattagtgatgttgagcacattttcatatgcttgtgagccatttgtatgtctttgaaaaatgtctattcatgtcctttgcccactttttaatgtttttgttgttgttgtttttgttgttatcattgtttgagtttcttgtagattctggatattagttctctgtcagatgcataatttgcagatatttcctcccattctgtaggttgtctgttcacgctgttgattatttcttttgttgtagagaagcttttaattttaattaagttccatttgtctaatcttgtttttgttgcttgtgcttttgaggccttagttatgaattcttggcttagaccaatgtccagaagagttttccctaggttttcttctagtgtttttatagtttcaggtcttacatttaagttttcaatccatgttgagttgatttttgtataaggtgagagacaggaggaccttcacattttaaagtgagatgctagacattctatgcaatattacaaagagagtattcccaaatctgtttggtaacccttgggccatccctattctcaagagaatacaagattgtgcatcggagatataggaaatgctaccctatgcacatttgagaaaatgtaaaggtacagacctcctttagcagagtaaataaacccagcagtatcagttacagcgcggacattcagagtttggcaggacacggatgtgtgcagggatcccatggcccgcatatggatggttaaaagggaaccagatttggactgtcagagacactgcctgagagagtgcttgactgcaggatgaagcaaccccaagaaatagcatcagtttggaaaggacccccaggaagcaggcatgggtgagaatcgaaagtgattaacaaagggatgaatcatttgtgccagagtacagtggctacagagtagtaggaagacgtccaaagaaccacaaaaacactgggagagataaagaatcagcagtcaaacgtctaacacattgatttgccatcaccagactccaactggatcagtcaagcaagattctgttttactcttgtctctctcattcctgttgctctgattttggagaggaaagaggcagcttggggaggtggggaagaggagtcaggtggcgcaattttgaagtggacccactcctccctcattacaagcactcagaaactgaaagtaagagagacagatttaaaattggaggataaattgaagtttgaatattataatagattgttttctgaaaatgtgactagtggttaatgcctaaaaatgactagtaaagctgtgagataggctttcccagggacaagacaaaatgagctgacacagcacggaggaaagccacattattggaaaagaaaaaacacaccccacatagcttataatttaaaacaaaaacgtcttaaaaacttatacgatccacatgtttgttgaagtcagaaaagtattcatagtctcccccaaataacctcccccaacattgttcacagtttcccaactccttggcaccttttcaccctttcagatatgctaatcagcacaataggcttaaacatttttagaactctaacagccagaagcaggcaggcagaattttacaactgaaaaaaagatacctaataagagaatgggttatctaagaaggatagtggaaagatccagaaaataatgttaagaagacttttcataggtacattgagaaaaagagttttggggagttcaggaagaagagagaaaatattgggctattaaaatgtgagatgattttaaagtcctttatccagagttataaattggatgcatttgatattcttagagaatcagtaaagatttgaattgtatcttctccatcaccttcagctatcagttaaagtaggaaaatacatacagttaaagtaggaaaatatataatagaaactacctataatttgacaaccagaaataaactattatgctttattatatttctttctagattttgtttttcaatgcacatttgatttttcaaacaaaatgtaatcacattttatgtacaattttgtaacctatcagatcctctgtatttatttaggcttgtgctatcacataaagatgatcataaaaggcctcaggagtgttttaaacatcaaacggaccacccacagtactaaagaataagatgagagtcactgccccctgcctactgctgtgcttcaaccttgattaccaacttaggaagcttggtttctttttaaaatcagccatttgcactgctacttcattcaggttttctctcctcttggtatccctccggagtgctgtagtcagagagaaccggagtggaataagggattaaaagatgatgggaccttaaggaaatgctcgaaaccatttaagtctactgagtattttcaatttgtgtgtccatggcatcacccaacccttacttgtctttagagaattcagcggtaggagatagagtttgacaggattgtaccaaatttttattttttttttaaaaaagcatttatttatctttgtaatttatttcttttaactgacaaataaaaattgtgtctatttattgtgcacaacatgatgttataaaatatgtatatattgtagaatggctcaattgagctaattaaccatatgcattacctcccatacttttgtagggagaatacttaaaatctactctcttaggagtttttaagaatataatacattgttctagagcagcctggccaacatagtgaaacccagtctctactaaaaattcaaaaattagccaggcatgttggcgctcacctgtaatcccagctacttgggaggctgaggcaagagaatcacttgaatctgggaggcagaggttgcagtgagccaagactgtgccaatgcactccagcctgagtgacagagcgagactccatctcaaaaaaaaaaaaaagaaaaagaatataatatattggtattaagtaagtcaccattttgtatgatagatctcttgaacttattccttctatgtaactgaagttttgtaacctttgaccaacatctcttcaacaatccccaccctgcccccatggcccttggtaaccattttactctttacttattagacttcaacatttttagattccaaatataagtatttttctagaaagaaaaatactgaatgttttatttctgcttgttttatttcacttaacataatgttatctgggttaatccatgttgtcacaaatgacagaattttcttctttttttaaggccaagtactatttcattgtgtctctttaccacattttctttatccccttatcctttgatggacacttaggttggttctgtatcttggctattgtaaataatgcagcaatgaacatgggagtgcacatttctctttgatatactgatttcatttactttggctatataccctgtaggggattgctgaatcatatgcttgttctatttttaattttttgaagatccttcaaacttctatttaaaatagaaacttaaaaagataagcagagtcacttagccttctccatggttctttcactttttatactgccaagtcacaaatcttgacttgtacaaatgtaatagttttcaaatcatttaagaaatgtaagctagaactattaatgacaactatagtaacactaaaataacttttcaaaggatacacatgatgtaaattctgacatcaaaaaaatataaactgtttgacgggagagtaaaaatgtagagttgtatgcaaagttaagttgtaatcaccttgaaataagctgttgtgattataagatgttctctggaagcctcataataagcacaaagcaaaaatctttagtagaagcacaaaacagaaatagtattcaaagaataccactattgaaaactgcgaaaccacaaagacaacaagacagaaagaaagaaaaatgtatcttccagcctgggcaacatagggtggccctatctctacaataacttcaaaaaaaattagctggatgtggtggcacgtacctgtggtcccagctactcacaaaggctgaggtgggagcatcatttgagcctgggaggtcgagggtgcagtgagctgtgatcacactaccgcactccagcctgggcaagagaggccctatctccaaaaaaaaagtatctacaataccacaacaacaacaacaagaaaaacaacaacaacaacataacaaaatggcagtagtaagtccttatctatcaataattaccttgaatgtaaatgaattaagttctccagtaaaaagatatagagtaagtgaatgaataaaaaaacaagagccaactatacgttacctgcaggaaactcacctcacttttaagggcacacagattgaaaattaggcaatggaagaaagatattccacatcaatagaaaccaaaagaaagcagggataactatacttatataagacaaaatagacttaaagtcaaaaactgtaaaaaaaaaaagtaaggacattatatgatgataaaggagtcaactcatcaagagggtataacaattgtaaatatatatgcacccaacttcagagaacctaaatatataaaataaatattaaggatatgatggaagagacagattgcaatacaattatagtagggtatttcaatacgccactttcaacaatgaaagataatccagaaaattagtaagaaaacattggatttgaaaatcgctttagacctaatgaatctaacagacacacacacacacacacacacacacacacacacacacacacagaacattccatccaacagcaacagaatgcacattcttctcaagtgcacacagaactttctccaggacagataacattttagggggaaaaacaagcttcagcaaatttaagaagattgaaattatatcaagtatctttttttttttttttgagttggagtcttgctctgtcacccagcctgtagtgcagtggtctgatctcagctcactacaacctccacctcccaggctcaagtgattctcccacctcatcccttccgagcagctgggactacaggcgtgcaccaccacatccagttaatttttgtatttttagtagagacggggtttcaccatgttggccaggctggactcaaactcctaacctcaagtgatctgcccaccttggcctcccaaagtgctgggattacaggtgtgagccaccacaactggcctcaagtatcttttctgaccacagtgatatgacactagaaatcaattatgggaggaagctaggtgtcatgttatgcacctgtagtcccagctaattggaaagctgaggtgggaggattgcttaagtccaggagttcaaggctgcagtagctatgactgtgcgagtgcactccagcctgggtgacagaaaaagaccctgtctctaaaaataaataaataaaaataaatgaatgaatatagggggaattttgaaaaatccacaaatatatggaaattagcatgctcctcaacaaccaataggtcaatgaaattaaaagggaaattaaaaatctttagataacaagataaaaatcttgttatcttaagataaacaaaaatggaaacacaacatagcaaacatatgggatacagcaaaaacagttcaaagaggaacgtttataacaataaatgtctacatcaaagagaagaaagatttaaaataaataagctaatgtcatacctcaaggaaacagaaaaagaagaataaactaagccaaagttagcataagaaaggaaataataaaaatcagagcagaaataaatgaaatagagactagaaaaacaatacaaaagatagataaaataagttcttttttgaaaagatgaacaaatttgacaaactagattaatttaaaaaaaagaagattcataataccacaaaaatacaaaagatcatcagggactatcatcaacaattatacatcaacaaattggataactaagaagaagtggttaaattcttctgttcatttaggtcctgtaaagtgtttctgtaaagtgttgttcaagttgaatgttttcttattaattttctgtctggatgatcttccagcattgaaagtgaggtatggaagttttctactgttacattgcaatccatcagatcctgtggatctgaagaaagagatgggttgcaatacaatatttacatattgtataaatataaatatctgttttatatgtttaggtgctccaaagcatacaacatacaaagactgaatcataaagaaatggaaaatctgaacataccaataatgagtaaaaagattgaatctgtaataaaagttctcccattaaaaaaaaaaaaaaaaaagcagaggacttgatggcttcatggctgaattctaccaaacatttattttttatttttcctcactgtcaccatttttattcaatataatactgaaagtcctaacgatagcaattaggcaagacaacaaaataaatggcattcaaatttaaagggaagaggtcaagttattcttgcttttaaacaacatgaacttatatttagaaaaaaatgtaggctgggcatggtggctcatgcccataatcccagcactttgggaggccaaggagggtggatcacctgaggttaggagtttgagaccagcctgcccaacatggggaaaccccatctctactaaaaatacaaaacttcactgggcgtggtggtgcacgcctataatctcagctactcaggaggctgaggcaggagaattgcttgaacttgggaggctgaggttgcagttagccaaaatgatgccactgcacttcagcctgggcgacagagcaagactctgtctccaaaaaaaaaaaaaaatgaaagactacactaaataaatcttagcagtgataaattaattcagtaaatttgcaggctaccaaattaacatgcaaaaatcagcagcattcctacatgctaacagagatggttctgaaaagaaaatcaagaaataaattccatttataaaagctataaaataaaataccaaggaataaatttaatcaaagaagttaaagattctacaaaaaatactataaaacactgatgaacgtaatttaagagaacacaaaaaaggaaagatatcccatgctcatggattggaaaaattaataccattaaaatatctatactccccaaagtgatctacagattcaatgtaatctctatcaagataccaatgaaattattcacagacatagaaaaaattctaaaaatttatgaaacagcaaaagactccaagtagctaaagaaattctgaataataacagtgctggaggtatcacactacctgcttttaaattatactacaaagctacaacaaaagtagattattaaaaaaaacaaaagtagtttatacaaaaaaaaaaagtagtatgctaacaaaaatagcatactactgtcctaaaaacagacacatagatggctgaacaggatagagaaccaagaaataaattcacgtatttacaaccaactcatttctgacaaaagtggtaagaacatacattgggctgggcatggtggcttatgcctgtaatcccagcactttggaaggccgaggtgggtggatcacgaggttaggagttcgagaccagcctgaccaacatggtgaaaccccgtctctactaaaaaaaatacaataatcagccaggcgtggtggtgcgcaactgtaatcccagctactcaggagactgaggcaggagaatggcttgaacctgtgaggtggaagttgcagtgagctaagaacatgccattgcactccagcctgggtgacagagcaagactctgtctcaaaaacaaacaaacaaacaaacaaacaaacaaaaacaacaacaaaaaatacattggaggccatgtgcagtggctcatgcctgtaatcccagcactttgggaggctgaggtgggtagatcacaaggtcaggagttcaagaccagcctggccaacatagtgaaagcccatctctactaaaaatacgaaaattagccaggtatggtggcacacacctgtagtcccatctacttgggaggctgaggcagaagaaatgcttgaacccaggaggtggaggttgcagtgagcagagattgtgtcactgcactccatcctgggcaacagagtgagactctgtctcaaaaaaaaaaaaaaaaaaaaaaaaaaagaagaacatacactcggggcttgggcgcagtggctcagagctgtaatcccagcactttgggaggctgaggtgggcggatcatgaagttaggagtttgagaccagcctgaccaacatggtgaaaccccgtctctactaaaaatacagaaattttgctgggtgtggtggcacgtgcctgtaatttcaactactaaggaggctgaggcaggagaattgcttgaacccaggaggaggaggttgcagtgagccaagatcgcactactgcactccagcctgggtgacagagtgagactgtcaaaaaaaaaaaaagaagaacatacattggggaaaggacaatctctgtaagaaatggttttgggaaaactgggcatccatatttataagaataaaactagattcctatcttctgccatatacaaaaataactcaaaatgaattagacttaaatgtaaaatgtgaaattatgaaacaactagaagaaaacatagggaaacagcatagatcaatggtctaggcaacgttttttggggtaagatctcaaaaacacagaaaacaaaagtaaaaatgggcaaatgggattatatcaagctaaaaagcttctacaaagcaaacaatcaaaagagtaaagaggaacaacctatggaattagagaaaatatttgcaagctgttcatctgacaagggattaagaatcaaaatgtaaagggaagtaactcagtagcatatgttaataataatattaatctgattaacaatgggcaaatgctctgaatagacatttttcaaaagaagacatacaaatggctaacaggtatatgaaaaaatgctcaatatcactaattgtattaggccattatttgtgttgctataaagaaatacctgagactgggtaatttataaataaaagaggtttaattgccttgtggttctgcaggctgcataaacatggcatcaacatcagctcagcttctggtgacgccttcagggagattttactcatggtagaaggtgaagcaagagcagacatgtcacatggcaatagtgagagcaagaatgagtgaggggtccaggtgtggtggctcccgcctgtaatcctgacactttgggaggctgaggcaggcagatcacctgaggtcaggagttaaagaccagcctggccaacatggtgaaaccctgtctctactaaaaatacaaaatttagccaggcatggtagcaggtgcctgtaatcatagctactcaggaggctgaggcaggagaatcacttgaacccagggggtggaggttgcagtgagccgagattgtgccattgcactccagcctgagcgacagagcaagactctgtcttaaaaaaaaaaaaaagtatgcgagagggggaaaatgtcatgcactttaaaacaatcagatcttaatgagactcactattgcaaggatgacactgaggggatggtgctaaacaatttatgagaaatccaccccttccaacaggcccccacctccaacatggggattacatttcaacatgagatttgaaagggacatctaaactataccattccacccctggccccctgaatctcatggtcttctcacactataaaagacaatgatacctgcccaatagtcacccaaagtcttaactcattccagcattaactgaaaagtctcaagtctcaaggacaaggtccaatctggagataagtttcttctacctatgagtttgtaaaatcgaaacaaattacttacttccaagatagaattggggtacaggcattgggtaaactctcctttcccaaagaagagaaatcagctactagaaggaggctacaggccccatggaagtctgaaacacaacatggcagtcattaaatcctaaagcttcaaaataatctcccttggctccaggttccacatccaggacatactgctgtgaggggtgagctccactccacctcttgggcaactttacttctttggctttgcagggttcagccaccacagttgctctcatgggttggagttgagtgcctaaagcttttccaagctcaatatgcaagctactggtggatctgccattctggggtctggaggacagtgatcccctttccactaattcactaggcagtactccagtggggactgtgtgggggggttccaaccctgcatttccccctttacagcccttgtagaggttccctgtgagggctccacccctacagccagcttctgcctgggcaaccaggctttctcatacatctgaaatctagctggaagctgccaagcctccttcactcttgcactatgtgtgcctatgagcctaataccacatggaagctgccaaggcttacagtttgcacctgctgaagcagcagcccaagctgtatctggggctcactgagccaaggctggagctggagagtggcctgcatgcagggatcagtgtcttaaggctgtgcagggcagcaagaccctgggcctggcccatgaaaccattctttcctcccaaacctcctgacctgtgatgggaggggctgcctcaaagatctctaaagtgccttcggggcctcttctccattgtcttggctattaacacttggcttccttttagtcatgcaaatctctgtagcaagtgcttgctccacagccctccttgaattcctctcctgatgatcctttttctttctctgctgcgtggccaggctgcagatttttcaaacttttgtactctgcttccctttcatgtataaattccaactttaagtcatttctttgctcttaaatctgagtgtaggctgttagaagcagccagaccacatcttgaaatttgctgcttagaagtttgttctactagataccctaagttatcactcttaagttcaaacttctacagatccctagggcataaacagagtgcagccaagttctttgctaagacaaaaccaggtgacttttgctctaattcccaataagtttctcatttccatctgagacttcatcagcctggacttcactgtgcctatcactatcagcattttggtcacaatcatttaaccagtctgtaagaaatttcaagttttctttcatttttctatcttctttggagccctccaaacttttcaaacctctgctcattacccagttccaaagctgctttcacactgttaggtatctttatagcaatgccccaattctcagtaccaattttctgtgttagcctgttctttgtgttgctatagagaaatatctgaggctgggtaatttataaagaaaagaggtttaattgggtcttggttctgtaggctgtacaagcatggcatcaacatttgctcagtttctggtgaaacctgcagggagattttactcatggcggaaggcaaactgggaacaggcaggtcacatggcaacagtgggtgcaagagataacccaaacatttaaagtagagctaatactaatcattttcaaacccttccaaaaaattgaaaaggagggaatactttcaaattctttttacaaggccagtgttatcctgatatcaaagccaaagaagcacattacaaaaaaagaaaactacatgccaacattcttgatgaacatggtgaacatagatacaaaaatctcaacaaaatagttgcaaactgaacaacccattaaaagtatcatctaccacgatcaaatgggatttattcctgaaatgcaaggatggttcaacacaaatcaataaatatgttgtatgagattaacagaatgaatgacaaaaactatatgatcatcttgttagatgcagaaaaacatttgacaaagttcaacaacatttcaagataaagactctcaccaagttaggtacagaagaaaagtaacttgacacaataaatgccacatatgagaagcccacagctaacattacacccaccagtgaaaaattgaaagccttttatttaagctctggatcaagacaaaaatgcccacttttgccacttttgccacttttattcaacatagtattggaaattcttgccagagcaattaggcaagaaaaagaaatgaaaggcattaaaatagaaagggaagaagtgaaaatgcctgtgtttgctggtgacacaatcttatatgtagaaaaccctacagactccaccagaaaactgttagaactaataaatgaatactgtaaaattgtagaatataaaataaacactaaaaagtacatttccataaactaacaatgaactatgtgagaaagacattaagaaaacaatcacattttcaataactacaaaaatatttaggaataaatttaaccaagaaagttaaagacctgtacattgcaaattatgaaacattgatgagaaattgaagaagacataaacaaatggaaaggtatcccttgttcatggattagaagaaaatattgctaaaaagtccatactaccacagtgatctagagttttaatgcaatctttatcaaaattctaacatcatttttcaaagaaatagaaaaaaatcttaaagttcatatggaatcacaaaaaaacccaaatggctaaggcaatcatgggcaaaaagaacaaagctggaggtgttactctgcctgattttaaactatactacaaagctatagtaattaaaacatcatgatcctggcaaaacaatagacccatcaaccagtggaacagaatagagagcccagaaatgcaccccacatatatggtcgattggttatttttgcaaggttgccaagaatacacaatggggaaaggatagtctctttaataaatggtattgggaaaactggatatccacatgcaaaagaattaaataggacccttatctagcattgtatataaaaatctactcagaatgggatgaagccttaagcataagaccagaaactgaaaaattaattgaaaaaaatctaagggaaaaactgtatttttctaggtggggattttttggatctgactccaaaagtgcaggcaacaaatgcaaacatagacaaatgggattacaacaaactgaaaagtttctgcatggcaaaggagacaatgatcagttttcagagatgtacagattgggagaaaatatttataagtcatacattcaagaagaagctaatatcaaaaatatatatggagctcaaacaactcaatagcaagaagacaaaaaacccaataaaaaattggcaaaataccaggaaagggagttggaagtaaagtaaaaataaaaaatgggcaagagacctgagtaaacatttctgaagagaagacatgcaaatggccaatagatacgtaaaaaaagtgctcaacattgctaatcattagagaaatgcaaattaaaatcacattgagttatcatctcacacctgtcagaatggctattatcaaaaagacaaaaggtaacaagcattggtatggatgtggaaaaaagggaatccctgtacacttgtacacttggtaggaatgtaaattagtacagctcttatagaaaactgcatggaggtttgtcataaaacttaaaaaaattatcatatgatctagcaatcctacttttgggtatttacaaaagtaaatgttcattttagcactattcacaatagccaagttatagaatcaacctaagtgtccctcaacagatgaatggataaagaaaatgtggtgtgtgtacacaatggaatagtatttagccttaaaaaggaggaaattctgtcatttatgacaacatagatggaattggaaaacattatgttaagttaaataaaccaggcacaggaagacaaatagcacgtgttctcacttatatgatgtaaaacaatcgaacttgtagaagcaaagtagaatggtggttacagagactggggtaatagggaaataaaggtcaaagggtacacaatctcagttagcagaaatatattttgaattctattgtacagcgtggtgaatatagttaaattggggtatcatacatttcaaaattgccaaaagtaaatttcaaatttctttgccacaaaaaatgttaaatattttaggtgatagatatgttaactggcttgatgaaattatttcacattgtattgagaaataataacatcactttgtaccccataaatttatacaattataaattgtcaatttatagttataaaaagaaatgcaagctaaaataatactttattgtttttcttctccaggtgataagcttattcattttggtgggatttataggagagttccaaagtttttcaaggtgaggactttttgggttgtgtgtaaaaatcattaaatttaaaaaatgttttagtaattctttagtctaattttgacattgcactttgaatctgtgtatccctccaacatattttctctttccatatttttataaaagacaatgataacaaaagcatgtgtttttaattattattcttttacttaaagaagaataattctcttgtaaaattatttttaaaaattgaagactaaaagtataagttttttgtctcagtgccgtggttttatctgtaatgcagataatcacagtggacttatatatcttagagcaatatttgatctttaaatgtaatccttgcaaagcatcctctggattttaaaggttgagagttttttaagaaaatagtcttaccaagttcttgaggcctggaaaaaagccagcatcatttatccaaggctttgttatgctctcactgtgtcagattgatgagacagagccaggtcagttcattttatggaactatcagaaaatgtgtcaggggctgtgctaggtactggggataccacaaggagcaagaaggcactgggagcatgctgggtgattcgtatcttgagccagttcattgcaatatgaatgtgttaagggctctgacagaagcctgctcagggtgatgtgagagcacagcaggaaggtcaagcaaacttcctctcctaagtctccatgtttggggaagccctctccatttccccaggacagaggctagaaaaataacagtaagttcagattgttcaagggtcaaaagtatttaggtattttgatcattggtaccatacgaaaaccacaggttggcaagattggccctgtaaaagcagccaaggcacacactatagaatgagagtcattactttcagagtaacctgaccctcttaagacatgcaagaatcatcttgactcaagatattgcccagccgaggaatgtgctgggaatccagaaatcaggaatactagttcttttattcttcgtagagcatcattttaggcaagccttccttagtctcttaaagctgactcaggtagtcttttccatatgacatggccagaatgtgagcattttatgagagtcaactctccattttcacatgtactttattttagtggagctgtttaagctcagattgtcctccttggttgtgtgcttgaaaaatggcctaaatgaacaggggatgcatttaaataaattcctgtccattcagcctctgccaatttttagttttccacttctcatggggactttttatagtttcttgtctttcagttaagtgtttctggataacttttcaactcatcattcagaatcccttcaaaggccataaaaccttgctcctttcaaaggccataaaacatatttacatatgttttcacctaccctcttaactcaaactctcccttatctatattcccataacacattatattgaatgcatttctgttctgaaatccatcaaatgagatatattgtactatgattatttgtttacacatctgtgtctctgtccttccttctatcaatagtcaatgacctacctctttttttttttttttttttgagatggagtcgccctctgtcacccaggctggagtgcagtggtgcaatctcagctcactgcaacctctgcctcccaggttcaagcaattctcctgtctcagcctcccaagtagccgggattataggcatgcaccaccacgcctggctaatttttgtatttttagtagagacggggtttcaccatgatggccctgttggtctcaaactcctgatctcaagtgatctgcactcctcggactcccaaagtgctgagattacaggcataagcaaccatacccggccaatgacctacctcttttattatttctacaattctagtgtctttagaacctggtacataatagattttgtttttttgtgatggagactccctctgttgcccaggctggagtgcagtggtgcaatctccagtaactgcagcctccatctcctgggttccagtgattctcctgcctcagcctcccgggtagctgatattacaggcacgcgccaccctgcctggctaattttttttgtatttttagtagagacagggtttcaccatgtaggccagcctggtctcgaactcctgacctcaggtgatctgcccgcctcagcctcccaaagtgctaggattacaggtttgagccactgtgccagcataatagatgtttattaagtgttagtctctaagaaagtggggctccctccatttttatatattttaggatccttttagtgtctcttcggaaaaaatatttgaggcaacatttaactatttttgactgttttcactattctttgtgttcccttgcgtatctttccacctgctttatgatggacaatttgacactgtggcagtgcctcctctccagtcaactgccagtgggacttctatgccccttggtcagaatgcaatggctgtaccaagactcaggtaggaccatgcaaaactttgtatttgattatttattgcagaaatactttggcatggccaaaatggtattaacttttgaatgttcattaaatagtgtcaatattttttgaaaactatgtttgtaattttgaggggagaaaagtatgacttgtttaataattaatatggtaataaagtaacttgtaatattgtaataaagtaacttgtatattcatttttctagatcttatcttggagctagaaatgtatataggctaaaagttcaaggcaatttactaactctttaactatgagagaaataggaataacatagaatgacatttttagataatgtaaaatgttttatgttcactgagttcaacttttcttctcatctcaaacaaacactagcaaatagcaaaatggctgcttgattttacttcacaaatagcgaacaaccatgaaaaaaattttgcaaaatgtcttaaagtttaattgctaagtaacacaaatacaatgttggacttaatgtggatattataaaaagcttctaaaaatgtttgtattccttattataaaatgttcactggagagaatacagaaagttatgaagaaataaggcattattcacaattctgcctttttctttttttgtttttgagtcggagtctccctctgtcgccaggctggagtgcagtggcacgatcttggctcactgtaatctccgcctcccgggttcaagtgattctcctgcctcagcctcccaagtagctgggactacaggcacgtgccactacacccggctaattttttgtatttttagtagagatgaggtttaaccatcttggccaggatggtctcgatctcttgatctcgtgatccacctgcctcggccttccaaagtgctgggattacaggtgtgagccactgcacctggccaattctaccatttagaagaaacaaattatataacagcatttggtatttattccctcagctctgtctactttttctctgtgtgtgcttataattaaaaaaattgagattattttatcatagttttgtattctattttaatctaacattatactatcagcaaaataatttataacagcagtattatgttccatgatatgaatatagccttcttatttttccacttttttattgtttgatatttaagttgtttccatttttgttataaagaaaactttaataaacatttttgaatgtagatatctgtcctcttttcccataattttctgaggatagtcctagaaataaaatgtttatcttaaagtttctgaacatttcaagagttaaatattctagaaatagtccagtttgggtaaaattatatttaaaaatcacttttaattattaaaataacagaatcataccatagaagataattattattttgaagcatcatcattaagatcaggtatttatttagtacctacatgagtagtattttcaaaacaaattacatgaataaagaatttggcttctagcaagtataataaataacagctctgattacaggcaaccaggtacatgaataacaagcaaaggtcaaagaaacatcaaacacgttaaatatttttatcatttaaagagaagaaagaacactaaatagaagcagagagatagagggtgttttttatacaagcaatttttttctttgagtgaaggtcattatgcaatggatacatcctagattataaaaacaaaattttcattcagaaagagacaagtgaaaatgagaaaggggttgtagggtcagactttgacaggtgagaaggagactgtggagagtggctgccatcaagggctccctggtaatatggagaagaaaaacactttcttatgcaaacaacaccatctgggctctggaacttcacaaaaggacactgttaagtcacacatgagcggtatcttcatcacttacaaagggactaaaaatggtatcaagaaaccttaccgagttccattccccactcatattcctctgtggctcctttgcttaaacatgatgaaagacaccagagccatgctcaggctggtgcgtacctgctcagagttcaaattatggccactgtgacccctcatgccaaggaattcccacttctaacccaatttaggatggatgaataagttcgacattgatatgtacagcaactcttccctgttgatcttcactcaaggtttaaatcctcaggacgctcagttttggttccgttttgtttgttaatggagaagaggtgagtagaggaagaggcctggaagatgctcactgattgccaggggtagatctttctttttgtttgaatgttagatacatgtcttcatagtgaatgaggattaaataaactttagtatgaattagttgtaagtttctcatttagtttgataatttcttcagttttcctatattcttttccctcaagaggtttgtattttacgtattcctttgtagatgtagcttcacctttggattacttaggcttctgttttgtaaatttgacttccatattcatgtatttctctctgaattgtttttgcttgcctttcttcctgaagaaggcttacagtttagctgaaaggaatcaccatcactcttctgaaggtttccttaactctgcttcatcttaacccctttcccagtaccttatcctctctccagaaaaagtcatttcactttctctaatgagctcttggaacacagatttggtaaatatattaatcattctatgctctaatgtatttgcttatgtgtctaccctctaagctttactcaggttactttcttttttcttttctttttttttttttgagacggtgtctcactttattgcccaggctggagtgcagtggcatgatctcagctcactgcaatcaggttactttcttaaagattcactaacatcatttttttttttttgcatttaatcctgaaagtcaatatatgcctgggagctctctataaataatagccaacatgttgcttaactcaaggacaaataggtctgtgaattcattgattttgaggttttatttctgtagaacaccagaacaattttccagacgttgtttttctaattgtattactttttctcagattttattactcagataaaggaaactagagatttctttgaaaacaaacaaataaacaaacaaaccactgcctgctttgtgtttagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtaacttgttttccataggctcagcatgcagattgtaaattcaaacgttatttggtgaacttgctcgttatatatttgttaaattttactgaatttatattggcctaaagttaattcccccaaatatcatcaggatttttgttggtatgttaatcatccactcagctatcattttttcaaatgcaaggggatgcatctggtaataaacataggaatgctctttgtctctttgaatggaactctagttactgacagacccaaaaagttcttgacagtgtattttgagtaaagatgcagagtgagtcttgtacatatattgagattagacgaaaacaatgttactgcctaaattattatatctacaagaaaagcaaccctaatgaactgattaaggagcaatacagttctctcctatgcatggggtgattgaaacaccagttttggcatagaatattatttgaccaatactctatgttgcatttatgcagtcagattaatgtaacaacatttagtaaacatttatgattcttgtttcaaatagtggtgagagttgtatatacaagtgaaacacatgcctcttccctcacaaatattaaagttttatgggcagaatagtacataaataatccctgtgttagaagtgctcctcagtgatacctgttgaacgcttattttactttcaaaatccaaattagataaccactccttcaggaagcctgccctaaatccccaactgatagaagtaattaagcaatcacttccatattttccttatgcatattgtaccatctgtcatttggatgattcgttggcctgaatgtctctcttggtgaactgtgaactccttgaagacatgaattatatttcttacatgttgacttctggagtccctggtacataataagttctcaacaaatgtttgctgcattggattgagtggcagtatagcagggtacatgtcctataaggacagctgtgcaccaaacatcctatgaggacatagaggaagaacatgcatcagagcctgtgaggcagcgatggttttcaagaggagataatgtttaatttgattcttgaaggacaagtaagagataggtagagaaaacccatctaggcagagagaactaaccaagcgcaagatcattggagatgacagaaagcttggccttttattcatgcaggtagtctggtatgactagggtataagaagctagtaggagaatggctggggatgatgctggggagataggcaggaactagatcatctggtactctccagtgcttccttggtactctagatttatggctatcataacaattatgatctatgtctttgtagtatttcctattagattgtaaagtatatgaaaagctggcaaaggccatttttattcatattcgtatcctagcccctattgtgctacggaaatgttgaattttaaccttttgataaaattgtccggctcttaaagcttacaaatttaaattaccaaaaaaagctcaactttgtcatcttagaatgacagaaaaaaagtgaaagttgaagggcaggaagtcagtctattttctcagtagtcggaattatataatttagacaagctgcttgatgattatgggtgagatcctgaaattctgaattcagatcctattttcaattttgtgtctgattgagttaagaaccatttccatgtgccataaaatggagacaaaatactcactagtcctttccgagacactctgaggatttatctcccatttacattggcgtatcagtgcagtgttacaggtagcaggaaaaccctttttggtcctgggtagtgtttctcctcttccctcttttacatttgcacgtggatttctctggtgttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatgggtaaggtgctgggcagcctcctgagtacatcagtgaattgtagttttaaattttgttttattttatagtttggtaagtctacgaacaagtcttctaataggcaagattattcattggctcagagctctttgccacatcctgagacagtatttttgttcacacatgtatacctgtagatacatgtggtagatgcagagtgaccccttgtcctgggatggtcctagttttagcgctgaaattctaattccaagaaacccctcaggcccagggaaacctggacagttggtcacttcatgggggttggaagggagggagagagagagaaaaaatactaattcaataatgtggggctattcaagagaatgaagagacaatagaatgagaacaggatgagaagagagacagaagcaagtgtgttgtaatatccaggctgaacagcaattgtctaaactagccaagaacctgtttccaagtgaaggttggaaaatactgtgtttacgttatcaaagagaattctgaagaatttttaagggtcatatgacttgttaaggtttcaagacctaaaaataacctattttagagtgaaagaagtaatttttctgaaatattttaaaatttattaacagagaaatagggtaaaattatttgaaagagtacaccattcagtatgctaagaggcaattagttaaaatttattatagagagctctctctcctcaagagtaaccttaattgtattggttttatctacagattcaattcaaaaccagctgttgccatagatacgaaagagccatgtgtttcccaaatatgttcttagatggaaagaatgttggattttctgagccattagttttagtgattataccaagcaggggaagctggataatgtatggtgtgtattaggatgctgtgctcttcatttgaactctctcaaagaagtgtttaagtgtaatgcattttaagaatttgtagagttctgtaataaacttttttccccaccaagtgctatttctggtttttaacggctttttatttcctccttctcctcctcctccttttaacagttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtacttacgacgttattgatttccaatctggaattgtcagagagcattatttatatgatattgacttttacgtatttgttgagaatttacttatggcctaatgtgtggtcaatttttataaatgttttatgttgacttaaaaagtatacacagtgtttttgctttggggtacagggcaatgatacttttaacatgtgtcattcaagctgacatatccttatacctcatttgtaacttcatgttctatataggcccaagaccttattgtctgtgctggtgtaggcattaaactgaagaccctgtccatgactggtaatgatagtctcctgacactgctacagtgtcagctcacttaaaatgcttttattttaaaattgtgaactatttcatatatacaaaagggtgtggataacatatatgtgtaatttgaagaaaactgcccttatatgcccaccatctgccttaagaaatagaatattgccagtgacttaaaggctcctctatgcccctctctgatcacatccctctcactcctcaggcaactactattttatattttgtattaattatccttgttttttctataaatgcttattctttatatgtttttgtccctaaatataaatttgtgatttagttttgcctattttttccatttgtataaatagaatcatatctattcttctgttacttttttcactaaaagttatggatttgagatttactcatgctgttgcaggtggcatttttattgctgtttccaattttttcttatgaaaatgccttgaacattcttgtgcctgagtcccatacaaatgaactagagcttctccagggcatacacctggaactcaaattgctacctcataggatatgtatgtactaaattttactaggtaaagtatccaaaatggctggatcatttcataccccagcagtggggatgagtggcctccacttcacatgcttgccaacgttggtattgcttaactttttaattttgcttatgatctcagatctcctctgtctccaggcttctgtttctcaaaagctatttctgtcatacacacctaaactcacccgtgagtaggttttgatcaacacaatacgtactcatgcaaaacagttatggctttaggaaactttacggaagatttagaaggaagatagaggagagattttctgttgcagtaatgcaaacatgttgaagcaatagcggttggcatcttctatcttaaaacacttccacagcctcaacacaacgaaatttctggtctcatcgggtgttagcttctttcttgctctcgtctttcaagatcccctctctcactccttttcctccctttgtccccaaactccaaaaatgtctaattcagcttttaatattgattacttctaaatttgtaaacccaaactactgaaatgttcagacaaaagggccttttgcttacccaaattaaccttctccagaaagcagctttgattataaatagcaaacataccgtcttccaatttaccatagaataagttagttgcatttaagagttgttgagtaatataaatgagaagtaaaacagatctgaaaaataattgtagctaccagtttttgaatacctactgtggcatctacactattttaggtgattagcataggtttaattctcacagcagctttggaaagtaagcaatattttactattttatatatgtagaaactgaggcttaagaggacttcagctgacatactcaaagtcaccaaattaaaaagtagtagagcttagatctggtctgtcagatttcacagccttttatttttccattacattttactctccccatgtgtttcacttatttttcaattctaaattcaacgtggtgaataacatgtattacaatttaacctttggccagaaaggagaatgtaagacaggcatatacagataattttttttctccctctataccttagagaatatgttcctaattctttcataattataatgtggagacttgcatgtatatttttgaaagggtcaaatttagaaagttacagagcagagaaaataataagaaagagcgtttctgacttcgttggaaggtagacaggcaggaagtctgcatttctgaagaagagggataatttattaacaacgtgatcctgacattcattttcctcagcagggcttggtctttagattgacaactgaaatgccttccccatcactgaatgtgaaggtgtttgtcagagtagagggaaattatagcctgctatagaatgaggaacagagatgttttgaggagcagtctgagggaagtgaagtggaagccacaggcagtgagtcagccatgcaaatgctaaactcaggtgtggacgcggaggtggtgaatgtcctccatggttcaaataaattcatctcgggcccactgggtattcagctctctttgaggtggaaagtgacttttggcttattggaacataaatattagtagtaaatataaaacagaatcggccagtctctcttataatccctgtttcggtttttagcatcgcggtttatccagggcaaacccaatttcttgtcgagtaagctacttaactttgatgctgtgcacattctctgtctacttatacattttatacaacaaggaaggcatttatggcttgggaaggtgcccctctgccttgttcagcctgagagatagcagaggactattgtgtttattctcagtgtgtgatgaattgcagaagggaatgaattatgatcaaggtggaaaaacttcatggcttcttctgtgtttggtcttgaatatacttcattatatattttgaagagaaatcctaaatgcatatcaaattaaaaacaaaaacaaattctaaaggcaattttaatgaatgctgcattatctaagcctttgcttcctctgttggtatgaggactagatacctgagatttctaaatctaccttgttaaaggaataatttaaatgatggttaaaaatatctcacatataagaacgctttgtatactaagcactgttccaagagctttacatggacctattttccttataataacctaaggaggtaggtactggcatctcattttacaaatgataaaacagaggcaaaaaagctaaatagcttatccacagcatagaagatgacaaaggtgggatttgaactttagaagtctggctccaaaccccctcagagcagacactatacttacaagcattttatatagtatatatatgtatgtatatgcagtgaatatctctatatctatatgtatatcgtgtctcattctatatgtgggtgggagtgggagagagagagaaaatgaaaaaacaagagtgcaagaggaacacttctttttttttttttttgagagggagtctcattcacccatttgcccaggctggagtgcagtcgtgtgatctcggctcactgcaacctctgcctcctgtgttcaagcgattctcatgcctcggcctaccgagtagctgggattacaggcgtgtactaccatgcctggctaatttttgtatttttagtagatacagggtttcgccatgtcggtcaggctggtctcgaactcctgtcctcaagtgatccacccgcctcggcctcccaaagtgctgggattacaagcgtgagccactgaccctggcccgaggagcacttttgaataactgaatgaagttcaaactggctggattacacagtgaagtgtgaagagttgtaagaaatgaggttatgagtgatcgggaaagtaaataaaaaagacttttttctggttagttaaggagattggattaaaaaaaagagtcagagagtttaagaagggttgctactcttatgaacagtggagaatagattggagggtggccaactgggggaaagaaccttggttagaaaactgttgtaataatccctgagagacataagagcggcctgagaaaacttggtgagcggctgaatgcggggtatgatggagagtgagcagtctgggatatgaatgggtttctgacttggaccaatggccagatgaaaatacaaccctctgagatgggtaaagacccatttgcagggagaagacaaatccagtttaggtatctaaagtatgtccaagtgctcaggagaaagtgtttgagctggaaatagacatttggtgattattggtataagaatggtaattgaagccacagagtggagaacactgttcctcttggaattagcatagaggagtaatagaaggagatgcgtaaaggagtcttagaaggaacagccagagagaaaaaaagaaaactagaaagccaacagaagagagtatttccagtaggagagagtggtcaacagtgccgaatgatgttgagagaagtgttcactgtctggtgaaataagaaaggtgccagcagcattgctggaagtcagaccattgtaagcggaagagtgaatgggaggtgaggaatttaagataattaattatagtcaactcatttaaggtggtgagatgggaaagtaggaaagaaggaatatatagtaacaggtaaagcatttcttattttagttggttgtattagaacatgtatgttttgatagaaaggagccagtagagcaagaaaaatggaagctgtaggagagggaacaatcaatccatctaatccaccctttgaagaagtcagagagaatgcaatacagagaagagagagaaaatttatcctaagacaaagggagggacacctatagagaaaaagaaggaaagaaaagttaataagtttgtagatttgttagccagcagtttaagaggtctctgaagatgggagtttttgtaaagaaagaggtaagatcatcttctgagagtgaaggaagtgtctgtagaatcgaggaattgaattttgaaaaattttcaaaattttgcagaatttaaaaataggtactgtagagaatgggaggagggaactgactagagaaataaagtattgttggctggttttgaggattctactgaagttgaaaagcacgaatggatttgtagtggcaccaatccgtacagttgtgcgattttctttctttctttttttttttttttgagacagagtcttgctatgtcaccaggctggagtgcagtggcgtgatctcggctccctgcaacctccgcctcctgggttcaagcgattctcctggttcagcctcccgagtagctgggattacaggcacgcaccaccatgcccagctaatttttgtatttttagtagagatgggtttcaccatgttggccaggatggtctccatctcctgaccttgtgacccgcccaccttggcctcccaaagtgctgggattacaggcataagccgccacgcccatgcctggcctagcaagccctggctgggtttttgccaggaaaacatgatagcaggtcatctaggcaaggaagttaaatccattggcaagagaatgattgaagtcatgagccaagaagcctaagctgaaacaggaaggaagtgaaaaaactgaaagtattgatagggagaaagggggagaataagtggaagaacatgtttctataatgtgaaataatagatgtggcaataataaaaatgagagttaaaagaataagagatgttagaatataggatggttgaatttgggatttcagaggaagaatcagtcttggagaatccaggatctaagctggaagaaggagggtattaattaaagaaaatttaataagaccacaccactttgagaaagatgattcctgcagctatgtgtaggtagataggagtgagaagatgctgaactaaagcagctgagaggtttatttgtatttgaattgtggatataaagacaggcggaaataggctaattttttttttttttgcattgaaagggatgtgtataacttttctttctccaaagagataataaactaaatattttttaaatcaataatatatatgtgtgtatgtgtatatgtgtatatacatatatgtgtgtgtgtgtatatatatatacacacagacatatatatattctcccagcccaagctgaatttttgcatctgacttttaaacaaaccaatttcataatgtgatggaaataatgctctaataaaagatttgttgaaatccatcttcttatctttcttatctttttagcatgcatatctaatactcaatgggggtagtgataacagtcatattgtattttctggtattttggtgtatttctgtcttgtattttttgactgggcatatacttgcatgattgtggttaatagcatcttcacacttatacctgtcttcttatttaatgtgacaacatgaatattttgctttcacaagcatcatttagtatgactgtgtaatattgtcattttctttccttttagttttcaaaaaagtatatcatttccatcagttcaatttcctctgttccttatgcttggatctcaaacgcagatgtgtatgtatatataataaaaacacaaatgcttgtgaaaggagagctcccaatttgaatatttatatagaacaaacacagtgagagggagtcttcttgcctgatttgtttcattcccacagggactgacatttttagcaaattagttgtctataactttaacaaatcaagagagttttacatgaagagtcaaatttatcccttggaaaaaatcagacaatttgtcaataccagaacctgtagttacatctagtgactgtctagtggatttgagtgttgtgtgtcccttttagacagggtacgtgttcactttttcatcaccatgctgtccactggaggtttccaacattgacattacttgccagttccctgtgggcatttcattttgacacttgatctaaagcaaaataaaggataaatgaatgattgtctcttcaataaaagctgaagctgtcacttctcatttagctacatgtgactaacctattgtctactttaaaattcttttggggtgaccctttcttctatctagcaaagaaaaaaatgcaattttagcatttatccaagtgaaacagaattagaaaattaaatccactattggatcacatagaacattccaaaacaaagtccaaaagagctaattgtttcatatcacctatttgcatctctgttcctctttgttagatgaaaaatcaagaacgaaattctttctagttctctgtcagtgtagcttttgttaatttgctcgcttctgggccaaatgctgacattaaaggaacatggaagttgtttgtacctaaatgcattttgtgagtcacttgggattgccattgttggtaccatgtgtcctgcttaataaaaaaataatcgtagaatgaactctttccttataatcatactggcctggtcttaatgagagtcacagttgctttgtgccaatgaagagcttttctctttgggaagattgcatgaagaaagtatgcatgataaaggatccagcattaatttagtcatagcaaaatttttcattttctttgtaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaaggttagtataaaatgtcagttaacttttccatgttttacttttttaagtattgcttacattaataaacttgtatttatcaaaaggatcagctttcatattaaaattagtaatagtaatagtacttcctttaagagtcaatgcaatatctttctctaaaaggtacaatattgtctcattaaatctctttgataatatatttatttatactggccaggcacagtggttcacgcctataatcccagcactttgggaggccaaggtgagtggattgcttgagcttgagctcaggaatttgggaccagcctgggcaacatagcaagaccctgtctctataaaaacacaaaaattagctgagcatggtggtgcatgcctatagtcccagctacttaggaggctaaggtggaaggatcacttgagccttggagggagaggatgcagtgagccaatatcatgtcactgcacttcagcctgggcaacagagtgagaccctgtctcaaaaaaaaatacatatatatatatatatatatatatatatatatatgtatatttagttatagttttaaacttctcattaaaaatatttgtttttatttgaagatgtttacaaagcccttattaccttgaaatcttctattttaaacgatcttaaatttcttaaatttgtgattactggtgatactattttaagtgtcatatacaattttaaaaaatctaattaatgcttatatatgcttcttaaatgcaaatgctagaggctttttagatggtgcatgaagataaaatactttaaaaacactttattacttttgagataccaacatttttatctaaggaagttaaaagacatttttaaatacttcattgttttgaaatactaaaaccttcctcttgagaaatctgaacagtagagatggattgtactaattgatatacagttatggctgaataatttttttaggctaattattattcacaatctgcacatttcatcacatcttaaagttagtaacttgattaataaatcacttaggaaaatataaggaatattgattttatttgttttatgactgagaaactgactatggagctatgagttgtaaaaacatttattgtctccacattatattgttcacaaagtggggatttggcaaaagtagatctgtgatctgtcttggacatcattaaaagatgcttaggaagtgtttaaaagacttcattataaagtagcttcacctgcaaataccctagcatgggagataaatcatacctacaagtcattgtcaagatgtggaccatagggacacattattttatatacttatatttatcagttgatagattaattctctttttctagttgaagatggcatagcaacttggtcttggggttttggagtttatataagaaattatcatataatttcttcacctgtaatctcagcactttgggaggctgaggcaagcagaccacttgaggtcaggagttcaagaccagcctggccaacatgatgaaaccctacctctactaaaaatacaaaaattatccaggcatggtggtgcatgcctgtaatcccagctactcaagtggctgaggcaggacaaagctgaattttcctgaattaatcctgaaccctgaattaatgctttgttgatttcatattgagagaagggtcctcactatctgtccagatgtgggaggggatggtggcttaacatagcattactcagattttttttttttttttttttgatattgggtctcactctgttacccaggctggagtgcagtggtgtgatcacggctcacttcaatcactgcctcctgggttcaagcgattcttctacctcagccacttgagtagctgggattacaggtgtgtaccaccatggcaggataatttttgtatttttagtagagacagggtttcatcatgttggccaggctggtctcaagtgctctgcctgcctcagcctcccaaagtgctgggattataggagtgagccaccttgcctggccattactcagatattattactatttgagactccaaatattcctgattgcgtccagtaagtgggcccataagagtgctcatcatgcgtcaaaaataaaaattcttgtagtcttggttgattggagatgagagctgatgaaggtattgaacagagaactatttccattgcctttttatcttccacctaaaactccttgtactctttcttctttccacagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatggtacagtattaaaaaattcgttgtctaaaggcatttctgggattttaatggggaaataacatgtagttaatgtaagcttttgagctttaaaatttgacaaacagaaatttaaattgcaaaggaatctaaaattgcaagaatgtattattgtctacttaaaatcttatatggtttaagaaaagcctgtctactgttttgcatagtaccttgagctaaatcattatcattattggctatctctagagggtattggctgggtttttagaatgctttttaaactttccactttctcaaactaaacagcatttctcaagaaaaactaaatgaggaatttagcaatatttcagaaatcaagatgtttaaataagtatttcatttacctttgttttttaccctctcattcttttaaaaaaatcctctctgaatatcataagtttgtttactacttaatacttgtaacaatagcttaaattgatgggataccttcctcatgacaagtgagttacatgtattagtaataatccttactactacccaatgagatgggcattataatctctgccccacagtgagaaatagagactcagtgctattatgagacttatccaaggtcatgaagattgcaaggagggtatttaaggctgggtctaactggcctcaaagtcagtttagcttattccttatgctatgtcactgctaaaattgcctgattttggttagaatcaggacatacccctgaattaatgctttgttgatttcatattgagagaagagtcctcactatctgtctagatatgggcagggatggtggtggcttaacaaccactcctcctcttcagagactagccttggcttactaatgttccaagtcaaaccttttttttcctaactttgtcttttagctgatgcccacatttccctctctattccaaatcccctcttcaaggtctttctcttcagaaaagattctgttacaaccttggagaagaataagatctcttacataagattcagaggaagtcttttagctttttaaatgggtaaactataatattttttcatttccactgagctatttttttttgaagttctctactacataaaatttaactagaacttgatcttttcaaatcttataggttagaaatgagtgcacaagtacaggtttttgtagcaacgacaaggacactatttctttggagaattaatccagcaagtagtttggtctaaattcagttttacttctttttattgcacttaaaagaaatggagaggattaaaaaaacattccaagctggtaaaattaaatttttcagtaaaaattttactcttgagcagtttatgtttttcctaaaatttttatttaaatataatcataacctctgggatatagtgtatgccccaaataattgttctttaagaaacattaaggttattgtaatatagttagtaaatgagaaaatatatttgcacattttagtatttttctatcctactttcaaaaaatgcattggcaaaaaaaaaaaaacacaaaaaactccccttgataatgagtagaaatgatcacattctaagggtataagtcatgggaaggagatgttggaagtcacagatgttaaagatggagagattgaaccagtagaacttgaattttaggagttaattcctgtggaaacagaagccagctttgggagccttaagtagatttgctggaagaagctgtcatgctcctacttttattgatttatcttatgcctaagaagctgactgtaaatgggtgaaagatatcactctttggggtgttcaatttctactccctgcacctttttatgtagaaatctcttctgcctcccctctgaagctgatagaaggaaaataacaaaagtcaattttttctgatctttgactcttctagagcacttgaaaatgttcatatcatgtcactcttgattagatggccatagtagcagcaaacaacctcttatccctactctcatatctgaagatcttcaaggaatgcagaaattaaacatgtctcttttacattttctcccctagattttaattcagtcgaagaaaagaaatgtaaatcctcaggttggcattttgtcgttaaattttcaagtcatggatgcaaggaactggaaaacgctttaaaagctgcttcaggtaaatggaaaaagagcagtttgcattgcaagcttaacttcttttttttttacttttaagttcaagggtacgcgtgaagttatgtaggtaaacttgtgtcatggggctttgttgtacagattattttgtcacccaagtattaagcctagtacccactagttattttttcctgatcttctccctcctcccactctccactctccaaaatgccccagtgtgtgttgctcctctgtctatttccatatattctcatcatttagctcctgcatatatgtgaaaatactcaatgtttagttttcttttcttgctttagtttgctaagaataatggcttccagctccatccatgtccctgcaaaggacatgatcttattctttttttatggctccatagtattctatggtgtatatgcaccacactttatccagtttatcattgatgggcatttaggttgattccgtgtcttcgctattgtgaataattacaagcctaacctctactccagtcttctattgttaattcttgatctccaaaggcttttgaggctttatcaggggttctgctttgtgttttaaaaaatctatttggtaatttttgtctctgctctctctttcatgtgtcaaggtagtgagacatcacacaggatagggagttcaccaggttatctcctctgtattataaatatgttatcagtgtgcagcacttttctcctttatgatgattggcaaacaagcctagacaagtgacaatatcaagagacagttcagtttcacttgctgacatggctactccgtggaggtcaggtttttggtgcatgctggttggcagtggagatggggggaaggtggtatgctagtctttgggtgattgaaggaggactgaaagggtaaactgatctagactgtgagggtaccatgttaaggagtttggatttcattctgatggctattgggttccattaaaagatttaatacatggagtgatgaaataaaagtttacctaagtaaagttgtagagaataaagaagaatggagaaggaaacatttggcaggattaaaaaacaagagatggaaagtaaaggaggagtgaggtcaacagagtgaagataaggaccaaaaaatgttcactggatttggtgattaagacttagttgctgcttttgagaagtgtccgttcatgtcttttgtccatttttaatggggttatttattttttacttgttaagttaagttccttatatattctgaatattagagttttatcagatgcatagtttgcaaatattttttcccattttgtgggttgtctgttacacattgatagtttcctttgctgtgcagatgcaggaacaggaaaccaaatactgcacattcttacttttaagtgggagttaaacactgggtacttatggacataaaaatggcaaaaatagtcactggggactgctagagaggggaggaagggaggaatcaagggttgaaaaactaactattgggtacttactctcactacctgggtgttgggatcaatcacactccaaagctcagtatcacataatccacccaggtaacaaacctgaacatgtaccccatgaatcgagaataaacgttgaagagaaagttgcttttaaaggaagagattccatagtatggtaggggtgtaagtgagactgcaatgcattgtgtgaggccatagactgagcagtatcagagtttaaatcctcttggggtaatggcaaaagtggacactgacccatgtgtcatggttctcagtgaagaagcagggattcttgggatattggtagatgagtgcaagaaggaggaagataagtagtaaaaccaggtttatgtactcattcacttgcttcattcatcaactatttatggagtctgtggtatgtgccaggaatcgttttagacactcaagatatagccgtgaatatgccagagaaagtgcttgtcttcgtgaagttgacatgtcagaggaggaaaagtttttgaatgaagtggaaaaagaatgatctgaacatagaaatggaagtgagagctttgagaagatgttgacatcagtcttcagttgggctggcagttggaagctgcttaccaattttattttatttcacatttaacaaacacagggcacctactgtgtgccagcacaattttaagtgatgtacaaaaataaaccagtgtagtcctcctacctatgtgttaagtattattcatattctcattttacagacagggacactgaggcccagaaatgttgcccaagattatcgttaataagaattagatatgaaatgcaaatgcataaaatttggcttaacagtctggggtcttgacttgcattgggctgccttttctaggggaaaagagttagctggaacagagagctcactggggtatggaaagggaggctaaagccttaaaaaaacatcatgatggtagaatctgtaattctttttatttatttatttatttatttatttttattatactttaagttctagggtacatgtgcacaacgtgcaggtttgttacatatgtatacatgtgccatgttggtgtgctacacccattaactcgtcatttacattaggtatatctcctaatgctatccctcccccctctccccaccccactacaggccccggtgtgtgatgttccccttcctgtgtccaagtgttctcattgttcagttcccacctgtgagtgagaacatgcggtgtttggttttttgtccttgcgaactggattaagaaaatgtggcacatatacaccatgaaatactatgcagccataaaaaatgatgagctcatgtcctttgtagggacatggatgaagctggaaaccatcattcttagcaaagaatctgcagttcttacataggtgtgctggctaaggcagtgattctcaaactttaatatgcatgacgcttacctgggggattctcttaaaatgctgattccaaaggttactcattctctcagatattctcctgtaggtcttggtggggactaagaaatctgcagttccctcagatgattgtgattcagtaatacagggatgggacgtgattcactgcattaaaaagtgttactgtatatattgaaaacacagctaacaatgaagacgaggaagcatcaggtgatttgttaaaactattaagatttacagtcacagaaagtcaaatattgcatgttctcatatgtgagggttaaaaaaattgatctcatggagatagaatagaatgataattatcagaagctggggaggaggaggggtcaatgaagagagattgcttaatgggtataaacctgtagttaggtaaaaggaataaattcgactaggcgtggtggctcaggcctgtaatcccagcactttggcaggctgaggtgggtggatcatgaggttaagagatcgagaccattctggccaacaaggtgaaaccctgtctctactataaatacaaaaattagctgggtgtggtggcgcacgcctgtagtcccagctacttgggaggctgaggcaggagaattgcttgaacctgagaggcagaggttgcagtgagctgagatagtgccactgcactgcagcctagcaacagagcaagactctgtctcaaaaaaaaaaaaaaaaaaggaataaattctagtgtttgatagcacagtcaggtggctatagttaacaataatttattgtatattttaaaatagctagaagacaagatttgaaatgttcccaacacaaacaaatggtaaggtgatggatatcctaaatatcctgatttgatcattacacattctatgcatgtatcaaaatatcacatgcaccccataaacatgtaccattattgtgtataaataaaaaataaaaaaacaaaaaaagaacctgtcaggctttaatgatttctgaatatgagtacaatatgcttattttatgaaattgcaaaatttggacagttacaaggaaatgaaaaccactcaaaatccgatctgcaaggttggaaatttcttgtcatgaccattacaaatggagataaagtatttctaaaattatgaggcacataaatggaaaagaagcttccattagcatttcacacttttcagaacacttttcatgcgttaagtaatagattcctgttaattaacagcttattttattcattgttagtataccagatgcaataaactgttttccttccaatattttattatgaaaattttaaaacatatagacaagaatgttgtaataaatacccatatacccatttcctatatacaattagtattttgtaatttcactacatatatgtacatataatattgataatattgactgattctttgaaatatatattatgtatttaaagtgtttataatatttgctgaactatttggaagtaagtttcagatatcataatacttcatcactaaatatatgcatgtaacatctaagaagaacattctcttgcataatgtgatactcacactaaaaatataaagaacatgaacaataattccctaatatcatctgctctcaggcaagagttgtttttcttttttaaaaaatataccttagttttggctaggtgcagtggttcacacctgtaatcccaacactttgggaggctgaggcaggcagatgacttgaggccaggagttcgagaccagtctggccaacatggtgaaaccccatctctactaaaaatacaaaaattagccaggtgtggtggcgtacacctgtagtcccagctactcaggaggctgaggcatgagaattgcttgaacctggggggcagagtttgcattgagtatgccactgcactccagcctgggctacagagtgagaatactgtctcaaaaaaaaaaaaaaaaaaaaaaaaaaaagaaaaccaccaaaaataaaataaatatagcttagtttttagaacagttttaggttcacagcacaattgagtgcaaaatacagagagttcctgtatatcccctgctcccacacaggcaaagccttccccactatcaacatctcctaacagagtggaacatttgttacaatggatgaacctacattgacacattgtcatccaaagtccataatttacattagggttcactcttgatattgaacatttaatgacttttgacaaatgtataacgacatgtgcccaccattgtagtattatacagaacagtgtcactgccctaaatatcctttgtgctctgcctattcatccctcccttctttctgaccacaatttatcttttgactgtttccatagtttggctttttccaggatgtcatacaatttgatagtttttttaaatacttgatagacttttcacttttcatttgctttcttctgtataggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaaggtatgtcaggctttgtttaaagcaataggaagcagtcatgtttatttgcatgaggaaaacgaaggtggttaaatcaagatggttaaacagacatggctgtaattagcattttccgtatcccaattatattttgtagagtaaaatgaatgcacacataataataagaaacagaaggtgtgttatactcatattttagttgcaaatgttaaatgtcttgcaatttccaagataaattaatgacaaaatttgcatttttaacttttgatctaagttcgattatgtcttccttggtccctaattcagaggagttataaattctagcaaggggaaggcatgaagttttgccttctgttatgttcctatcacctttctttgtgtggccatggcttgtgggctcctgaagtcatacaaagtaggatagtaacaagttggctggcagaattttaacatgttttattgttatcatcaattcttttataatgcaacaaatgtgtttctaaaaatcattgagctatgcaaaattgcacaataaagggcttaaggaaaaaaaatcaggttagagacacagcactcaaattttcatctgtcacactcatatgaaaaagacaggtgccaataaaaatacttgcatggttttatacatgttaaattattaaaaatgtatctatactacaataagtgtggtgcattacctagaaaaagacctgaagctttctgggttttggaaggtttacggcttgtgagttactgtgaagtgctagaaggacgccagtcagaaacccgacagacatttgtaacagcagacatgaacagtatagtttataatgcaggaaatgaactgacatagatgttgaggggtgtgtgagtgtgtgtgtgtgtcaacgcacatgcgtatgcatgagttttgtatattcctatgtggcttgtttccactgtgtgaagcattttgtgttcaccctgtgtttcatgtggacatagttgtacataagaaaatctcaaatctgtgctatactcaaaattttcagtatatcaatctcaatggaacaaattccccttatcaaaacaaacattatagcagaaccgattctatgatttattccctgcatgaaagtcaatgttccaggcaaagcctgattttcagagatacatttcataaactcaaaaattgcaataggtcctcaagtcccctcctaacacccataaattgcccattggcttccaaatatgggtgagggagggagggtgaaattttcctagaaagtcttatcttaaaggaccatctgttaatattcaaaatggcctgtattcattgtcagcatcccatacaaatctttagaaactcttgattacattaaattattgattagagaaagacacatgttctttaacagtctccatgtacttttccacataggactataaattatcatatttgtgctacctttttagcagggcaaaaaaggaacagagaaagaaaaggcactatgcaggtacaggtacatgactatgcaaagccatcgtgttcgcaacagcttgggctctcaggaaccaatggtgcatatctcttcccagttcaggcatcatggtggcagcctgaaattggctatggtgagagcagttacactgcagaaactggcaaatgctacaaagcagagacatttctgttcctgggagagcagactgttaaaactgagtcagcacatctgtgatttcaaggttgcttttcttctgaaatagccaacgcagagtaataatgtttacctgttttaaatttctccatgaggaaagaatccatgatttccactaagagatatgttaaatctctcagtcaggaaatttaattctaaatttaatttcacttgcttctttgctgtaactagaaaatgaatgtcctattttattttattttattttattttgagatggagtttcactcttgttgcccaggctggagtgcaatggcatcatcttggctcagcgcaacctccacctcccaggttcaagtgattctcctgcctcaacatcctaagtagctgggattacagacatgcgccaccacaccctgctaattttgtatttttagtagagacggggtttctccatgttggtcaggctggtcttgaactcctgacctcaggtgatcccccctgccgcagcctctcaaagtgctggcgttacaggcgtgagtcatcgcgcctgggctggtttttttttgttttttttttttttaaatcttacgcatgcacagaagatatataaaaaattcctcccccatgtgaccctaattttccctaagtttgtcttgattttgttgcaaagagagtgcactgttttcctttgtatttgcataagaaacaattgtaacaaacttgcccgtggcttttgattttgttttaatgagagtcgtgcctaaacatgaaaagcaaaatattcttgcctaaatccctgattactgactataatgtctttatctctatagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggtcagtggggtgaattttctctagccaccctgtacacattgaaagggaattaccctgtttctctgctccttgagatgcttctttgtgtatgaagagatgaagtctcaaatgaatttagaatcctccttccctttcctacttccagattatagctactgtggttaaggctctttgctgttatctctatttatccatctgaagtaacagccccactgtgccctccacttcccattctctattagaatagagttatgattaaaacaccttcatcctctgtaattacctcaataaggttttgctgtagcaaaggtctgtggagcttgtatatttgcattgcctaatctttctgatggcatgctctttgaaacatttctatttctattctgtgtgatgtactatcaatcactcacaaatatttgttgaacatctgctgtgtgctctacggtgtatatggtgcttcaagcacttagtacagggctatgtgaaattgactttatgagtagtcaaagtatgactacaatctatatacttttgtttctatatttatgtacatgtctgtctcttctagaacgctcattacttaaggtcagggctgtttgattcctttctttattcccagagcttgacaaaaggcttgattcatagaagtcactaaatgaacgataaatgaataaatataagactaaactatagaggcttatatacaagcattacaaaggcatccttatccctaaatgtctctccaagtggcctgttctggtaattaaaattctacgactgtgattcattcctttgtggcttggatttccccttatctgttaaaatggaagcacactctcctgctgtctaattaaatagaatggtaacatttcctgcccacctccattcactgttgtgagaagtaaataaatgatacaacgtacgtaaaagtgctttgaaacagttgtaaaataatcaacaaattaaggatattattgcaagaggttcactaatgcaaccttaatatggacattcctagtctgtatgtagagccattctgaacattgtagaaaacctcaatgaagagtgaaggtaatcaatatccagaatgatctcttcctccaattaacttgttagcaggaagcatagcactaagttcccaagccctctttaagaacttattgatcaacctctttctcatcttgtaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggtaatggagacccgaccccctggcagttgcatagaacacagtaccctctgcagttagcatggaacacatgattgctgctgtcgagagatttagaagttaaatggctatttttaccagggactgctttgtcccttagcactagggtgagttgaaggagcttgctctgtgtgcttcaggttttcctgaaacaagtgttacaaaaggctgggtaactgggagtagtcctgctgagtggatacgatcattctcattcgttttggccacctacttgctgtgtgaccttgggcaagttactggccacatctctaaaattagcatgataatagcaggtaaactgatactaagattatctgtttattgttactgtcagaattaaatgagattaagcacccaaagtgattactaagcattcattaaagtttgtattacttttcagatacaccattcttactcatttattttttggattaagcatagagccagttgcttgagatggagaatatcttggtgggtaaacccagtagcctggcactaaacttcccatttgtcaggaccctgcaaaagccatctcaaaaatgctcagttgatgaatcatagccctgggtcagaattctttatgccacaccctactgttttacattgtccttagtaatttttgctgactggacttggcaaaatattctagtaagataatttgaaggtcatgtgagttgaagaaagagatgaggtgcttgggtatctggtagaagcgtagggtgaataaagaaaaaagaataagttgggaagccttattcctaaatctttggtgccttgtaatctggcattaatcagtatctcttgactgaggaagctggcaagcatgtgaactatggtgggaagaggatgctggctgctgtgcacatgtttctgggaggatgagggtctgggaggagatctctgagaggatgcatttttcctgctttttgacataaagctaggaggagaggtacatcctaagaaagtcattgaagagatttttcactcttggtgctcaggggaggggaagtatcatctttctcagtacaaataggaaaattaaacttgccacagtttcctcaaagtatggcaagattataaggaactcagatgagaaggaggccacactcccaggctatttgtactgctttctctcagattttgtgtctctagagtggagataatattagtgttattttgaccttagaggcagtcttgaaaaccattgtttaatgacagatgtcatcattatcattatctttattacaggctcccccaagagatagtcatagtgatggtaaagtgtcaggattggcacttgtgggatgatattaggacttctgttctcccatcttccttttaggcttaagattcttactccaagccttacttaaacttgctttcaccaaataatgtgctttcagttatacacgttcagaaaaaaatgtagacactaagacttcgtatttctctattgccttgtgagaggtagaaggtgcacaattgtaggagcctaattgactatacgtaaatccagctttggtatttattagttcataatcttggacaagttatttgaactttctgtgccattgttttttccatgtatctcatggtgttgctgtatgaattgagataatgcatatatgcagagcaactgccatggtgcctgacacatagtaaatgcttagtaaaaggtagttataattttgtgttacctctcttttggggtcactaactctaattaccttcttcttttttttttttgagatggggtctcactctgtcacccaggcaggagtacagtggtgggatctcagctcactgcaatctccgcctcccaagctcaggagattctcctgcctcagcctcctaagtggctgggattacagatgtgcaccactgtgcccagctaatttttgtagttttagtagagatggggtttcaccttgttggccaggctggtctcggaactcctgacctcaggctatctgcctgccctgtcctcccaaagtgctgggattacaggcgtgagctgtcgcatctcgtccaataccttattttcaatacagaattaattctgtattaaatgaatttcagaaccaaacggcaagaggaaaaataggttttgaaacaggtgacctctagaaagcagacagtagtatgttggccaaagactttctttttcttttcattctttctgtttgtttttcatactactgacctagcagctatttaaatcactgtcttttgttagcttgagtttatgtttgagttttctaccacaggatgtaagcagatatttggttctaagaatgataaaaatattacaccaatgtacttaaatgaatggagttccttcagatacaaaggagaaatccaacgtaatgcaaaataattattatactgtgcaaatcaatcacattaattacattttttttccttccaggttgcttgaaccacattgctttcctttgtctttggttccaacagaattctgtccatcacctcctgccttgaaagatggatttgttcaagttggttatgaaagatatttttttcctttataatgctctaacttctatctctctgctgagcccataacctattttcttcctccatggtgaagccgtgccaaaaatattttatatatgcattttagttttagtggtgagggttttagtgtgtgactttttttctttggcccaaggtgatgtgaattctgcagaaggcagtgtatcttctatggtgtgggaaatcaacactgccacccagtgaatcaaaaatgtaatcatgccagagggctactgaacactgccaccctaaacaccaaactgcgaatctacaagcttgctctttaactcacagagcttctcttatttttgccactgacttttttttttccccctcataactgtaggccctgggatgaagtattaggtttattccaggagtcaataagacagttagctagagtctagtgagatatggatcattctactttgagcaattgaaccttcctgttcaggaaagaagagtagtcatctgccatttgtcattctagggacttttgttgttcttggcttttgggacattttcgttaatgctgctctcagtctttatgacgaggctttggcctgaagccccagtggtgcctcttcatggctcacacaggatattgttcatgaggactctctccatgttaccagcactgctttcctcacaagggattttgcttttcaaaccccaggcccttgaacatgcattcactgaaaatttactgtttccccaaatgtaggcactattgggagatgaaagttgtgtgttcacgcaagtgtgtgtgtgtgtttgtgtagagagagagagagaaaatcaacctagcatctctaccacccattctgtcctaccacagccaccgtaattcatggagttcctgaatggaacatatgctcagagaataggccaagcaaactcatgcatgttagcaaaccatgaggctgctgtccccaactgcagtgtgtgtggtgttgttttaggagccaggagtcccaaatattgctctgtggactggctgcatccgaatgactcagggaacttaaaactagagatggctctttctcacttgtcctccacgttttctgatttgatagtttgggagtacagcctaagagtctattttgtaatttctacaagtgattatgatatacagccgcatttgtgcactgttgaatcagacttcctcatatgaaagtttttgttttgttttgtttttgcaaggtggaggaaggaataggatcatgagtcgaaacagaacatgtgctcctccccatttccctcaaacctcagcatcagcctggcccattctgttttctactaacttccatgatagagccagagtgggccaggaagcacatactgacaatgggaaggagatatcaggaaatcttgttctaatccctagagcagagctggtcaaggcctgagctccaagccctctcccaggcttgagtttttcaccatccccttgggtggaagacaatgagaagggtaaggaaagagagaccctaaatgagtgtgattacccttcatccatccccaggctcagacttcaaattccaccttgcttcgccatgaaagctcgcttcctgccattataggttagtgaaacgttcttgaatctgacccagccccagcagcattccatacatatagtgtggagtaggagggtaggatgggagaagatcaacattatgcttcccctaaaagttatcagcaagaaacttaaactttcatgaacatactaataggattggaaaatttctgggtgttcatactgacattttgtaggcagtatggcagtattgtcaatgaacagctcataatactttttttttttttttttttttttttttttttagagagagagagacagagtcttgctctgtcacacaggctggcatgcagtggcactatctcgcctcactgcaacctccgtcccccaggttcaggtgattctcatgtctcagcctcctgagtagctgggactacaggcatgcaccaccatgccctgctaatttttgtatttttattagatacagggtttcactatgttggccaggctggtctcgaactcctgatctcaggtgatccacctgccttggcctcccaaagggctagaattacaggcatgagacaccatgcccggcctggtaataccttaatatgaagagttgactgacaaagatgttctccaaatctaataaagaactgatttttcctaaaagttaaaggaaaagaaattatttggacagtgtccaaataattttaatagaatgtaattttagtagaatgcttagtatagtccttggtattttgggagcaatcaatacattatagacagtggtattaatagttttatttcaattaatggtggtgctagtgttactaactatataggggaaaatgtttttatagacacttttctgaatcaattaaatgtagcttgcctgatgattatgatttatagactgaatatatgtaaagaaacgttttgttaatgcaaaatagacaaactctttccttttccatcttttacttttgtttaggatgaaggtacaatgtttcctgtggggaaaaatgtagtgtacacttgcaatgaaggatactctcttattggaaacccagtggccagatgtggagaagatttacggtggcttgttggggaaatgcattgtcagagtgagtggcgtcagttgtatataatttaagatgagaaaattacgtggaagagaatgaatcaagataaataacactcaccatatggcccatgtgttggccttcctttcctgtaaggctgacatgatcctgttcaagttttaggagcgacttgaataagccctccgccttctctagttggtaatgttcccattcagtgaggtcaatttcattgcaatttaaaactttctggtgcaaattaaagtaggccagggaattctctttagatgaagaccattaggatattctttagagttcagttactcaggatgtaccacaatcaatcaactttcttaaatgctttgcctcctgttctgtttggatagaggcatctgaataacagcatctgcatgctgcaccaccctaaaactactctggcttccatctctcttgcaatataagtttgttcagcaaatgaataggccgagctgcagtgatacatttttcctaaatcagttgctctgtgctatatgaggaaagcgctagtgtacacacacacacatacatatatttctccctttgggaatatacctattgtgaaatttctgagtaattgggtattcatacattgggtatacatacatttagatttagtggaggctgccagccttccaagtggttgtactgatttacatctctagcataatctgataaatcaagcttgcttttgtccttactaacacttgatagcatcagacacagtggtgagtgtatagtgatatatatatatatatatatattttttttttggagacagagtctcactcttttgccaaggctggagtgcagtggtgccatcttggctcactgcaacctccacatcccaggttcatgtgattcttgtgcctcagcctcttgaatagatgggactacaggtgtgtgccaacacactctgctaattttttgtatttttagtagagacagggtttcactatgttggccaggctggtctcgaagtcctgaactcaggcaatccacccatcttggcctcttagggtgctaggattataggtgcgagctactgtgcccagcctatttttatattttttctaatgactaataatgttaagcttgttttcatatgttcgttagccattggttatattctttggagaaatggctgtctatgtcttttgtccattaaaaataatcggtttgtctgtctttttcttattttttaatttaatttaatttttaattttaatttttaaaaatttccataggtttttggggaacagatggtgttcggttacatgagtaagttctttagtggtgattgtgagattttggtgcacccgtcactcaggcagtacacactgcacccagtttgtagtcttttatcccttacccccttcccaccctttctctctgaatccccaaagtccattgcatcagtcttatgcctttgcatcctcatagcttagctcccacttgtgagtgagaacatgcaatgtttggttttctttctttttttttttttgagatggagtctctctctgttgcccaagctggagtgcagtggcacaatctcagctcactgcaacctctgcctcctgggttcaacattcaaacaattctcctgcctcagccttctgagtagctgggactacaggtgcacaccaccatgaccggctaatttttgtatttttagtagagatggggtttcactctgttggccaggatggtcttgaactcctgacctcgtgatctgcctgaatcggcctcccaaagtgctgggattacaggcatgagctaccatgcctggcacaatatttggtttttaattcctgagttacttcacttagaataatagtctccagtctcatccacgttgctgagaatgccattaattaattcctttttatggctgagtagtattctatcgtatatatataccacagtttctttatccactcattcattgactgatgggcattgtcttttacttattaatctctctctctctctttctcttggaatccttaagcagaaacaaatgaaatagaatatgaatatgaatatttgctagttgggagttaataaagccaaaagtttgttctttgaaaagattaataagaaacttctacttgaagggcttcttttcctttattgtgaaccgactgatgaaatgtctgtcttttaccttgacttttcaaaggattttttttttttctttgagatggagtcttgcttatcgccaggctggagtgcagtggcgtgatcttgcctcactgcaacctccgcctcctgggttcaagcgattctcctatctcagcctcctgagtagctgggacaacagccgtgcaccaccatgcccagctactttttgtatttttagtagagatgggttttcaccatgttggccaggatggtctccatctcttgacctcatgatttgtccgccttggcctcccaaagtgttgagattacaggcatgagccaccgcacctggccaggatatttttattaggtaagacattctaagctagcagttattttttattttatttatttatttatttatttgagacggagtttcattcttgtctcccaggctggattgcaatggagtgatcttggctccaatcttcacaccatattttggcagttcatgtgcatacactgcacagactatcacgttcccttctacacaggtctaagcaatctgacaaatgataactctgtttgttacataaaatatcatcctgtatttgggtgtgctgtatttatttttatcctgtatcaccaagcatttccgaacatagtgatcagttttaccctcttgtcatcttctaaatttcacttagtatcttttaaagtaggccttattattaacaactttaacaaaccccatcctgtgggacagagacctgcgtttgtggcttgacagagacctgcaggcccagtagtgctggggtgggaaaagggtattattaattgttttttgcttttggttttctccagcaactttactctgatgtctaggtataattttctttatatttttctgggcttttattgaacctgtgctttaagtcttttgtcagttttagaccatttcttgaccattatgtcctaaaacattgcttctgtcccattcttcctcacttgtccttatgggacacaaattatacattttttggaccattatattttttaacatcatttttttgtttgttttccatcttttccccctctgtttcattctaaatattttctttttctttttcttttttttatttgagatggtttgttttccaggctggagtgcagtggtgcgatctcggctcactgcaacctccgcttcccaggttcaaacaattctcctggctcagcctcctgagtagctggaattacatgcatgcagcactgcatctggctaatttttgtatttttagtaaagatgaggttttgccatgttggccaggctggtcttgaattcctgacctcaagtaatctgcctgtctgggcctcccaaagtgctgggactacaggcatgagccaccgcacctggcctcattctaaatattttcaactgacctatcttccaatttattaattctctgtatatttctgtataatctccttttaagaactctattatagagttttaaattttatcaattttatttttcaacttaaaacaattatatatattttatatatatatatatatatatatatatatatatttttttttttttttttttttttttttttgagacagattttactcctgtcacccatgctgaagtgcagtggtgcaatcttggctcactgtaatctctgcctcctgggctcaagcaattctcctgcctcagcctcctgagtagctgggattatagacgcttgccacagtgcccagctaattttgtactttttagtagagacggggtttcaccatgttgccgtggctgttctcaaactcctgagctcaagtgatctgcctgcttcagtctcccaaagtgctgggattataggtgtgagccatcgtgcctggctatttttcaattttagaggtttcatttgtctacttttttactgcatagtgaatttttaaattaataacttcatttttagagcagttttagcttacaaaaaactgactagaaagtacagagagcgcccatctacttccttacttcccgcccagtttccctattaggtattaacatcttccattaatgtggtatatttattataatgaatgagcctatattcttacattattatatttaaaaatattaaaatttttcacttaaaatatagtttttaagcgatgttttgatatgtgtaaacagtgtgtaataagcaaatcagagtaaataacatcaattacttcaaacatttatgtttactgttttatattttctaattctctgttgtaattctccatcttgtcatttaaaaaaatatattaatttcagttgtttcagggcctgtatctgttaatttcattctttaggtaagtctgttactgtaagtctgtttctattgttttttttggttggaatttggtcaattcttgtctttttgaatgttaaattagttttaattgaatgtcagactttacgtatgaaaatttaaaaattggatgatgctatcttcctctagagaagactaacttttgtttatggcaaccagtgaggctggcttatgtctgggttatctctattccaaggatgtggccattaagggattccaactgaaggtatgggctttctacctggccccttctttttgacaggactggactctagtttttaaaaccctggtcctgtgagactgctaaaagctgtttatctttttagcctctgagctatggttttctcttcagtttagcagcctttcagcatattttctttttttttttaatttacaaatacctcaaggaaaaatgtgttaccaaatgtaaatgtaatcaccacattagacttcccttctctctgaaatcttggactttcaaacttgcactgccttgttagtgctctgattctttcagaaatagttttccttttaattttgtacagtctttctattttttttgtcttggtaggagatttaatgtgaaaacagcaaacgcattagaaacaagcagattcaatactagattatgaagttttggaaggcataagatgtgacttgtactttgctgtgtcccaagcagtgcacaacatatttggcaaaatataggcattcaaaaagtgctgtggatttttgtatatattcatggagtattagctcaattttgctacactgatatatctcattgtgatgaagtcaaagctttcagtgcatccatcaaatgctgtttttgaatgaataaatgaatgaatgggttttctgatgacagtgctgtaaagatacagcaatactttgtagaatattgtccaaagtccattagggatattagcaagattttttttttaatcatgaattctgacttgctgtttatactatgtgtgttttttctttttctctgttcttttttgaagtaagctatttgagctaatgaatgtaattgagtaagaaagaatacagatgaaaagtcagggaacactgaacacttttatgtctgcaagtttaaaggtggtgctttagctgggtgtggtggcatgtgcctgtgatcccacctactcaggaggttgagtcaggaggattgcttgagcctaggagtttttaattttttttttaattttactttaagttctgggatacatgtgttgaatgtgcaggtttgttacataggtatatatgtgctatggtagtttgctgcatctatcaacccatcatctaggttttaagcctcgcatgcattaggtatttttcctaatgctttccctccccttgccccccatcccctgacaggccacagtgtgtgatgttccactccctgtgcccatgtgttctcattgttcaactcccacttatgagtgagaacatgcattttctgttcctgtgttagtttgctgaggatgatggtttccagcttcatccatgtctctgcaaaggacattaacccgttatagtattccatggtgtatatgtgccatattttctttatccagtctatcattgatgggcatttgggttggttccaagtctttgctattgtaagtagtgctgcaataaacatacgtgtgcatgtgtctttacagtagaatgatttataaccctttgggtatatacccagtaacgggattgctgggtcaaatggtatttctggttctagatccttgaggaattgccataccgtcttccacaatgattgaactagtttacactcctaccaatagtgtaaaagcgttcctatttctccacatccccaccagcatctgttctttccagactttttaatgatcaccattctaactggcgtgagatggtatctcattgtggttttgatttgcatttctctggtgaccagtgatgatgagcattttttcatatgtttgttggctgcataaatgtcttcttttgagaaatgtctgttcatatcctttgcccactttttgatggggttgcttgtttttctgttgtaaatttgtttaagttccctgtagattctggatattagccctttgtcagatagatagattacaaacattgtctcccattctgtaggttgcctgtttactctgatgatagtttcttttgctgagcagaagctctttagtttaattagatcccatttgtcaattttggtttttgttgcaattgtttttggtgttttagtcatgaagtctttgcccatgcttatgtcctgaatggtattgcataggttttcttctagggtttttatggttttaggttttacatttaagtctttaatccatcttgagttaatttttgtataaggtataaggaaggggtccagtttctgttttctgcatatggcttgccggttttcccatcaccatttattaaacaggaaatcctttccccattgcttttctgagcccaggaatttgaggctgtagtatacactgattagacctatgaataatcactgctctccagcctgggcaacaagacagaccctgtccctaaaaaataaaaataaataaataaataaaagtggtgttttaataatttcagacggcaaaatatccaactggatgaaagttaatgaaactctcctggtggaacatcactagagcacataaataagtgacagctgtgaaaagtttggtttcaacagtaggctgggcattaggactctattggggttgttcattttaagttgtcacattgttttgaggggaggggtgggagagggggagctgttttggtttttagatattcatgggtcaattacgtgccaggctctgtgtgacatgtctttcagtccaccctaacagtgaacttacgtcttcctccttgtcctctaatatgaaaaagcagaacaagtgtgtctgcatcacataagacttttttaaaaagatggtttaggagagcaacgacccttatattttgctctcttttatctttagaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaaggtgagtggcttccatgtctatccaaggacacttgtacccaggcaagtgagagtccttgtggcgaccttcatggtactgtatcaccatagctgtgagtcattccctccattcttgctccttaagatagggtcagtttgtagactgagtaacagattttcttcacatggcacagaaagactcatgaaagcaaggaaaggcaaggatagcctggtgattctgaaacttttaacttaaatcatccttgtgaaagattagctttatatctgttatggtgccaagacaataaaggatttttaaaatctgttttttgtttgtttgtttgtttcctctagatttttttcccctgcatttttcataagtacagagttgagatcataatttatttaaagttctgtatgtttcatttttgggctttcaaagagtttatcagtatttctgaaattgaaaatttagaaagcattttcatttaacactttaaagcagacattattgaaggaaaagtgttgtgattcatgaaattgttcttaatgtggaaacccaaaaatccagtattttaacaccaagaaaattaaaatggtcttttaagaacctaaggtagaaaggatttagaaagccaaattatttctttttagaggtaattttagatgagatagatttgtttgacaataaccccttatttattctttgtttacattttttaaataaatggaaaatattgtatttgtaacaaaaatgagaatgaagaaaaactcacttgcatactattttatgtgatattatctctctagtatgtgatttttaattaaacgctgaaatttatttttaatagtgaggatgaagtactagatttcacaggtgatggtgtgaggtgaattagatgtttctaactaagttctccatgcgacagggtatggagcactcagatactgatggtagatatgggctgtgatgtgaagtggatgagaggcagaacaataggcaagacacacgtccttggagtgccctccctgcctgtcctgatgtgctgttaagttatcaaagctccatctcagaggacagttgttttgtgttctgtaaacactgaagtataaacatgagtttacttggaatatttaaagtcatggaccagtacttacaattctaaaaatgaaagagaacaatatacagttgatgaggttgcacttttggttcaaatgagattgtagactagtctgtctaaaatgctacttcagctattttacagcacagtttggtatgaagtttcatttacccagtagaaaattctattaaagtgggttttaattaaggatgtttttcagatctgtgtgtttttctgaagatgtgaataacagtaactacttctaagcctataacaaacaaaaaaatccaagacttaccagcttccaaagttgatgttttaaaatgttggctgttctagtatttagtctttttttttattataataaagcatacataacataacatttaccattttatccatttttaaatgtatgttcagtggcattaagtaattcccattgttgtgcaaccatcaccacattttttttcatctttccaaactgaagctctatatccattaaacattaattcctcactttcccctactgtccccgtagttagtcttgatgggaataaatttgcttttaaaatagcaaaagcacatactttcggtgggccttaagagtgtgtttacttggttaaccaagctgtaaaggcaacaaagctatgttcttcttaaatgcaaaaattctttgggctaggtaattctatcgtttttttttttttccacaaagacattataatacattttttttttttgagatgcagtctcgttctgtcacccaggctggagtgcagcggcacaatctcagctcactgcaagttctgcctcccgggttcacaccattctcctgcctcagcctcctgagtagctgggactacaggtgctcgccaccatgcccggctaatttttttttgtatttttagcagagacggggtttcaccatgttagtcaggatggtcccgatctcctgacctcatgatccgcccgcctcggcctcccaaagtactgggattacaggcgtgagccactgcgcccggcttgacattataatagtttaagcaaacttttaaaatctaaaatttcaggatttgtcctaaagtaaatttttaaccacagtgcagaactaatttacatggcttgatcattgaccttaagttttggtacatctagattaaggcttctcaacctcaacgctattggaattttaggtctaataattctttgctatgggagcctcttctgtgcattgcagggtgcttagcagcatccctggtctctacccaacagtagcatcctcctatgtcaataacattctgcagttgtaaaaaccaaagatgtccctagtgatttccagatgtcccctgggggacaaaactgcccctggttgagaagcactgatgtagataataccatttttaaaaaatttcattttggaataattttagatttcagcaaagtcacagatataatttctacacacccttcacccatcttccttaatattaacatcttacataacacaacttggttaaaactaaaaaattaatattagtacaatgctattgactaaactatacactttattcaaatacctcatgttttaccactaatgtctcttttatgttctagggtccagttcagggtactacgttgcatttaggataataccattttaaagagaagtgtgctttttttttttttttgagacaaggtctcgcttgtccaggctggctggagtgcaacggcgcaatcttggttcactgcaacctccaccacccgggctcaagcaattctcctgcctcagcctcctgaggagctgagattacaggcatgtgccaccatgcccggctaatttttgtatttttagtagagacagggtttcaccatgttggctaggctggtcgtgaactcctgacctcaagtgatctgcctgcctcggcctcccaaagtgctgagattacgggcgtgagccaccgcgcccagccaagagaagtgttttaataatgaatcttgttattgagactgctgaccatggcaggcatacttcacattgccatcatttttacaggtttatgaatgctcacaagattgtaatgtcatgtccaaggctcttgaattttccaaagtaaggaagtatttcatagtttgtgtattcataaaaacatattctccagataaactacctttatagatatagtaaatgactatctagttttatgatgcaaaagtgtatggcaatgaatttcattgtaataaagctattacgaggtgaaaaaagtcaggatgtttttagatcattcccattgcaatcagggatagctgaggggatggcagtcacattatgctcttgtaagttggaccacggtgtttacctgtcaaaactgaaatgatgactgaattgtcagtttctataaaacacaaagttatagaaagaattttattaacgtaatgacctccagacatttattcactgttgagggagaccacttagacattcatatgtaagaggttattgtagatcttctcggcacaccagggagttctccatgtataaggcaagtgatgttgctgctttttgcctcattatgggcacagcaggcagaatgcagtccaaacaacaaacagtttataagcaccagcttcttgaaagggagccactttattgtccttggattcagaccaatgtagaattaaatgctgcctgggccagtttgttaaatgtgtgaagtagcaccaacttcctaactctttttactcttaattttctgatttcttaggtgggcatgtgttagggaggcatgaatatcccaatgtataaaaagtgcatgacaaatataaatgttcacgagatggtagctattactaccaatgcagttatttgtaatgtgactctagaaactctctatagcttgtaaaatgtatcacaccttgattattattactattgttactgtgcaaatgcattgcagttggagaatactacagaccctggtccagcaattcatataataccttgtttactatgaagaggcttttctcctaacgaccacatctcccttatccttttttagaaaatccgttaacacaggcagtgcctaaatgtcagcgctgggagaaactgcagaattcaagatgtgtttgtaaaatgccctacgaatgtgggtaagtgccgcctttgctcatttctctgttttattttattaatgataagggataatttcttagataatagtgtctgttggatggaaggtgtagcttaccaagagttaagggtctttgtttgcatttcgatgtagtccatctgctgcctgttatttgtctgggtcactagggctgacagccatggcattaagcagtgttctaatctggctagtggagaaggctgcaggactactcgagcactgcttgttttatatataaaatggagcaaaatggcaaaactgtcagctgaggatttagaactttagaggattagaggattaaaactgaaattcctttggcacataaactcttaaagcaatactgatagggaaacagcagctgcttttgttgattcttgaagcatcttctctagatttgcatggttaagaatgccaccaacttgaaatcattccattgtaggaggatatctctgaagtagttaatagatgtctgtgtcatggtcctagtaggatagagatggcacaattaaattaggacaagaaaagctttattagcagaaatatttacaaaaatgtgaacagaggaaaggaaactacaagtcccatggcagtattcctagactgctaacagcttgaccgtatagccatacccaggtccaaggagtaaggagaggggcattcaggaaaaactggagacagagagggctgtgtggagatggccctgaggaggagctgacactctcattttagggacttcagaggtcccacaggcgtgagccaggggcataaacacctcaactgcactgtccttcctgcctcgagtctcctgctagtcagtgctcaccactgatcaaaccaactgaagctagaggccgaggaagtccacgatgtggcccatacatgtcagcttcccaggcaggtggagaagagtggaaagtggatctggggaggaaataagaaatatccagcccctagacttagtggccatttttaaaattaaaaaccaacacatgacctggtgcggtggctcacgcctgcactcccagcactttgggaggccaaggtgggccaattgctcgagctcaggagttcaagaccagcctgggcaatatggtgaaaccccttctctacaaaaaatacaaaaattagctgggtgtggtgactcactcttgtagtcccagctactcaggagactgaggtgggaggattgcttgaagccagggaggttgaggcttcagtgagccacattcatgccaccgcactccagcttgggtgacagagccagaccctatctcaaaaagaaaaaaaaaaaaaaaaaaaagaaccaaaacactaattacttggttttcaatgattttggttatcaaaaccgatatccaacttcttgaagctacagtgggtaattgttattgtatatagcaatttctggtgtgaagaggaatataaataactaaatggcgtgatggaaatggtggtcagcctagatacattctcattctaatattctgactttgctgctaatctttaataattattgtttattttgagtcattttcatcctctttccaacttccccatttcatttagttgatctgcagctcgttgttaatagttatggtatacatttccatgtcattccatggtctcagatactggcaacaaggtggtattgtaaggtctttaccctttcagctgttataagtagttctatttaaagtttcaataaacagatgaaaagatagattcaaaacaacaggatttgtttctgttttataaataactccaagtaaatgtagcttttggtagaaaaggaaaatattagaactaaataaagtgtgtgaatatagactctttctgactccatctggtatacaaaaatgctgtgttgtctaaggtttcagtgacagtaatgccctccttgtctatcagcattcagaaatgtggagttttctgatagtgacatttctaaatagctatttttttccactattttagcaccaatgctaatgaggaaggtaacacattttatggaaattttttttttttttttttttttttgggacacagtttcattcagtcatccagactggaatgcagtagtgcaatcttggctcactgcaacctctgcctcctgggttcaagtgattctcatgcttcagcctcctgagtagctgggattacaggtgtgcgccaccacgcccagctaatttttatatgcttagtagagatggggtttcgccatgttagccatcctggtcttgaactcctgacctcaaatgatccacctgcgttggcctcccaaagcactgggattacaggctcccaaacttatggaaatatttctaaactattttgtaaacatagatacttttaaaagtagcattgaaaaatacagtttcatcttcccgtgatgatttagggtcatccatttttggacaatgcagttttatggacatgaactcttggctgttgggctgggatgagctcatttctcctgcaattaatggtcccatttgactatgatcacattgaatgcttggtctccactggctttctgtctcctttgtcagctgttgctagcagaccttttcttctcatctaatttgctgtacctggtctgttctagatagaactagatcaacactagatatctacacttagaaaaattgtgagcaaataatgagtaaatacaaatatcttcattttgaagacctaagtgagttggacctaggaatgaaggggatttgagtttccaccttttttttttttttactgtgggtgataacatctgggggcactaagctcagagcatcacttttcatttctccttctcagcttttacgaacaaaaatcttgtaaataatgtcattaaaaattcttttcagaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatggtaaggggcctttcatatttgtaagtataagaatgctaaagtcacagtactgaggatttaaaaaatgtggtttctagtttagcagtgggccgaagaagatacttgaggatgttaaagactcagactgatttgacatgcactgacctctcctatacccctcactggagaagggcacagatcacagacctcagaggataagattcccacattcctgatgtggaaatgttctcccaaacaggggtgattccatgccaccttcatgatttttactctgtccttgtattatccatattgtgtactcattttttaaaagtctgacataaaaataacttaaaaatgaaaactttatatcatgtccttaaaaggaggtatcacttgccataaatactaggtaactataaaagttatatgtaatggaactaaataaagttgtggactctagccagatactggtccaacattgactatgctgtttctctgtgagtttagcaagtgttagaggggtgttaaaaacatactagcaccaagctgacactttcttctagaagtaatcagacggatttgaagagaataaaagaagaagttactttctcacgttgtgattcaatatttgctaacactatgtttaagtagtacttacagtgatcttgaactcccccaagagcacagcaaacctcccatgatttgggcagtactatgaaagtggaatggctgggtctccagagccaagtcactgtctgggcttccctatctgtaaatttaggagctggactctatgacttgtaaggtctctgtcgtctcttcactctctgccctcctggcctgtacccgctggcacctgtcccctcactccctcaaggtttgcagcacagactgatgacatacatatgtgactctagccatgtctgggtcacttttggttaggtggtcaccattgtctgctggctgaccttgttactcatctttggaagactcctggctggtgtattccaaccatggactttccatgcacagactccttgcctccttaactcatttctggtttgttttttgggatttgtagccttttgcatgccatgctctctctcaaagcaagttaagttctctttttttctctctctctttgtttgagtcttgacttggttctttgttgagggcttctcatttgacctcagttgctggcttatatggacagcagcatgtatgtaggagatagttgaagagctcttgacttggataaaaccaccccatgtggtctaaccaatataaagcctgctaccaacctcaaaacctatttctttggagtggagcaaaatgccccaatttcctggtcctactgcttttccaggggataatttattatgtcattccaggcaggagcttctacagctctgatcaccacattattactttggaggtgatgttctttgactccccgacctccacaatgtaccattaagcctctttcacttacttttccagctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 2366 - DNA, 63452 bp, Homo sapiens
  source 1..63452: mol_type = genomic DNA
tgtgtatctgggtgagtttccaacatcagatagatcttacaggtcccagcctgtagacatcttttactccaatttcctgaatagatagctttattccttcaaggtaatatagtgcggtggcttctggctgagatgtttgctgttgttttcttcatcttgtctttgatgacttgtcagcctggggtaactgcacaggagaaggtgaaccagtaagtgggccatatgtctctgcaaaacttgcacgtaggaatcacctgctggggaactaagacacttttatgtttgcagcagaggctgtgttagaatggaaaataacctcttttcatgttattactactcctgtggaggaggatgggacagtgaaaagaccgtgcacttggagtcaaattggtctatgtgtaaatcacagctctaatgcttagaagctgaataattcagggtaaatcatctcatcggtttgatccttagtttccctagctgtaaaatgagaataataatacctcttctataagagttaatgtagataaaataagatcctgaatataaaatgtactcagcttatagtagacacttaataaatgacagttctcctgagtggtgctgaacagttaacttaacccctactttcttatctgtaaaagagcatcataagagtgctgtctcatagttttgggggaggataaaattagataatgtgttcaaaatcactgtggggaaggcaaaggactatagagatgctgggtcatttgattctaaaaatgactttatcttttgctatgggataatagagggaggtgatgtagtttcatatgtacattgtgttttacccattctattttcttgagatttccaagcttgcttcatgggttttttttttttggtatcttaatattaagtattttgtggagcctaagcagtcctttatttcaccttcgggatagctttaaagcaatccctgtctcccaaacattaaagattttaaatagaattatttaattctaattcttgatagatgatgcaattttgaatcattagtgcttttaaatgctagagcaagtgagaattcctttaagtaacagttcagaagggaggaaagcatttttaaaagcagttaatttgtaacttgtatttaaaggaaatacaattttgaaatcagaaaattcatctgtaataattagaagataaaggcaagagaactgtgtaaaggaaatctccgccgagatattcttaattataaaagcttatcattgtaatcctttttgaaaatgaacaaagagtcttgatgtttgatgaacttatcaaacaagacagaccagtgaaggggcaaatttcaagtcaaggcaaaatggaaccaattaaatactttacaaagtgctgaaggaggaaatcatgaggtctttgtatctaatgccagtgtgtctgacactgactttgaaagtgaaaaactacatggtgaaatgattttattaggttcaaattctggcactgacattcactagctgtctgatctcaggcaagttatttaatttttccaagcttcattttccttacctgtacaatgggaggaaagtaagaacaaaaattaaatgcatgaaagtacttagatcaatacctgttacctattacctagtaatcattcagtgaaagctgtcaccagtgctgctgtgtgattgttattgttattttttggtatttccattcccttgatggttgacaataatcagacaaaacaaatttataatatgccaattggcatggatctttctgatcagtcagagattttaaactttatttttaagtaatagcactctttttccctgcaaaataaaatttcacatgaaccctaacattgaaaacatattatatagttttacattttaatggtacacatttattttataagttcatgtttaacatttgcttattataaaatcttaaaaatttgttgagaaaaacattttaaaacaatggtgatggaaggaagttataatcttcagcctaaaaatcagtggatctctattacatattttatacaaatttattttataagttcatgtttaacagttgcttattataaaatcttaaaaatgtgttatttgagaaaaacattttaaaacaatggtgatggaaggaagttataatcttcagcctcaaaatctgtgggtctctattacatattttatacaaataacacctttcattatgtgtgttgcttagaagtttttaatttcaagtttctaatttgcttagaagttttaattgcagttcttttaatgtattgggatttgttttttactaagagtgtgatcaaccttagtgaatattccatatgctcaaaaaagtgcattattctgttgttcagtgtagttccaagtcaattaagtcaagttggttgttaatgtcactcaagttttcatcttgttctattgattactgagaaaagaatgttgcaatctccaactgtatttgtggatttgcctacttacagttctatcagtttttgctccatgtattttaaagctctgttattaaatacacacacacacacacacacacacacatctagagttattctgactgcttgataatttacccttttattatcatgaaaggcttccattatccctggcaatggtccttgttctgcaacctattatgtttattattaatacatatagttatgcttgctttcttatgatctgtgtgtgcatggcaaatctttttctattattttattttaacttatatgactatatttaaaaatataattcatgtgaacatacatagatgaggcttgctttagctagtctaacaatctctgtcttttgattatagtaattagaccacttatatcaaatataattattgatatgcttgggtttgagttcaccattttacaatttgttttctatgtgtcccatgtcttccttgtttctatttttttctttttttgggccatcttttagatttatatttttctaattccaaggtggtatggttctgtgggttatagttttcatcaaatttgaaaatttttgccatgattcattcatatatgttttctgccccatacactctcatctgtctttcttatagtccaattacagagatgctagcctgcttgataaagtcccacaggtcagtgatgctctttcttattttgttgttggcagtttattttctgtttcattttggtttctataactctatatttattaattttttgttctgcaatgtttaatctgctgttaagcctgtccagtgaattttaaatttcagttaatataattttcagctttaaatgtctcatttggtaccttctactatcttctactacccttctcattatcctcttaattctcctcaaatattggagcatatttacaataacacttttaatgttcttgtatgctgattccattatttctgtttcgttggtctttagaattaggaaggatttagtatctagcttaatccactcatgttgcagagcaagaaactgaaccttagagagagaaggggagtattcaataacaagataactcagataggcatttatgaatactggccaatttaacccttattacattcttctaagagtgttgattttactatccatcaattgaaggccaaaattttcaacccaatatttccattgatgaaaagcagaattccttaggggaatttaaaaaatgtgaatgaagaccccaaacatagaggacaactatctaagcttctaaagtttttctttttgctaagtaggcctataggcagttgatcctaaagaagtttcaatcatgatgtccctttttattttattgcttttatggacatcagagtatgtttaccaaagcatcttgggccaaggccatgtgaatatttttaatagtagtccagaagactgaaaattgatatgtattcaggaaacatgaatttttaattaatgaaaacaattggagtagtgggtgtgactcaaaagcgaatcatgtaatatggaaactgttattcagggtaactaatctttagcaatacttcaggtggcattgggtctgggctatgaagtataatcaatctgggattaagtcctggcatcaccacgtagtggctatggaagttgcgccagttgcttaaacttcctaagcttcattttttgtttcatctatgaaatggagataatacatatttcttagagttcttgtcaggactttagtaagtttatataaagtacttataacagaacctggtacatggtaagcctttagaaaattatttttattaccctatttctcttttgtcagaaatccttcagaatacatctcagaatgcttaaaaaatgcataggctttggagtctttgttggtttgaattctggccttgccactttctacctacataaccttaagcaagttatttcaacttcttatgaatctgttttactcatctataaaatgggaatagtacttcctaccaccacagggttcttgtgaaattttaatgaaataacttaagattatatgagataatatattcaaggtactgtgctaagcactagggtacaatggtgagcaatacagtcataatctctgtcttccagagcttgcagtctaggagtaggaataaagtgttagaagatccatgtatatggcactatgttagcataggacaggcaggctaaagaaagatatctggagagaatgaactgaagtggaaaggtttggccagatgaatgagatatgattagcattctgtggaggaaatagcattatgcaaatactgcaggagagcccagtacatgcttggaacttaaagttctgtatggaattctatgtgcatctagcacacagtggatacttttttggatttatttattcattcattcaataaataaatattacatgtatgctaggtgttaggtaataaactgaacagataatgtttcaacactcataggatttacagtgtagcgatggagttagtcaataaatatataaaaaaaaattatcttaaaaattgtgggtgcggtggctcacacctgtaatcctagcactttgggaggacgaggcaggtggatcacttgagctcaggggttcgagaccatcctgaccaacatggtgaaactctgtctctactaaaaatacaaaaaattagctgggcatggtggcacatgcctgtagtcccagctgctcgggagactgaggcacgagaattgcttgaacctgggagccggaggctgcagggagccgagatcgtgccactgcgctccagtctgagcagcagagcaagactctatctcaaaagaaaaaatttttttttacattgtgataaatactgtgaaggaaataaatggggccctttgttagaggatatcagagcaatctaaagacaggctgattgagggaattttctgtaaagatggcatttaaactgagatgtgaagggcggtagtgagaagccgggtgaagagcagggtaaagcggagggatcacctgtgctaagactctgtggttggaagtggcttgtcatgtttgagaactgaaggatgggagcaacatgaaagcagagaaatgtgccttaagaagatgtcacaaaattggacagaggccagatcccaaagaaccttaggcaccacaatgagaaatttggaattgagtgtatgggtagtaaaacacacacaaacacaaaaacaaatatcactgagagtcttataaaggaaggatgttatctgatttctcatttgaaaaaattttcttgattgctgtgcagagaatggattggagaaaggtaaagtagaagaaggtcttggcccacaggaaggcataacaaggagctgcttaaaagagaaaatgaagagtttacatgtggaaccattaagtttgccatgtctaagaggcatttgatagacatatcaaatggagaagttggataaacaaaacagaactacagaggactagtctaggttgaaggtctaaatgtaggaacatttgcacagatggtgtatgaagccaaggacgtggatcttaccttcttaagggtgaaaaaagcagaaagagaaaaagaagaaagaccggactgcactttgaggaattccagtttttggagaactggccagaggcaggaagagagtgaggaggaattgtgctgaagaagtccaagagatgaaagttctcatgaagaaaaaagtggttcacagactgcatcttagtcagttttgtgttgttataaaggaatacctgaagctgtgtagtttataaaggaaaggagtctatttggctcatggttgtgcaagttgtacaagaagcatgatgccagcatctgcttggcttctggtgagagcttttttattaaattgacataaacatgcttattgtgttttattgagcacctattatatgccaggtactgttctgggccctggggatataaatgagaaagacaaagtgcttgctctcagctctcatgaagcttctattctagaaaatgtatgcaaatattttatatactttaagttctataaagaaaataaattaggaacatcctggtgagtacttttgtgctgcttcaaaacatggcagagaaggtaaaaaaggaagtgggcacattcgaagagggaccaaacaggaggaggaaccttgctttacaacaactcatttccatgggcccagtgagaatgagtctgtctagccaggagaacccactcactaccacaagagcagcactaagcctttcctgagggatctgccccatgacccaaacacctcccaccaggcccaacactgccacatcgggaatcaagtttcaacatgagtttgtttttctccccctacttattacactcatgcaatcaacatgagtggggacaaataaaccatagcagagagcaagtaaaacaaaactagacaattttccactgcacttagcaacatggaggttgctgaagactgagcactttcaaagttaaatctaaaatacctctattgtatgatggaatctccatgtaactggatgggactggcttaagattatataattagtgataatcagattttaatacaagctgagccaatttattgggataaccccctggtaatcatcagagttagactttctgaccttctagcctaggattggtagctaattaattattttcttttctaaaatgctgaagaggccacattctgggtcaagtgtttgacttgcgcattgcttattcaagtctaggttttagactctttgcccaatatgctgccctattttaaaaggcagatgggaagcatctcacttgtccacagccctatccgagtacattcaatatatttttgatgaagatggggtggtttgatgagcatgtgtgacgttgacaaggttagagtgatgctaacatgtatgccaggcttgtgctcgagattttacatacatgatctcaccccatattcaaaatagtcttgcaaacgattttccctgttttatagctataagaaaattgaagttcaataagtagcagaaatcagattcaaatgcatatttgctggactctaaacctctttcttttacatcggtgtttcaactgtgttacatagtcttacagatgatgcatacaaaaagaaatggcctgtgtttcctcacaaaatttgggaaatgccaggttatgcaaattaaaatgcagaaactctctgaaccttcaatatgttattgagcattttgaatctccaagaacaatatggtgtatgcagttcatccaaatgtatttgaccatggaacttttctcctcttcctccccgaccccagtgcatatctcaggaactggtactctgcagggtacattttgagaaactctgcaatagcaccatatagacttgtgctcattctacagactaaaaaactaaaagtcagttaaagcagcttgctcatagtagcccagcagatgagaggcaaactgaagattagaagcaaagactcctgagtccctatgctccgtattaaatgtcttactgattgagtagattttcgccagctgagagatgccttaaaaatattttccaagatttattaggccatggaattatgaatggctccttaagtaattaaaaaatttatacagttcttttggaaagccatttggcaatatgtgccataagctctaaaatcccttcaatgcagtcatcccactctggaggatatatcttcaataaataacttgaatacagaaaaactggggactcaataatctaattgtttaatataaggggagtggaacaatgtgtattaccataaatagtttatgtttctgctctattattaagtggaagaatcaggatataaaatgtaatactcagtatgacctcaatatgttatgaaaataaacagaagaaaatataactaaatattaatgacagtaaaatttggggcaattcttttcatttatgatctttcttatgttctctgtaatgagactgtattacttttataatcatcaaaaaatgaactacattgaaaaatttattggaataataaaatgttggtcacattggtattggctaaaaggttggagccctgtaatgactttaatgaatggtcctggtgtactttctgtactctggcctgcgtgatagcattagcatgtatgcctctgtctagacttcatgtcacaaggcttttaaaactacagcaatacaccaactgctctctgtctaggcttttgcttccatccattagtactgtttccctctggtttgacacataatgcagtctctatgggcttacaatgacattatcttgacaattgtgtagtgagatgcagaaataatgctggagtccttttctgttctcaaaccttctccctataccttctgtctctccttccaattcgccatgttcccccacttcaaacttttattattagaacagtctattagaaaaatacgtgtgtaaccaaccctgagccatttgaatgtcaagataccaggatctaatttaatttagattataagaatcaggttcaaataaatatctcaacaatgtcactgcctatatcccagaaattggttttattatttcccttccctccctctctcactcccttccctcccaccctctctccctccctccctccttctctcccttccttccttccttcctttcttccttccttttttccctccctctttcccttccttttttccttttgtaaatatttactgagcactttccatgggtctggcccatgataggtgctgggaactctgtagcaaatatagacagtatctgcattcatagagcctagaatctggtagagaagaaataaatcatacaaatattacaagtttgataattaagaattgagaaaatgtgcagagattgacgaaatcatatgaaggaggttttcaaccagtctggatatcaggaaatatttccctaaggaattgatgtttatgatgagaatgaaagatacataggaattaaccaaagtaaagaggtagataattggattcattcagggttgggatttacagttaggtgtgattgagggaacagtggggtctaggtgtttagaatataggtaagattgtaaagtgatgaatcatggaatcaaaactggttataaaggtaaataaagagaagagggggtcttattgaaagggaggaagcttagatgttgagataatggagatcccaatgaggttcaagaaaaagtgcagtgggaatccccttaagcatataagatagaagaacaagaggctgtggaggccccaagtaactattcacaggtgattcatgaatgaatgacttggaggaggagttgttttagagagtgagaaggttcagaagagaagataattacagataaggaaaaggagcaaccgagcaaccagagagttggatgactcgtttataaggatgatgagtctcccagcatgatgacaggaattgatgtagggggaatattgtgagctgggcaatgaagttttctttgaagggatgggagggcttgtgcctgctagcaccatgttacaaattagagtttctcaaagtgtgttctttagaccccagaaagtccccaccatcttctcaggggaactgtaatttcaaaacagttctcataataatggtaagacattattttccccttttactgtgtttacagtcgcactgatggtacagaggcaccaatggataaaactgctagggccttggtcaaaatcaaggcagtggcactaatctcataggaaaaaataaacaaacaaacaaaactcctaagttttaagttttacttaagaaagtccttctagaaacagtaagaattgttaatttaattaaacctcaatccttgaatagatgggacttaaatattctatgtaacaaaatgggaagaacgcataaagaaatcattgagtatacactgagtatgatggttgtcttgaggaaaagcaattatttgaactgtaagttaaggtagccacttgtcttactacttggactactataacaaattaccatagactggatggtttaagcagcaagcatttattcttcacagttctggagactgggaagtccaagatcaaggcactggcagattcagtgtctggtgagggcctacttcttcggttaacaggtgatcgtcttctagctgtgtcctcacgtggtggaagggatgtgggaggtccctgtgatctctttaatgagggcactaattccattcatgagggcttcaccctcgtgacttagtcacctcccaaaagccccacttcctaataccatcagattggggattaggtttcaacatataaatatggggggacataaacatcagtcagtaagaccactttttttcctggaacatcattttttcttgatgaaaaaactaccaaactatggttatttgggcttagatatttggcatgcattgtataaaaaatgcagagaccctatcatttcaaggaaaacaaataacattacttgttactaatgacaagatttgagcttctatgagaaaattaaaatttggggaaacatatccactaccatgaacttgacgagatcactggtgatattaacaggtttgatgtttagatattatacagtgaaatgcattaatatttgtaaggcacatactcagtgaaccattattttccaaatttcaaatgcctgatatcataaaaattgtatatgggcacaagatccattcaaagtataaagaccaatggattttaatgtgacagagaacaaaaaattcacttatatgctttcaggttccacatgccactaacatgtaagaaattgccacttgtcaagttttcatgtaataccaaaggagaacatccacagttattggaaaaggctgttaaaacactcctccccgtttcaactacataaccatgtgaggctgacttttcttcatagatttcaaccaaatcaatatatagcaacagattggatgaagaagcagaaataagattctagctattttctactaaaccagacattaaagggatttgcaaaaatgtacatttatggtaacatgtaataggtttgttattgtaattttaaataagttaataaatattttttaaatttctcagttttaattttgaattctgtgaatattggtagatctagcccacttaccagctcttcggagtctttagtaatttgctgaaatgtaaaggtatactgagaccaaaagtttgagaaccagagttaaagatagacaaaattttctgaactattccatggctccttgtgccgagtttcaacttaggtgtcattattcatcaaattcattacatcattagcatgagatttgaaacactttctgttcctacactagggttataatcatgccattcatcacagcagtggctgcctggctctcagaggctgtggtaattctagtgttaacagtgttcccactttcccagtgggccaatctggctttgaagttgtagcagtggtactatgggaagaggctaatgtggaagccaggcaaacttgcggcttgtctctctttccctgagtaggcattttaattggtgagggggaagtatagggtaagagaaggatcgtgggcttggagatatgctctctcatgtctgttggctgattcataaaatgaggcagtagcatgatgaggagcaggaaatgggttttgccatcaaaccaactagttccaattttgcctctgtcattcctgggttatgacttcagggctacttagcttttaggaatcccagctttcttacactgtacataaaatagatctaataatatttatctccaaggattgttatagagattaaatgagataatccacataatgtcccagcatgtaataatgaaaatcatcttgtagtaaacctttcataagcatttcaatacactttcaataacccttttaggtaatgttttttaatgtagttttatagatgggaaagctgtagttcagagatattaagtaatttactcaagttttcaaagtcagcaagtggttaagattcaaacccaatcctcttaccccagactccacattcttaaccactgagctttctgctactttggctcttcaaaaattgttagccctctttaatattcttctctctaaaattataataatttgatgcatgggggactgatatagtattaaagggataatttatataaaccctctagcaccatacactctctcatttctgttggcatttctacataaagtaggagtacaataaatgttcattcctcatttcttccaaaccatgttttactggaaggaaaatgtgcacagctttctcatttgcttaaattttgcatctcaaaattgatgcatggatcttccctttctttaggagagtaagacgggcagctacacccgcagcagttacctgccagctgagcaactggtcagagtggacagattgctttccgtgccaggacaaaaaggtgagacacttacaaccggtttgggggcatttcatatttgatatgtgtattaggcattcaaatggagattaagcagtccactatgtctaggggcctggggagaaattgggtctagaaattgttgtttgaaatccattatacatggatggtgaaacttgtttccgtgtctcctaattttgtttgtaaggtagtgttgagtgaggctgcaaaagatgtatgttatggctcataggcagaaaagtcactatctgtacatgggcacgtttgtttctctctgagtcatggcaaatctattgcccactcatgagggtcttctggaggaagtaatagcttagaaacaaaatacaaagctgcccatgaggagatgagataatccaagggatatcccagagtgtgttcttgagaattccactttcatatattgaaaagaccaacacacccaatgaagagaggtgtgtttactttgcctatctaaatggttttgaatagttcaaaatgatccctagtaccattgacatatgaagggaagagggatgttgggagccctccactcaggcagaggcgagtattaaaattctgactttgttcagaatccctggctcacagtaataataaaacatagtcagccaggtgtgagggctcacacctgtaatccaagcactttgggaggctgaggcaagaggattacttgagcccagaagttcaagaccagcctgggcaacatagcaagacttagtctctacaaaaaatacacacacacagaaaattagctgggcatgacagtgcacacccacagtcccagctactcaggaggctgaggcaggaggatcacttgcgcccaggagtttgaggctgctgtgagcttagattgtgccactgcactccagcttaggttacagagccagaccctgtctcataaataaataaatacgtaataaaacacagtgtaacttctagtctgttttattattgttttaaaatttccttcagactcacatgcctgtatcagatgctcccttccccactcggcataccactcactgcctgaaccttgtctattagcacattacctctgagtttaagtgttaagattcagttctgcactttagatccagctttgcctcttatctgcattgttactttgggaatatttttaatcatctttgtgcctcagtttcattatgtataaattggagtataaaagtacctactttctagaattattgtgagcaatacatgagtaatgcacacaaaacccttctcatgcatctggctcagaatacatgtttaaggaattccagatgttttccttcttttattttttcatttttatttcaatagtgtttgggaaacgtaggttttggttacatggataagttctttcgtggtgatttctgagattttggtgctcccatcacctgagcagtgtacactgtacccaatgtgtagtcttttattccctcaccctccccacccttccacccgagtccccaaagtccattatattattcctatgcttttgcatcctcatagcttagctcccacttataagtgagaagatgtgatacttggtttttaattcctgagttacttcacttacaataatggcctccatgtccatccaagttgctgcaaagaccattaatttcattccattttatggttgagtagtattccatggtgtatatgtaccacattttctttatccactcgttggttgatgggcatttgggttgtttccatagttttgcaattgtgaattgtgctgctataaacatgtattacagtctcttttgtatataatgacctttttttccgcttaggtagatacccagtagtgagattgctagattgaatggtagttctagttatttaagaaatctccacactgttttccataatggttgtactagtttatattgccaccagtagtgtaaaactgttcccttttcaccacatccatgtcaacatctattatgttttgattttttaattatggccattctttcaggagtaaggtgatatctcattacagttttaatttgtggaatgccagctgttttttaataattatctgtgctttcctcttcattctcagtccgattgccttgaattaatccctgcttttctctcacctgagttcttgcagggtttgtgaatggtcatcctgcctccagacccaccactcagttagtgaggtgctctgggaatgttcctgatgagttattcaaaattgcatagctagtaagtggcagaaacacacacaattttgacctagttcattcaacatcaaagcctgaaatttgttattctgcctctctcatctctgagaagtgctgaagaatcttagactgttcctgtttaaatgtgtctgatccctacgtgctcattttgctctgacatcctgtattagtttcttgagttcactggaacaaattcccacaaacttggtggcttaaaacaacagaaatgtattctcttacagttctggaggccagaagtctgaaatccaggtatcagcagagccatgctccctcttagaggcgctagaagggactctgttactaggttggtgcaaaagtaattgcagttttggcatatcaagtaacagcaaaaactgcaattacttttgcagcaacctaatatttgcctcttccagcttttggtggcattgacaatccttaccttgtggctggatcactgcagtctctgcctccctggtcacgttgctgcctcatctgtgtgtcttctcctctgtgtatctgcctgtaatctctctctgccttcttcttacaaagacactgtgatgacacttagtgctatccagacaatccagggtaatatcctcatctcagaaactttaataatgtctgcaatggccggctttccaaataaggtaacgtttacaggttccataaattaggacttgatatctttgtgtggccattattcaacctgttatatatcctaaattaaatttttcgtatttatttcagtttagacagcaggtaccacaagacaatgacttgcagtttaaatcagaatagaattatttccttactgactcaaaaacacgtgcgtttttaaagtaacccttaaaataattaattctgttaattaggtgaaagaccaccctagttttttttattaatatgtttcttcttctcaaaatcatccaaacaaagatgtacatttatggaaggaaacattatctaccagttagaaaagaaaattatgtcttaatgatcccaaccacaggcaatagcatggagaagtccctaagggaatattggcaccaaccttcctgccacacaaatatcttcattatttgatagcaacctagaaaatagggaatcaatgggaatgaaccttatggcttgcaccataattcccagtatagatactataggaaggatgacaatggcaatagtcaccatttattaaataatttctaggtaccagacaattgtgcaaatgccttaaaaaattatcttgtttgactttcacagccaactgtaaatgacagacatcatcatccactttgtttaggtcacccattaagaacatgacagagccttgatttaaaacttggtcagttgactccaaaaagcttccgcggctgaccgctccacactactgcctcccgctgaaccatccaggagagtaatgagtgacataagtggtcacttcaattccttttgaagtagtccaacagctggatacaagaatgatgatgacattgataactactattattgagtgtatatcagaaaccaggcaaattgatgatttctttacatgtgttatgatgaatctttgcaatgttctcagacatatttcatttaaaaatgagaaaacaggatcagagatgttaagtagttgacccagtgatgcatatacagtaggtggcagagctggaattctaactcagctcaaaatgggtttcccatagtatatttaacttcataaacttgtgaagattaaataagataaggaatgtaaagtgtttggccaagagtaggcactcagtacatggtagccaccataaccattatcaagttggtaggtacaggtgttaaaaatcgaatataatttttagagtaagaaagaagattggctgctaattcaaagaaggagtactcagaggcaagtacctactgtgtctgatttcgaataacattatgtgttatttgtttggagaagctcaagctgttactaaactatattaaatctgttcctataagtcaccatgaaagcactgcagaacagtggcatgtaccagatccctgttgcttatttaactgtgaactcatcaccccataacatgtacaacagatatgctaaggtatcctggcaccaagtttcaggctcaaatttgcccttttgtcaaagaagcaaaaatgtagtttagaatgacctaactgcaatattccaagcagcaatattttctttctttggaccttggataaatacctttacaattcactcccaacctcattctcaatgaagtggaattataagcacaacatattcataataaaaagctgtaatcaaaatagatgtcatgtaatggcaaacagtcgtctgagttggagagcactatgccatgcataatgtccttgttagatattccattctcattatgacattgactggatatctactcagtgctggccatgttaaaaagtctgagatgctttccttcaaataacatgtaacattagttgatgataaaggaaaaatacagaaaaaaatttaagataatatatcttaattcaagtagaaaatgaagacaataagatctatatgagtttaaaagaaagtcaaacctttagggtatgaattgtgggaaaaagggtgaacagtcttaaaagacctcatggtggaaaacaggctctaagctatattttaaaggaaggaaaaatttgaaagtgagatgagaagtcattctaagaagaaaaaccatgaacaagagtctacagccaggaataaacatagtatgtttaggaacaatgagcaagatatatttggctgaagtcatagtttcatgtaaggaaattatagaaatgtatttaatgtggatagcagttacacttcaaagagtgggaatgactaaacactttggaacagaggaagtaacagataaaccagtgttcttggaaggcacatccagaaataaactgacataaagagaggaaaaaaaaaagaaagaaagaaaattggctctacatttctatgctgatcactcctttatttgctgtgctgaggggcaagagtgtgggtgggatattaaaatatactgatgttctccaactggtcattaattacaatctcttcctacagagtttacaaatctcttactgctgttattaactgaaaggcaggacagacctatggacaggtttgatcttcacctctccttgctacctttgccactttgttaatgagcagctaaggagacagaggtgggtaagaagagaagtgagctgcactgctccacaactcacccatggaatcacctggaaatactgcacggataacagtaacaatgtgaaaaccacctctgcttattgaacaccaataatataccagaaacagggctgggggcttctttacacattctcttactcagagctcacacagtcctttcaagggaaaatgccattacacccatttcacacactggaagacagaagctcagaaaagggaagtggcttgctcatgggcagttggtaagaaaatctgggccctgaacccaagtctgtctaatcctcatgtccatgctctgtcaactgcaggacacaggtgaaaggatattagtcactataattaggtaagtcatttagctcacccacctcattgcacagatttagaaactgagccacaaagtaccagacactgatacttcacacagcaagtaagaaattgattgaggtaggaaacccacttctcttgctgctcaaatcattgctttcttacctacatactaacgttcttaaaggaagggcccgtggactgagccagggagagaggcaccaggaaatacagggctgcacgtttccttgtcggccactgtgtgtttgctatctgcactgcatgttttgtattattacacattttatgtcctcaactagggtctacgcttcttgaaggcagggatagaacctcatgtttctctggatatcctagttttcagcttccttcttctacgctagtgcctgacactgtacactatatagaaagcatgattatgaaactctaaagtcccaagattggcgtgcattttaattccttccttctgtcaagtgtctatttatctgcagtcaaaggtggacccagggactcagatgatgtcttcagagctctctttctctctctatctcttggatgggtgctttctgcataataggcaaggcatctacaacttgatgtccacagtttccaacaattccaggagaaagaatctgtctctttgtaaaagaaaatccccagagagaacttgattggatggggttgagtcatgtgccaatccttgaagcaatgattacaacaactaggcagatgtgatgctttggtgaaccaggcctggttcatacccacacatccctgtgactgaggaagtgagtcctttcccaccttaactataggagatatatctccaaagaaagaggggaattccaggaccagaagaaatgttgcaaagaaaaagcaacagatgtcttctgaacgtgcctcttgagtacctgaccttagatcaagtgccaagtgtatgaagccaaataagacatggtcctctcttctctaccctcaatatgaaaattgctcacagtctggtgggagagatggagaactacgtggatgctcaattgcaacttcatatgccaagtgctagtagacagggaagcgagcaacttgaagaatgttactgaaagattaataggaatttaacttcttcaagaagagggaacagaggttattcctagcaagtaggaagaccctagaaatatcttgtccaggcctttcatttgatgcttggaggccctattcaacgttccaatcagtgattgtgccacttctggtgatacaccactgtttatgcatattcatccctcaaaagacagcttcacaggcaggtctcaatcattagataattatttcttatgttgagccgaaaccaggctgcacaagtcttggttgattgattgattggttgacaagaatgtgtcttgttcaaaatctggtttagtaccgacaccggagcctcttgcagccaaacaagtttgggggaaccatctgcagtggtgacatctgggatcaagccagctgctccagttctacaacttgtgtaaggcaagcacagtgtggacaggatttccagtgtaaggagacaggtgagtagcatttcagcagaataacagctgtgcctgtcaaaagtgacatgtgaaacacttccccagggagcttattaaaatgcatactcctgagcccttcctctcgaggttgccattctctaggtttgggatgggtcctaggaatctgcattttaagccaagccagcagcccaagtaattttgattcaactttgtaggaacatctgttgattcatttagaaaaagacaattcattcattcacccactcattgaacaaatattattgaccacatattatgtgccaggaagtatgctatctgctgttaatatagacatgaaaaaaataatgcaccttaccttgatgtactcctagtctagagacctaggaagagttaattacaacactgtgtgatagccatgggcacatgcatggcctagtgggtctttctagcaggaggttcccaaatctgctttgggcagtctgggtgggctttgaaatggtatttgagtagagacttgggaaacaaaatggaactttctaggagaaagaacatgcaaaagcatggggatcagagactcccaatcagcccagaatgtttgcagcatcagggcttttggaagagaggtaggtgatgggtaggtaggtgatgggcaggtagggtccagactgtggcatttggaagaagaggaatggagaaccactggaggatactgagcaaggggattacatgggcagactggcattttagaaagattactgggggctgcaatgtggagaattagagagagagaaactcaggcaatgcccaagctgggaggctgcagacaggagctcattaggctggaaggaaggcagaggcagtgagaacagaaagagaatgggacagatgggaggtttatttctgaggaagaaaggacttactgattgtgggtgtgagtctggagggagaggggaacccgaggagcagccacagtctcttctctccaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtgaggccctgcctactagctatttaggagcagggaatgatttgtcttcaatcgtgagcattagttttgaggacagaagggggccattttggagggttcctctggagtgcatgctgtgagctgctctcattgtccccagagatggcttgtccagtcctgcctatgtgacactgcccatgctctcccctcatgtctctgcttgagagttctcctctcttttagtacacctaccctactgctcatctcccttcaccccagtgccatttctaaggcccatttaagaagccacagcttccatgaagccttcctgatgtctcagaaagatagctcttctctgatctaagccgttgcctttccaatagccctgttcccaatctgctttgcactgtagatgcttgcaataaccagggctaatggtgtgacacagtgtaaagaaaatgggctcagggtgagacagagaggggctttaacccccactttcccattgcttacttaaacctctcagggcacagtttctttatctgttgagatgaaatcagccttgattctaacttctcttcattcaccttatgttcagggtcagttccttgaatgcatcacactctttccttctgagccttaatcaatattcctggaatattctttcccgaattcctacctgggtaactcctcatctaatgttctgcactgaattttgtctccccttacccccacatttatgtgttgaagctctaactcccaatgtgactgaattaggaaatagggattttagagaggtaattaaggttaaatgaggtcatagggtaggaccctaattcaagaggactggtggctttataagaagacaaagatataccagcgatctctctctttccacacatgcatagccaatgagacatgtgaggacacagcgaaaaggcggctgtctttgagacaggaagagagcctccagcagaaaacaaccttgataacaccttgatcttggactcctagcctccagaaccatgagaaaataaacttctgttgtgtagggcacctagtctatggtattttgttgtggcagcccctgcagactagtacaccgaggtaccatctcccctaggtagtctttgtaacagccccctcccctgctcttgactttgcctaggttgacttagtcccctcccattgctcccagagactcctgcaagtcttattctcacagctcttacccaataggctggggatgtctgtcgaggtgtctatctgcccaggctaggggctccttgtcatctctgcttctccagtaccggaacagggcttagctcagaatgacgttccagtattgttagtcctctgccactctgtctttgcctagggtcttgtctcctaacttgaataaactctttgagggcagaggttgcttctgactcagctttttcatctcctcagcccctgtgtcagagcttgtcctatagcctctcgctgagtgttggttgaattgaaacaaatcaatatgatcagctggatctttacaaataaggaaatgaggagatgtagtaactgtcacagagtgacccagccctgttgcagcccacccaaggacaagtgggggttccatgaaatgcagccctcattcattatggttaattgctctgagatcagagcccacctacttgatggaattgaactctgtaagtgcatgtagatatacacatataaaaagatgagaaaattctgttttctttcataccagcagtattagtttgctgggattgccataacaaaacaccacatcctgagtggcttaaacagcagaaatttactttctcacaattctggagactagaagtctgaagtcagggtgtcagcagagtggtttcttctgaggcctctctccctggcttgttgatggctgccttcttcctgtgtctgcacatgttcttccctcgtacatatctgtgtcctaatttccccttcctgtaagaacaccactcacattggataacagcccaccataatgacctcattgcagcttaattaccccattaaggactccgtctccaaatatactcacactctgaggctttgggagttacaatttcaacacatgaatgttggggacatgtaatccagcccgtaacatcaataaaaggggattcttgttgatttcaaaagtgactatagagtaaacaatagaagtgtgaaatattgacatgttgaaatgaaaaataatcccttccttattggcagaacatggatcttctcccacgtgatttaactagaaacatttcaaatacgctttctgaacagtgtgcttcacccacactgaatactgaaactggtaaaatggtcctgctccactccagccactgatgtttgatggttcttctatttatctcagatctcaaaggccttcctttcttgctcttattttttttctaatttaagcatttcccagattaaaatttttatttattgttagagaagtaatacatgtttgaaataaaaattgacagttttcttccatcttctcttacctgcactccgtccaacagccctctctcccttccctccctagagctgacccctgttaacagtttggtggagatacttccagattatgtaaaaactgcattgacaatatgcattatatagaaaatatacctatgtgtactgggcattatagacacaggtatattttacataaatgtgatcatgctatacatattgtctgcaactttcacttttatacttaatagtagagttttaagttttcccccaaattttctatctctttttaataagcagcatattcttctataacatagttagcaaactatggcctgaaggccaaattcagccggctattcttacaaataaagttttattgaaatacagcttttaccctgcgatgacagagttgagtagttgcaacacagccctgtgacctgcaaagcctaaagcatttactatctggctctttattaaaaaaaaatttccaactcctcatctatagtataattatataattatttgactacttcctattgaaagagaattagattatttcccatattttcctcttacaaaaatgctgcaatgaacattcttgtacacatagttttgtacacatgtgtggatatttctgcatagtagatttccaaaaagtagaacttctttgactacacctttcccttttaactggggctttcacaaccagcttttccaaatatatataggctttatgcttagaggttatattatactcttagggattaccgtttctttgagttttgttcagtctattaagaggctgtatttataagctacaggcagaaacatgttcaatggtcaggaagatagaaacttcagggaaagtaaagggaaggaacccagattttactatcaacaaaatctaggaaaaaatccagctatgactagagacaagttatttaatttttctgaacttcaatttctgcatttgcaaagttgtcgtgaggttgaaagctaaacgtctagtagagtatgtattcaatttactgtagttattattacatcacttccactaatatgaagaaagagaaggagaaagaaagagaaaaaggaagttaacatacattgaatttctacaatctgccaggtgctctataattatccacttattcctttgaagtgggttttattcgcagtttatcccctgctcctttcctgccttgtgccttttcacagaggccataaacaatcatgacgatcgctatgctacaggtagtcactgcatcccttgggaacacagaggaggaaacagcagtctttccagagcattcaaagaaggctgttgacagaaggcaacatttgagttggctccttaaggttaaataggagtttgagagacaaaaaacgagcaataactacattatctgcaacataagaggctttgattgtcaggtcttagaactcttagccaactctacagtttttgttctgttaactttccctttttagaaaattaaagctgtatttcatctgcttgacattattttacctgaatatggtaaaaccatccatatcctaaaacatggaacccgggttgatgatttttaaatactctagaaaggaaagtatagagaaatatttctggaagagtgttgggctagggaaaagtaagtataatttgttgaatgcctaatatgtactttactgctgttttagtttcatactctcagcatcacaaaaaccatgagaggtaggtattattatgtctattctttaaatgaggaaaatgaaatgcagagagcttctagactgtgttcaaagtcatacagctagtaagtggcaaagctggaaattaaacaggagtctccctgacttttgaactgtgcaccctccaatgtcccatgctgcctcaaagataatggcctttctgaggattagagtctcaaccttagcactatgaattgcatccaatatttcaaagtttttttttgtagcagcagagcccttatactatactaagaattatacttaatactaacaattgctacaatagcaacctttattcagtccttaatgtatgctgagcacaattatgatttctttacatgtttcaactcatttaactctatgagggcagtagtatttaagaactgctttttacaaatgactaaaccgaggcacagagaggttaaatggtatgcctgaggtcacacagctagatgtggcagagatgggaaatgggcccagactgtctggctgctgcccttggattcatgataattgcacatattcttctctaacttattcaacaaatatttagggctgcttcccatgtgggaatatgattctagatgctaaataggactgtctagatgatctgggtaaaggaaatctgaaggctcaggccagcccatttagtctccaagtgttacctaaagtggcccataagcttcttggaggaaccccagggctccacagaacatagattgagaaactgttacttgtaccagctacaacatctttcagaagatgacattatatgctaccttgcttttctaattctctctcctaaaagctgcttttgcttttgctttttaatttccaacttttattttaagttcaggggtacatgcgcaggatgtgcaggtttgtcacataggtaaacgtgtgccatggtggtttaatatacagatcatcccatcacccaggtataaaacccagcatccactagctatttagaagctgctttgttccatgtaggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagtaagtctgaacagaggggctctgaggccactgtggtgtaggtggcagagaggcagaggcctatttgtggagatgacttgctctggaagcttttgttttctataaagtttgctggtgtctgaagtctccttcatacccatccccacacatgcttagtgtcgaagggtgctgagaggcagatcataaatgtggctacccacctgttaaatcttggctccattccaaaatcagtaaaatagatctgaggctctattatctgggctgccaatcagacaacctatttctaagttgtggctctgttagactatatacaagactgttagcagctaactcactgccctccttgggcccagttttctaatctgtagagtgtgggggaggacagggcatagatgagcaggattctgagacctgtgcttttgtttcaccaaaggcagctcacactgatcattttcatgtcttggctctttgtatgtgattttgtatgaagcaagggttcttctgtacaaaaatgcttgcaaattgctgacgatcactaagactctctccatctctacaatttggtggtctcttggtcacttggagctcatgatcagtcaagggcctactcatggccattaattttcttaccactcatcctttgggtgaaacatccacacagcgaacatcattgaatgcttaacatgtgtcagatcttctactttcacacaaattctcccatttaatcctcacaacacaatgggatagatattatcattgcctcattttagatattaagaaaaagaaacacaaagggttaaagtgtcaggatcaaactctactgcagttggtggcaaagacaagacccaaacctagatctgtctgaactaagtccaggctgcacaacatttagaagaagagatagattatacactttctagagagagatagtaggatcctaggattctgaacaaaatactgacagaaaataaggccaagcttatagggcctgtttttaagaagtttgctcccccaaccccactccaacctctactctctatcaggccaatggtaaatcaaggtggaagacataaacaacaccatgttcctaatctcaaggaaggtcttggggctctgtatcaggcaagacggactaagtgctttgggaacaaagaattctcaaatctcagcagctgaagcaacaataccttgcttatgctatttgtccaccctaaagtagaaaggaaactgaccatcacagacactcagggactcaaggtaatggaggctccatttcaacacatgctctcatgattgcagagcaaactactcacaggctcataaggcttacttctttggctcaaacaaggccaagaccatgtctcagttcaagacagcagagaaatgaaatcctgtataccactgcctaagacaatccaaatctgcaggtttcctttgcttctttcctcccaggctcctgcccagatgtggctttctgtatctcactattgcaaagacaagcagccagccttctctcctggaaggataagccagcaagaaagaaatccacgctcagagcaatatagcatttgatcagaatcatctgcatctgtgtgtgtgtgtgtgtgtgtgtgcaagcacatgtggtgtgtaaataagtattttatcagtaccactaaacactaacaatgctgtgttttctatattttaataagtatcagtctaatgactggattgccttataaaagaattacctaccataatctaaaattttagatattttacaaagcaaagatttaagtattaaatatgaattgagaaatggctctatgtgcacaaagctaatatctatccttttttttttcaggccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaaggtattcaaacataatgtctgtgtctcacagtattccataatatacactgaacacgtattaccttaattgcattaaaaagtacagtagtaattgaaccttaatttgcttgtgtaattggaaatgtctgatcagtggtaatcaggtttgtttttcttattacgcttttgcacacagaatcatcacaaaggaaataaaattgaatgataagactaggactcttatcactttgccccccccatcatcattttttatggttacctggagcatatagggaaatgtgtagaatggtaatgttttaagagaaacagccagaccctctaaatttcacttggaagaattgtaaagcaagccttgcttttccaaaaagatagaaggactggtatgctaaaaaaaaaaaaaaaaaaatttcatttttccagtaaaccttcaccattaagtgcctattatcctggggggtcaatatatgcttccttgaggaaagaacattgatctaagcttagatctaaagattagtgcaaattgtccagacaaagggagacaaaagttggcagaaaggtgctctaggcatggaaatcagcatgtgcgagggcctggagatgaggaagccacacaaaaacttgggattgaaagtacttcagccagctgaagcacagggtgggaaaggaaaacagagagtgatgaggttggagatgtaatcaggtggccaggggaatatttattgaattaattagaagcttactaaaaattctcaattgcattaataccaagactatggatcaaggtggggttcaaaaattatcttgaatgatgaaaatatagttataaaaatcaacttactcaacacacataaattgagtcctagagctttgccaaagaattagctattgagctgaaggtaaagtcctatattgttcaagggttatctgtagcgtgttaatatggacttttctaaaagcatgtggactcctctaacttccatcatcactttgaatcaaggcttctattgcctgaaagtaaagcccatagatggccatcttcctgtaaaaccaatccaaaattcttccagtgctatctcttatttttttatataaagatgctgcttttctttattacttagttcaagattactattggaatgtaaactccatgggggcaggagcctatctcattcaagattatgtcctctgcacctagtgtaatgcattctactataggcattgtagatctttgctcaataacttcaattgaatgacatttcagcatgtcactaaagatatcttaaacacagtttttaatggatatgtaatattagcataggaggtttcacaatgcagtgctttgattagcactaggagaagtgtgggggtgggaatagattgggagaagaacagaagggtgaagcacaatgaagaaaccattgtagtagctcacccaggtgagagctgatgagaacttgacctaggcaggggcaatgggaacagagatggaggtgtgggggaagtctggcacacattggtgcctagtatgtgcttgtgaaatatagtagtactccaattacatgtatttatgttcatatacgtgtttatatataaatatatatttacataaatatatatttatatatatttacataaatatatttatttaaatatatatttacataaatatatatttatgtaaatatatatttatatttatttaaatatatatttaaataaatatatatttatttaaatatatatttaaatatatatttaagtaaatatatatatatttccgtaaatatatatttatttaaatatatatttacgtaaatacatatatatatttcttacagctactaaaagctgaccttttgcatcctttcttttttgtttttttttgtttgtttttttttttgaggcggagtcttgctctattgccaggctggagcgatctcggctcaccgcaacctctgactccctggttcaagcgattctcctgcctcagcttcccgagtagctgggattacaggcatgcaccaccatgcccagctaatttttgtatttttagtagagacggggtttcaccatgttagccaggatggtctcgatctcctgaccttgtgatcctccagcttctgcctcccaaaatgctgggattacaggcatgagccactgcacccagagaccttttgcattatttctaatggtaaaatatatgctctctttgttcttttgctttattcaatggcggttgctggcagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtaagtaaagcagaagctctatgtacacagtagtcaacacagacaccaggtcatggtttgaagttttctaagcactgactatgagccatgggtgatctcatttagtttttaggacaactctataggatagcataagtattattactcccaaggaactgagatccagaagagtgagacttgctaataagtaccacaaacaggatttgagctcagacttgtctagccccctaaaactatatgcttcttattgcatcatagttacttttatttaaaaaaataattggggggattttgttatttaaaatgtgaaaacctgttttaaatgtagtattattggttaatggaactaccacacagtcagtgaagctagaaacttacattcatctcagactcctccttctccttcactccggtagatctctaaggtgcttcagttctctctcattcttccactctcctccatctccactcctactgaggtatgctggggtctcatctttcccttgttactgcatcagctcctaaatggtctctgggggtgggctcacctcttccaacctattgtcgataattggatggatctttctacttcacagatctgattatatcacttccttgcttaatatcttgaatggctaagaataaagactattagcatcgaccacattaatgatgttactccaacctaggagaacggtggttctcaaagtgtgggccccaacagtcagcatagcatcacctgggaacttgctggcaatgtaaattctcaggtctccatcccaaatctaactaaatcaaaaactgggaatgggtccagctgtctgtgttttaacatgttcaccaggtgattctgatgctactacagtttgagaaccactgacctgttcaatgagtgagaggaaggataagagatctatccatattgcaaagccaagttcaaattcccagctttaagaagtttccttgactgcatcatcccaggctggctactccttttcttcaacacatacataaaattccacactaggtagtctttaaaaaacaattttccagtaatgggattgctgggtcaagtggtacttctggttctagatccttgaggaattgacacactattttccacaatggctaaactaatgtacactcccaccaacggggtaaaagcattcctgtttctccacatcctctccagcatttgttgtttcctgactttttaatgattaccattgtaactggcatgagatggtatctcattgtggttttgatttgcatttctctaatgaccagtgatgatgagctttttttcatatgcttgttggccacataaatgtcttcttttgagaaatgtctgttcatatcctttgctcactttttgatggaattgctttattcttgtaaatttgtttaatttccttgcagattctggatattagccctttgtcagatggatagattgcaaaatttttctcccatccaaaggattataaattattctactataaagacagatgcacatgtaggtttactgcagcagcattcacaataacaaagccttgtaaccaaatcaaatgtccctcaataatagactggataaagaaaatgtggcacatatacaccacggaatactatgcagccacaaaaaaggatgagttcatgtcctttgcagggacatgggtgaaactggaaaccatcattctcagcaaactaacacaggaacagaaaaccaaacaccacaggttctcactcataagtgggagttgaacaatgagaacacatgaatacaggaaggagaatatcacacaccagggcctgtcggggatggggggctaggggagggatagcattaggagaaatacctaatgtagatgacgggttgatggatgcagcaaaccaccatggcatgggtatacctacgtaacaaacctgcacattctgcacatgtatcccagaacttaaagtatataaaaaaaatttccaaatgttagtattatcttccttatccagatagcaagatatttgaaaaaagtatcatgcctgccacttttctctctttaacactcaacacaggggttaatacatagtgttcaaaacaagacaggaagttcgagatgaagcattaatttagattcctggctagagtcattcattaattcatccgtctacatattcatttaaaaaaaattcaaatgctctaatgagtatacattatgtgtttgtgctagggatatgatggtgaacaaatctaaatatggttcctaccctcttgcattacagtatttttcaaataacatgttgtaagccaattgtagtactcaaaatcaatgtatatggatcacaagaaaaattttgaacaacaacaaaggacagaatagaaaatatcatagtggattataggcactaaagataaattattacttcaataaatcttttccagttaaataaaaacatgcatatttgtatcgtgtcatgatgcaaaataagtagcttacaatggatgtaaaaaatgtaaaatgtaaaaaaagcatttaaaaaactttactcaagtgggtcttttaagaatcattcaaaaacatgaggaaggaaaaaagagttaacatttgttgagcacctactaagtttcgggggctattgcacatattctcatttaattttcttgacaccatttagagatcggtgttgtccaagttttagctacataaacgctgtggctcattagagaggctaattacttagtccaggcctgccagaatctggggtcagagccctggacctctagtcttccaccatgtggttgtggtatagcctttcatttgggctcccgtctttggggctggattactaattaattgcctggggtatctggtggcccctcctctttaaaatctgtgaggctgaaatgggcttccaatgtggttaatattcaaaaggagcccaccgacaaattgtcccagggataattacctcagctctgtttatagaaaaccatatgtcgataatagcacaatttgctatttgtgaagagctgattttctataaatccggaaagttagtgttgcttttctataaatatggaaatgtgctaatcatcacctcatctgctggagaccgctaataaatcagaatgtcatttacatattaacctacaaagaacaaaaatatctaccttctttccttttgacaaacagaatcacacacaccttttctccattttgatgtttgctatattgggctggttcaaaagtaattgaagtttttgccattaaaaaccacaacttttgtatcaatctaatagctttctctctgtcttattctcttcccctcggtctcattccgtttctttctaggtacctttctctctctctcccttttctctttcctctttgtcactgtctttttctctctctatgtatctttgatctatatgctattaatttatattctattaagtggctgtttctaagagacatcctgtgtggtgaacattcatgtctgcaaaggactgagcttggcatggaatgatttaagtgaacatactcactggtttgctctgggggaatcttttgtccttgggtttgctcagatcctctctgggttcgttccagaggatgcacgaggctgttttcttctaatgtgccctttagatcacatgcttctcccccaaagacagcatgaaaccatgcatcaaaaatcaagggaagtcttggatgttagggaggtgacgttagacttcaatgagatcctaacatttcctcaagggctgtgactgacagctttctaccttccgcaggtatcagtacggtttggggcttaaatttctagatttagatttttttcccctccttcattccttctttggagctgtcattatttgtctttgtatcaaggtatacaaaagagaaataatgtatttcgcattctgacttctctggttacaaagctgccaatatatgttggacaggtcaagtacttcaatgccattgttctgttcagctggatattcctggcctcctttgcacatgctgttctctcgtctcccaatgctctcttccctgtcttgccaacctgacaaacttcagctcatccttctgaaccttgtaggggcatccccacctctgtgaaacccgctctgatattgctccaccccttctcccatagtttcatctgtttatacattcattcattcaaccatgtccacatgagtatcacatgtgaaaagaacaaaatcagtatggtcactgttcttgcaaagcttacgatccagtggaggaaacaaaataaacagccaaagtccaaatatcatacttggtcctcttttacttcctggccccatcagcgagatatattgactttacttctaaagcatatgcatcacctgttctccctctattactgtctcacttgtccaagccaccattgtctctcacctggatactgcaagagtatggtggtctcttattctctttctttgttgttgttgttgttgcaggtgttgtcatcactgttgttcctgtaactctctggcactccaagcttactatagtctagagtctttgtattagccgtcttctttgccggaaccaccctttcctctgatgtgtgtatagcagtattcttatcatttgggcctccttaagcatcaccttttcagagagacctttcctgaccatgtagtcaagtttctgtttgttatatcaccctattttaattctcagcaaatcagtagcccccatactcatagatttatttgtttattgtcaatctcctgtttctagaatgttcattccaatcatttttgtttattactgcatattcatttcctagaatatagtagggacttaataacttgtgaattaattgatcaatatataatcgcgaattgtgataaaagccatttagaaaatgaacaagttgtaaaaacagagagtaacttcagggggtgagggaagatattcacttagtttgggatgatctgggaatgtctgtttgaggaagtgaaatccaaactgagatgagatccaaaggataaggagatgccaaagacaagggtgaaggtgctctgggtgagtggacagcttgtacaaaggccctgtctgaggaaagagcatggtgtgtttgtgaaggggaagaaggcatgtgtggcagaagcctcggaataggggaataatagcagaaactgaggttggaagaagccaagaggtgtcagagggtcttactggccgtagtaagaagtatggactgtatctgtggtggcagagaaaccactgcagggtcatcaacagggcagtgcttggtctaatcaacgggtcagcagaccattctattgccatgtagaacacagattagaggagcaggagtggactcaggaagaacaattaggggcattgctgatgtccaggtgaggaataaagaatggacatgaaagaatatgatagatttgggatgtattttgaaagtagaaattaaggaatttatagatagactgggtgtggattgtgaggtgtcaattactcctttctctaaattgtatttttatcatagacacacataagtgtgtgtgcatgcacacatacacacattgaggtgagaaggacaggatgtgtttgcctgaaggtgccagcttcatggtaaagacatcccgcaggcatttggaaatatggtagggattctgggggcaaagaagggactctaaatatacatacatatttaagtgcatattataataattgcaattatatatttgtctcttctgcagactatgaactttgatgtacaagtcctaggcctattgtccttggggtattttttgtatctagcacaaggctgggcccacagtagatgcaccacgaatactcattgagctgcattctccttgcttcttctactcctgcaactcttaccatcatgtgaatgacctccacatttccatctagagtcttctttcttctccagaatccctacccatattttcatatgcctgtgaacatctccaccaggaagctggcacctccaggaataacattcatgtccttctcaccctaaacccttcaagcgtttcttcctgaattctttctctatagagacaccaccatcctcccagtttacttgacatagagaggtggaaaaataattgactatttattatgtgctaagctccataccaagactcctcacctaagattgacaatgatcctgtgagggaggcatggtttcctcatttttacagatgaaggaaacaaggcaaaaaagtcatatcactagtaaatgaaaaatatacaaagtgagttaaaatccagggttctttctttttcatttcagccgcctttactgggactcacagcctgggaaaaattctgtctctcccctctctccccctacatatctcattagtcacctcctccgtatccacaatccatccctttctctctattcccgattctactgatgaccattctatgctattttctctgcaggttccctccagccaagcagacatgcagaatgagaaatttatcagaggttagatggatgtttcataaatgcctttggaacaaagttggtggtggtctgctccagaccccttctgtggctcatgtagataggacctgatacatttgtttcagcttttgtgccctgggtccctcaaaatgcaacatgaagtagaatgcttcctaccagttaaagaatctcagggagtctgatgggacacctctatcagggatgctgtaatagaaatcctgcatagaatagaaagttaaactgctgtgattcttggccttattgaaagggctttgcaaagacctcacagaaaatgacttatgttgatgatttgctcacaaaaacagccgtagccattctgccaccatatcaaagacagtaggccccatcaaagatggcaggcagtgtgatagtggaaaaaattattttccctgagatatctttttttttaatctaggctctaacattcagaagctggtatgtcacatttctgagtctcagtttttccatgactaaggtagagattgtcataactactttaaaagtctgttgtgagaattaaccaagatagtcatgaaaagcactgtgataccttaaatactgtccaagcagcacttactattatggattataatttcaggtggagtcagtaagtactaaagccattttgatcaagctctgtgaaattaagaaacatgccagtgacatggtagcaagaagtccacactttgaagtcagatacatctgggtggggctcttggttctattatttagtagctgtatgactttgattgaggaacaacacttaatttctctgatcctcagtttcttcaagatccaaataagaatgataacaagggcttgtttggttgaaaataattctaagtgcatgttgcatgataagtgttcaatagatatgtattccctttagtgaagaatatggatatagcacagtggttggaaacatggaccctgccacttactaactgtgtaatcatgggcagataatttaatcatcttaagtttcaatttcctcacctgcaagctggaaatactgtcatctgcctcatagagtggttggttgtgaagaataagtgaacttattttgtacccacattccaataagcactcaataaatttcaattgctgaagtaggttctgagtcagattgcctgattcaagtcctatctccaccctttatcagtcatgtgacccacagacaaattagtttacctcactgtacctcagtttcctcttctaaatgagtcaatgagagtacatacttcatagggttgttgtaaccttgaggtgaaacaatctttgtgagcatgtggcatagtgcctgacacagagtaagagttcaaaaatgttacctattattgctgtacagtgtaggtgttattattaccacatttttattattctcaaattacagttatcaactctggaatgttaactgttctctcatctgtaaagtggggataagaggaagatccatctcccagagttctgcaaacacccagctctgaaacattgctcaactgggagggaaatcattatcatgatgtccagcctgcagtgtctggtatatttgctgtggacttggagcctcagcaatcatgcctcctcctccacctgcccatttctttgatcaaggtcattcatttctgtctccagagcttcatccagttttggagggaccactcttcccatttatcaaggtcactttgaactctcatcactatctttcaaagtgttaacaactctgctcaaatcagtgtgtgctttccatcatccctggccctgatggataccagataacagtgaccctgggaaagacccttccagcaagagttcagtacatccaacctattattgatcatcttattccagtcagggcttgtggaccagccagtctaccacctaacacacaatgtctaaaaagctacagggacagaagttaaaacctcaccaaagttaatgccaattatagctctacatcctcttcctcctccctccctgccttcctgtatttcattcagtcctctagcctttccctcgacaaacatttatgaagtacacataacatgggaaacactgtctagataccaagatgcttaatacattgtccctctcatcagggggctcatagaaagtaagggggtttctctttgtcataatcatcagattatggtcagggataatttactctgtggacagccaaattggttaccacccaaagtgaactagcaatttattttcttattcactattttgttttaatacaatgtttttgcgtataataacatctactatttgtagagcataacacatctggcattcaaattgatcctcataataactttatgaggaattatattgttattttccccagttttatagaaagaaagttgaaatccaaagaggttaagtaaatggctcagtgtgactcacttagtattgaacctaggtcttctgatttagattttgtatatcttccaagtactcatccctttttccatacattctgtcattcattctgatactatatgtgagaggcttagactttagcagtggtggtaagtcagccaagatttactgagtattcactgtgtggtagacattagggtaaacaccttaaatgcaccatctcatttaattctcaggagagacttgtgaagaggatactattatataatctccaattcacaaaagaagaactgagactcagtgattttctgttaaatagcttgcccaaggtcacatagctattacttggtgaagtcaaactcaagaacctgtaatgttaagcaaggtgctataatgtctcaaggatgccttaacctaggatttttcaaacttcagaccataacccattagtagattgtaaaagaaattcagtgggtcatgatcagcatttaaaaaataaaatgtaatagaacacaaagtatcaaagtatgtcacacaaagtgtagttaagtatttaaacttttaagccaagcacagtggctccttcttgtaatcctagcatttttggaggccaagtctggaggatcatttgagcccaggagtttgagaccagcctgggcaacatagggagaccatatctctataaaaattaaacaaacaaacaaaaaactagccaggcatggtacatgtgcctgtagtcccggctacttgggaggatgaggtgggaggatcacttgagcctgggaggtcgaggttgcagtgagccaagatcacaccattgcactgcagcctggataacagagagaggccctgtctcaaaaagaaaagaaacttcttttaaatgaatgtgtgtagactgatcatgatgtaaaatgtatttcttactttgagagtggtcaagaaagtattgaaaacacagtcttaactcagtgtgctctactaactataaaaacatatttaattactttaaataaaggaaaaatcatcaatagccctaagggaggcattgggaagtgtattagtcaggttctccagacaaacagaactaatagaatacctgtatctgtctctattatttatctttatataaaatgtatatataatatagagatttattacaatgaattggttcatgtgatatggagtctgacaagtcccaagatctgcagtcggcaagctggacacccaggagggctgatgctttcgtttcagtccaagtctgaaggcccgagaacctgggcagccagtgatgtatttccagtctgaaggccagcaggcttgagaccctggaagagttgacatttccattcaacatttcctgtccaagggcaggaaatgaaagccaatgttccaggttgaagaaaggaagactcttctcttattcagaggaaggtcagtctttttgttctagtcagtccttcgactgattgcatgaggcccatgcacattagaaagggcagtttactttattaagtctagcactttaaatgtttatctcacccagaaacacccagaataatgtttgatcaaatacctaggcattccacggcccagtcaacttgacatatgaaattaaccatcataggaagatagacatgtgggaaagctggaagcagatgtcaataacaactgtggagctaggtctggaaagtctcatgtaatcaagtgcttccaagagtgtatctcagtggaaatagaggaataagcatcactgggttctaactctgtggcaggtggcacgctgagccctttcatacacatcatcttatccaagccttgtggcaacccttcaagctctattttatggctgtcctcatttcacagatgaggaccaccaggcactgaaaggcaagatgacatgtccaaggtgacacagctggtcagaggcagggcgaggtttgaaaccagctttctaattccaagtgcagtgtttcttgcagtaaacctagatattttatttcatttattttcctttctaagaacatcaaactgttgtgatagctttgaaagtgagtaaattgggttttaaaaataattaagggagtattatttttatatctatttctaaatgtaatgttgagtcagtttgacccattgattgggaattgtaactgggagaattgttaatgtttaaactgaaaagcatgagattgttctgaaacttaagtacaggcacagagccaggaacaagcagagtgtgctggctggtgacactcaaagaggtgaacctcagagacttgcatgtcggaagaagtgtctaagccagggatggcaagtggtcttaatagcaaatgctacctagactgctgagttgaagattggaacacaagatgcgggctcagccagaaagtgctatcatcgattagtgatgtctgccagaggctggggactgagggcaacagggctcttgggctgtgtatttactatacagttattaaaataagacaaaggcagcccagatgattaagccatgtgaggagagtgattggggtgggaaagacatttaatcaaagtcccttaaattaccatcacatttatatatcatggctggttgtttgattataactccctttcaggaagattctgagtagagcatttacccttgttgcacaaagttggaaacaggaaacaatctcaggggaaaaaccgtattcgtaatctaatctccattcatccattcatccactcattcagtaaatgctcactgagcacccgtgatttctgggaacacaggggtgagacacacagagcccttccctggagaaatgtgcagtcagttgggtgccaagaataacataatgtgataaatgtttaaatagaaacaaatacagtagaagcacaaaggagggagccacaactttttctgcccctcccacttgctagaccctaaagacattcaaaactcatcttccaaaattactaggagtagaagtttacctggaagagaagggagttgcatgggaatggttggggcagcaagtaggtaaggatgagtaaaaggagatgaatgtccagattcactcaaaggttggactcggttttggaagggcttgctgctgaggccagggcataaatgagaacaatcttggctggattatgccaggaatagtgatgataacagtggctagagtcagtgttgacctctcagaaaccacagagaggatggcaagctgcaggaatcatgcaaggtgaacactgaaagcaagagagcctctgcgtctggaaaagaaggccagcatttcagtgagcatgcacagacctccagctcattgttcaccattggggtgcactatactgagcaacgtactggtccctggacttaccatactctttctccttgatttgcatatgctatttcttctacctggaattttgcacctctccctctgcccttccttattcacctggtttatgcttattcatcctcagttctctgcttagctcaaataggactcttccaggcagtctttctgtctcctcagttctgggttggaagcctgttttaggtgcttcagtgtactcaggacttagatctgagtatcacactattgcagctgcttgtgtccagtgtgcatcctgttaatgttgcatcccagagtcttgcccattgattgagcatggcccacagcagagactcagcgtctttctagctggggtggttccaaatctgagcccatgtatgctgggcagcctccagagctttcctaacactgcagagtcaggggtggtatcctaaagttctgaactgaattggacaataaggagggtaaggtgggcaggaatcttattgtaaaaggtcctatgttcatggctaaaggctctgggacagcccagcaggtctttttatttatttatttatttttgctcctgctaaccaaccagtcacccgaacagacagtcactagattctaacaagctccaggctttatccccagttaccatgacaaccagtcttcacggtgatggatggtattgattgactgacagactcctagtttcttggctctgtccttactccccttaagtcatctgcatatacatggaactgagactctcagcaccatccttctgattttgtcttgattttgaatttccacctctaatatcactgagaacagcttcatacttaaaggagaaaagctgagatggtgtcaacattcttcccagagccatccttagctctctttcccataggcggtataatatggcatacagaacgtggtctttggacacaggccttggttcaatcccagttctgttatttacttagtgtataacctgggcaagtgacaagctatctaagttaagtttaaactatttcaacctactcctttctaaaatgggactgatcattcctattgtggcatgatgtgtgaacactgagtgagctaacacatggaatatctccacccagtacataatagtgcctatgaagtcaccgggtgcccttgtcctccccactcgctcctgggctaaccacttatactgcagaaatgcccattaagaaaacctgattttacaaactcctcagcctccctctttttctaacttttcagattccaaatcaggagccaaaagcctcagtgtaggctgcagcatttctggcaacagcagtaatagcaacacttgactgtgattgctagctctgaaccaggcactgtccagagcacattacatggcatggattaactcattcaacactcacaacaaccctgggaggtagacagtattaaaatccccatcttacagatgggaaaactggggcaagagaggttaaacaatttgcccacatagtcattggacaggggtggcattccagctcaggtagtctctgtttcagaatttggccttcatctacgctgtctcttgtcatggctgaaattatggagaagagtcagagcctctgaagaacccttatcaagtaggaggaagacatgggactgtagtcaacattgcctccttcttctgcctagcttcctttctctaagcttctttgtagaatgaggtagtcagggaatgaggagttggaaggctcctttcaggactaccattggctacacaccatgcatgatgaatgttcctctgcagaataacagtagcatgatgaaatggagcatccattgtgtttgagtatggcatatcttgcttcaagacctgattcttgggcctgttagtcctgggtgactttggcaagttacctaacaataaaagctagtatttattgaagacctaattgtgccagacacgttttaggaattcacttatagaaacaattatcattcccgttttaaagattgggagtatgaggcagaaagccattaaatgagttactcaagtcactaccagagaaggtgaatggtaggactctgaccccagaggttacactcttaaccaccacaattcctgctttttccaatcttagcctgtaagatgggtaaattctccttgtcccagaatattgttcagagtctccaatgagataatgcagctgaaagtgctttataaaatatagcatattaatctagcatgagatattacaaaactgtgatttgcatcttcaattaaagaaagacctatgactcctagaacgttttagaggcattgtctatataggctaaagtcagccaatccccaagccctcctggggggcttggcacatgccaggctctgtgcagagatttgcaaacccgagagatgacttagaagcttgtagtcttataggaagaacagaccaagaaattgacaattactagagtgagctaaatactatgctggagagaagcacagggatacactggaacatagacatagggcccttggggattaagaaaaggctgtctggagctcagtgggagaagctcaatgaaagagataaagggactttctagcacctgcaaaggcactgaggtactcattttattctcaggtgttttggaagaagtgtgagttttaaaggataaacagaaacacaaaggggacaggtgagttagctaacacctcccaactagcccagccacacactccaatcatcttttccaatgtgatgatagaaaatagactattagattctctttcccattctgaggctgtctttgggggcaaccaacatagcaaagcaatgtagcacataaatcacagcaacatgaatggtatttgttttttgcaaagagataatgaactacacctgctgttttccacctaatgcttttaatctgaggaatgacagacttgcagtgttctggcaccttggaaatcaagctgcctggttctgcctgagagccacagacatgcagaagctccatggaggtgtgagggtggctctcccacctgcgccacaaccaagaccatgtgggaaacaagtagaagacatggtggccagactcatatcctttgggctcctagcctgtcaagtagccacagaaacagctcaccttgagaccagactagactgggaagcaatccagcatcccactacctctgtacttccttagggacctcaactgatttgcatctctctcttttccactctggagtttaagtcacattggcttttctgagtagaatcttgctgctgaggaaacaagtcctctgcagggtctccctcatctcccattatactcctagctttgtctggctaatccctacttgttctacttgtctctggctccttcttctgacccccacagatgccttccctgaccctgctgccctgtgtcagagtcctcctcgcacactacaataattatctgtttccttgtccatttccccacacttgactctcagctcatagaggtcaagcactctcctgagtcatctttatttctcaactagctctaacacagtaaaacgtcattaggtacttatcaaagttgtctcaaatgttcttaaagtattctgctgtgttcttaaagtctcaggatcatggcattagaggtcaccttaaaagatcgctggtcttttctacccttcaaaccctcctgtaccctcacaggcaaacagccagcctcagcttggtctcctgcaatggtgagagctcactgcctgctgaaacacctcatctctgcttgacttctgactgtgataatgatcgaccttatgctaagcctaaacttgccttcctgtagcttttggcctttgggtcctagttcttgcccttgcaaccacacaaataaaccttattcttcttcctcaagacaactctctggagggtttaatccagttctactggtctctcttaaagataaatcttttttcctttcttcaagtaaatatccttagtcgcctctaatattttcaaaaggatgtggctttgaacatcttcaccctcatgcttgttcttctctgatcattccctatttttaaattttattatggtaaaaatactttaacatgaaatctaccctcttagccaactttaacagtacaatacagtgtcattaactatagggacatgttgctctcagactttatcttgtataattgagactttatggtcattgattagtaattctacctttcctcttgcccccagcccctggcaacaaccatgataccctttgattctatatatctgactattcatatatctaatataagtggaatcaggcagtctttatccttttgtgactggcttatttcatatagcagtatatcctcaaggttcaatcgcattgtcacatatggcaggattttcttctttttaaaggctggataatgttcattgaagaaaatcatattttcttatttcattttttaaagcatttttgcacacagctctgagtttccctaatctatggagaggagagtgagattacttcctccttcattttactaattataatttgtaccctggtttcattaccctactgagtggggagtaatctaaaactctaaggccttttcttttgttctcccgctaagctgtctatttctcactgtgcttattcatttggtattttgtctgtagggtaggatgttaaagttttcccagttcagtctcattttgctatgcttggtgatatggtttggctgtgtccccgcccaaatctcatcttgaattgcagttcccaaaatccccacgtctcatgggaggaatctggtgggaggtaatttaatcatgggggtggttactctcatgttgttctcatgataatgggtgggttctcatgagttctgctggttttataagggggtttccccctttgcttggcacttcttcttggtgccatgggaagaaggatgtgtttgcttccccttcttccatgattgtgagtttcctgaggcttccccagccatgctgcactgtgagtcaattaaacttctttcttttataaaatcacccagtcttgggtatgtctttattagcagcatgagaatggactaatacacttggtcagtgtatccacccagccttttgagacctttttggatcctgtttctttaactgacttagccttggcttcttctagttcttattctgagtagatatgatggaactggctactaagtccatatccaaggcattgacaaaggtatcaactgagacaggatgccagagtcctgtggcaagccaccagagatactctgtaggaccaccatactcaacatctgatccaagatccaatgaagaggaatcatctgggatacttgtctgaaaaacagattcctgatttcatagaaatatacaattagaattgatagaggttgggcctagttacctatatttttcaaaagtactccagatgatctcaatgtacagcctgggttgggattgatcaactccagagctcactgagttcaaaagccccaaataaactgcagtttgacctggtccaaagttaagcctaaggagtgcagcctgatgggatgaggtggagcaatggcagaggattgtctagttccatgaatatagtcagtctatccacactacacacctatctgggcaagttctttataatggctccagacctttctctgttcctttcaccccagacccccacctccaactctttctgtttatctctctggttctgcgtcctggcttccaatgccagtttcaactcctggatttgggtaccaggtttgacttcctctgacccgaccccaacttgttagtgtcattttcccacaggctcactgtagacagctctgattttggcatctcttacagcctctgatgaaagactcctttctagccctggtatattgaaacaaaaaactctcgggatacagattggtcttcatttaagatatggcccccagcctgctaacttctcaagggcaggatcttacctttgcagttttgcatcatattcacattagttatattctcaaggtgtctacattgcccaatatgcgatatgctggggatggtacacagtaggtgcttactacattttcctctcagatggcagaattcttttgtctgaggcaataactgagattagtaaaataccacaggcttctaaacataacagacttgagcgtgaatctcagcttcaccattttttaactgtatggccttaggcaatataattaaccttcatgaacctcaggcatctcagctataaatgaaaagtatgagctaagtgtctaagagtgcttgggctctcaggttctatgattctttgtaagtcacagactccccttgctggctgggaccctctttggggtcttagatggcaaatctctgcagtcaagtcatgcttctcaagtcagactggaattctcttctcccagcatcacgtggcaggctgttgccagatctttcatgagcataatcacacaacaggcatcctccagcccccattaatcagcctgtcctgtggctttaattcagcagcactccaccatccacctaagtaatcactctggcttctgccagtgaattcttttcatccacttttgtttatcactgttgaagcattttttaatcaaaacaattaaatttgctaaatcttcccccaattagtaatgcattaaaaattaaaagtgtttgaatggaaatggcagaagaagccctttgctcagtgctgagtgccggtgctcagagcatcactttccccaagcactttcagctcaggagtgactcagaaactgatatccaaagaggcacagagggctgcagctgaaaggggtcttggagatgacaacctcttctttccataaatgggaaatggaggcccagtgggatcatgggcctttcctaggatcatacagggtgttagtgactggaatttgaatttaggacttatgacttctaagtttccttccatcagaaacccttaccaaaagactcggggcattcatttatttactcatttttttcattcatcaatcatttattctgaaagtacttactgaacacggcacacaccacattgctacgctaacaagacaatggtgaattagacgcaagtccttgacatcacagagtttgctgtttaatggggacacaggcaaataaactttgatgctcaatactcccttgaaaatagtgaatctaatctttagctcaactgaatgacaggtctaaattatttttcctttatggttgatagaataacagtatgactggaaataattattttgtatagttgtagtttaaaggaatcatgtctcaaaatacaaactcccatttacaacttccagatgactcctttagctaccgaaaaggttgaactctgtagcatgggcaatattcctccagtctgtttatctagttttatcttgccaggcatacctagggttggaaacccagctctgtttatttacatagcaatgtggctttactgctttgagaattattttcctcatctacaaaatgcaggttcctcagtgggtcctcagatgtagacaaatacagagatggctaacgtgggcctgacagtctttacggagtctgaagggcaggtaaactttccatggtgatccatccatcttctagcaagactttggcctctctggggcgcaaagaggatctggacaaagagaattgtgatgaagatgatcattcaggcacagagaacatcggtagctctgaaaaaagagggaattattcagatctaaaaatagttcatggagtaaatgacatttgaatggaagcttgagtagcctttggaaagatgatggaaagggaggaggaggggcatttagagtagggacaaatatgtgcaaaagttcagggtaatggtgcctatcatggcccgggcactgaggtaggcatgggggcaaatgcagaaggatgagatagaattattgcctcaaggtggctcaataaagaatggtcaaaggaaagagtgctagcattttttaccaactagtatgtgcaacacatatctcttctcatttcaagaattattttggttggaaccatgcagaagagaaaactgaaattggattaaagaaccgggctttcaacccaggccttttggactccaaagctgaagctagcttttactactctgacatagttgtaccatgtcaagtgtcttttaataactcagcattttgtgtttctctgtctccctgttgcaggtattaccagcagagatatcacgacatgttttggaggctccttgggcattcaatatgaagacaaaataaatgttggtggaggtttatcaggagaccattgtaaaaaatttggaggtggcaaaactggcaagtgtttagtaatagatctcccaaaaagagaagccaggctttcctttggacacacactgggacatggaagctattttttttcccagttgattgcattttagtcaatgatcagactgcatagacgctaaataccccaaaacaatgacctgcagtggctttattttgaatctaccatgggcttaaaatcaccttagaaatacctacctttatacggggcaccctcctagatttcaagggttagacaaaggtccaagtaagaactagaatgaaaggaatctggaaaatgggctgtttgaatgaagacccatcatattacagttcagagggaggaaataaggctgttgagagagaatatggtaccgagtccaagctcaaagaataattattagagagggattgtacaggaatattttatggcatttcctgaacaagtcagttggggtgttcatgtgttcatttactcatccattcatcaaacaggtattgagtttttttccccaagtgggagacacagaggatacagggatgatgaagaagtttataatgcagtgggtggaatagatattaatcaggttcaagctattcctattgcattaggttacctgtacctcagggccttaagtcaaattgtttcttctctctttctatcctctcttcatttacctggcaaatattcactaacctttgtagacaactcacctttctttctgactgcctcccacaccccctactgtatagctaactagtttctttcactgtgcccacattgagtcctatagtaacatctgttgtacctatagcacctataatatttgattgaacctattcggcatatagcaggcactgagtaaatatttgatgtaagaatgaatgagtgaatgaatgaataaatgaatgaccacccatttcctgttccccttatcctccatgtggtctgggctgtcctctcagtatttctccactccagaggatgggtctatttctgagtcttggtccttcccttctgccttgtcctgctagctaaccaagaagagaagaagaatggtaaacatctaaggaaaacatgtaaactttcttccaaatctcattagtggggtttgtcaaccagtccttgggctttttgggaaatgagttaatgcagtttatcctcttgatggcagaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgaggtaagtcttttcgcagttgaagaaactctacgtccatgaggaatgaaagtgaagcagaccagatcatttcatatttcttattatgagcccatcaaagaacaagattaaatgtaatggcacactgaactagtggccttgcttgtgcctgactccagggagtgcatgacttcagacccaggccacgggacagctgggatcagaaactgatgatctagtcagtgcctagttttacactgctcatcccagaagttcctcagcattaggtcacattaggcaaatcatgatttttatttatacataaaacacttcaaaaatcacatgggctaaattagggggtggcaaactttttctgtaaaaggtcagatagtaaatatttcaggctttgtgggacacatacaatctataatacacaaagtagtagtattagttcttcttctttctcttcttcatcaaatctctttaaaaatataaaagtcattcctggctcaaaggccatacaaaaataagctgtgggttggacttggacccaggctgcaatttgctaccatcctccacagttatctcatctctccattagaggaacctctgtcatagatactattccctcccattaaaaagattaggaaacaggctctgaaaaatcaagtgaaaatatttgaggtcatatagctcagaggtggcaatgcttggatttcagacctttggacttcgtatccagttctcacttctctctatcctagcacctccattaaagcagtggctctcagctactaggggcagttttcctccacagaggaaatatggaaatgtctggagatgtttttgatatttttgtcaccacccacagtggggcaaggaggtgttactggcatccaggaggcagaggcctgggatgctgctaaacatccttccatgcacagaacagaccccacagcaaagaaatatctggcctcaagtgtcaatactgccaaaattgagaaaccctgccttaaatgcttaacctcacaaagtgtgaaaaattctattttaaccacaaaggaagtgattgttctagcagttgccaaactatttctgtccatatgtggtgtagtccatttaagagactgcatttcagactttgaagcaaaagatcatcattttctcatccattttctccccacccttgcctatttttctacatatatttaaaatcccagatatggatatagtcctcctcttaaaacatatgcctacagttaaacctagaagtctattctaacaccctggtttctgtgaagaaacaggtcagatggatcaaccttgattttatttcttcttcaataagtaagagaccattttcatgcaactgtaattcacataaggtttgaaaattgatatcatcaagctattagtgatttgagcaaaaactgtaaaattgatatcaggagtaatacataaactttcataggcaagaggtgaacttggtgtttgccttgagaaaaacttccctgggaagactcagggtcatcatttggagaagaccactacagtcttttgggaaagagcccaggctttggcaggattgggtgagagggaggagaaagacataatttaggtcatagctcagctgctttttcaatgtgtgacctttgacaagttacttccctcactgagcctcagtttcctgctctatcacatagagatatttcacaagactcaggagatcagaagttacttggtaaatgtcagttgaagaaacaggttcagcacaatatctcgaaattggcaaatgatagagtccaactcgagtcatgtttgactgacactaacatcctcagtctcttcacaactcatgttgccccctgagaagttcggactcaatgcattaagccacgggcaggctttatagcagggaagtaacacagctagcactgtgttttaaaaagagaatgctcacagggaaataaagggtgatttgaagaagagagagattacagacaaggggaccaggtaggggttatttggagcctgatgttcagagtggaaacagcatgttattcacttgcatataccccagagttcagcagtgcttatttatagcaagtgcttagagtttgtgaatgtaggagtcctgctatgttacgtttgtgttatgttattttgttatgttgtgttgtgtgatatattattatgcattatcttgtgttgctatattgtatcatttgacctctgagtcttttttctcatctgcaaaacgggaacaagatcactgccaataccttttcaagctctaacgtcccaagatccctcttctccacctctctctcctcttttaactccaccagtccaccctatggagggcttcccctcttcctgtggttcctgggagggagagatctgaggtggggaactggatgcagagccccactggaaagtcaaagagaaattgctcaatggtcctggctttccctggaactaacagtcatctttgagaaggccaacagggcagcctattctacgctgacttcctaacaatgggactgaattctctgaacttccagtaagtggttttctccccttggctggggaccctaccagtcctgatattacctgcctgctgacctcaaccgcaacccctgaccacaggccaaagtctgtttgccacaggtctttctgtacacatttccaggaactcagacaaagctattgccagtgccctcagttgacttctgtttccagggaagtgcgactaccgtaatgtggctcagtcctactgctgacttgctctggcacagtcctactgctgacttgctctgtgaccttggcaaatcacttcccctttgggggcctcaggttcctctccttaaaatgagagatctggagaagtgccttccttttatgaagtattaacatgtataacattataagcatgctgaagataaccacatatgcatgcaatttgaaaaacatgggttttttttttttttttactattatcacatacaactaacaaaaatggtgctttattttttgtcattcttcccttgtacagtagtatctcacattcagtacttctttagatcctcataagaaatctgggaattaagtattattcccattttctagataatgaggatcagacttagacaggggcagttaggccacatagctagaaagtgagtcacatttacttagttttaccatgtgacaggtctttcccctatatcatctcccttaatcctcacaataatcctggagggtgtgatgactgttctccctttacagatgaggaaggaggctccgtgtgtcatgtgccaaagatcacacagtcggaagcagggtagctggggtttgaagccaggttttccggctccagattcaatcctccttgtgcttcatctactacttctcagtcgaggcaattgtttcccccaaggaatatttggcaatgtcaggagacagtcttggttttcacaactggaagggggctgctggcatgtagtgggtagaggccagagactctgctaaacagcctacaatacaaggacagcccactcctgccagtaaagaattatccaacttgatacgcaatagtgccgaagttgaaaaaccctgaactacggtcatgtctggaatgggttgcatcagttgtaaataactcccacccagccacatgtagctgccacagttacaccattagggaaattgctcagcaatgacaacaacactacctgtcaaggattttattaattcctgcattgaaggctgacatttaaaacacacacttttcctgcttcctaaatgtggtggagagggcagatgagttggcacaaataacttctaagcccacttgggattgggagtgcacaggtttcagagttaagtaggtgattcttgtgaggaatgcacacattgctccaggatcactgtgaggattaagggagatgatataggggaaaggcctgtcatatggtaaaagctaagtaaatgtgcctcacgtcctagctgtgtgggctgggacttttaactgcccctctctaaacccgatcttcattattatttcttaataattgtgtgcttctgagccagtcacttaaacactgagcctccctttcttctgctaggagctgaggagtttaatacctatgtcacagaatggctgtgaggatccaaggtggtgggataaattgggtgtctgtgtctgtgcctggcatgtatcaggccttccagaagcttggtggccggttcttgggctctgggaaggtagatagagcccagggaggggccctgtgttctttctgtgcccacagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggtaaggtccgtgcatccccacccagttccagcctgtcccagctcaaaggggccagtgcaaaaaggacttttggggttcccggcccctccttttggagctctcctagccaatacctaggagccacccttgagagttctgttactcacccatcacatttagtggttcttgtgctttgtccttgccatcaagaccttttctcagatgagaactgtttttcgccaagatgtatatggacaacaggattcatttctggaggaataaactagtttcctagggctaccataacaaatcatcacaaattaggtggcttataacaacagaagtgtattgtttcagacctctggaagctagaagtccaaagtcaggtgtgttggctaggttggttcctgccagagactgggggagtatgtggttcaagtccctctcctatcttttggtagttgtcagcaatccttggcatttctcggcttatagatgcatcgctccagtctctgcctctgtcttcgtgtggcattcttccctctataactctgtttctcttcttataagaaccaccagtcactgggtttgagaccaccctaatccagcatgacctcattttaatgtgatttcatctgcaaagatcctatttccaaataaggtcatgttcacaggtaacaagggtttgccttgaacatatcttttgaggaaacacaattaaactcactaaaagagataggtagttgtcattatagtgtaagaagttatgactaaaaacaaggtttgggcaaggaaggtttaaatgcagataactgcaacatgaaccaactggtaccagggaagaaagttatcaaacaagcattaaaagtccattgcttaaaaatgaagaagtctggggacttggatgtgaatcccagatactttactaagtcactgtgagacactaattgttcacatctttctggggcttagctttctcatctatgttcccttttagccccaagagtatgcatgttccaattcctaagctcccactttttcaggcacataaaactgtttgtatggtacataaaatgatggcaaaatgtatggactacctaatcaatgtacacattaacctaaattggctattgcaatgaagaaaacacaaagggaaaaacaaagaagtctggatgggaaatccaaggtattacaattgactccagaaaacaaagggttgaagcacagggtggagggggctgaagccatgtggctcaatggccatgtgaaagaaacaggccaaccattagtcccagttcactcagtgggagcctgatacagacggccccacagtgaaagacgggttaacaaaagtcaagagctcaggataagattcttctctggcgtaccaagatttttgttcttggtgccacacctcaccggatactgacaaagcaaagcaggcaatccagagaagtgggaaggctcaaacctatgtattaagaagatctggaaagattgggaattttaggcatgaagaagaaagactcagaaaggacaagtcccacataaactgccatgtgggaggacatggaacttgtattctatggccactgagattaggttgtaggactaaaggagagaagctatagcaaagggattagggcttaatgagggaggactttcttctgcatgtactgcagcaagaatgagggagggggatagatgaccacttttcagggagttggaagagattcattcttccaagggatggtcgggcaagacagcctcaaggtccttcctacccccagaatctctgagtctctgacctaaacaagggatagcaacatggtgagcagttggtagtttgaagcttaaaatctttaaatgcaaaattgaatttaaatattttaagcttcaaactacaaataccaatttctttaggattcaaggggatcttcatgcagtagacctggttttaagatcagatgatgttgagttattatttcctcattgggagagtagttctaagtaggaggcaggatagcatagctcaggtaccaaaccgatctttagttttttgtttttgtttttcttttgagatgaagtcttactctgtcacccaggctggagtggaatggcgtgatctcagctcattgcaacctcctcctcccgggttcaagcgattctcccacctcagcccgccctgcccccaccctgagtagctgggactacaggcatgcaccaccatgcctggctaatttttgtatttttactggagatgggttttcgccatgttggtcaggctggtctcgaactcctagtctcaagtgatctgcccgcctcagcctcccaaggtcctgggattacaggcatgagccaccacattcagcccaggtctttaatttctaagctgccaatttccatctgggcataccctgtaaaatgagattatattggaaccttccttaaaggttgtgttgaggattaaactagttaacacttgtggtaggctgtattttaataagcaaaagaagagacagcttcatgtgggatgtttcattggtagagaattgttctgggttgttacttgttcaaattcctcctttgctggcaaaaggggatagaatctgggttccagtgagctgcctgtgtcctgtgggaggtatgctgaaagaggtaagccaagagggtgagtgaaagccaatgaccttatgaaggagcatgcagagaatacaaaccaaggagaccaactcccagggccagttccatcttccatggaactgcagattccagcttccttgtgtgaactggaaaaaaggcactgcttggtagatgggtgaattgggagagaaaaataaaactactctggattgatacagccgagctcaagggcccagggctttcctgacttcccaagcagggtatggactgggttgtagccgccattttcccattggccaggcagcattcccaaggggaccaaagatcaatgaacagaaaaaataactaagccttattagtaacagccgttagagctgcatgtgtatgaactcatttattttcccaagaaccttatgacataaatgctattatgagtcccaatttacagatgaggaaaacagggcagaaggaaggttggataatttgctcaaggtcacctagctggggaatgaaagagacaggatttggacccgggacccaatctcttaaacattacaccctactgagtcacatcctaagagtgaggaaatttggggaatgagagcagagggtctgagacaacttcagtaagtatcattttggggagtggaaagtggggtatgtaccagttcatggttatcaatctggcctggcttaaaggaacagatgtgagccttgccagagtaatttaattatagcactccaagggccctcagaaccagtgacttgctaggatccctgtccacacagcatagagacaggaagaagggggagtgtgggctacccagacgtgcctctccatggtccagtgccaggctcagtggcaggcaggctgagacacctgcacacgtggtgggtatcagagaaggtgtgggcattacgtaatgatctgcagggagggaggagacagagggctgctcccaaggtcccattcctcctgcattcagttgcaggcagtgcagttagttcattgcaggcagctcatggcgctccatcaacctggttcaaagcaaggtgtggacatcaggtggccttggggctgtcatactgaactttcagcctgatggagactgggctggcaaggaagtctgaggcagggcagtcaaattccatggaggcccattacagtccctgggaattttcccagtaaacctttgcctatggagactgaggcacagaggtgggagaaagagacagagagccttgctgtggctgccccatcagggagtataattacagagctggaaggaacttggagataatctaatccaatgatagtcacactgtgatctgaggagccctggggtctcagagctgccccagcagaggagggcgagcctgacagacatccagcttcaaatagagcagctccactttcatctgacttagaggttgggggtctatgtaagatttcatttaggaaaaatgaaattgtgatgaaaaaaataaacattgaaaaaaaccactggattagtccatccttctcatatgatagcatccaaaactcaggcggagccccaggctaggtaattctctgagctagatttccagatagtccatggtcagtgcatgtgttcagatgctctgtgcagacagcctgtcaccctctgcggctccattgccagaatctgagggggtttgatttgcagatcctcatacaaaagcttagcaatcctctccagggaggtgtctggccaaaccttttctctgactccccaggagggcggtgctcccctctcttcacaccctccattgactctgtgtcattcttccaagggagcacacctcctgcctccctccgctatccatcttccatggaactgcggattccaatttaatgagatgggctcccagtggcctcttctcactccatccagagtttcaaattaagtgcaaggcagtgagcacagaggtcttggctggctacctgaaggcatttccccaaggaggattgcagaccactctcaggcaacaggatggccttccctcctcagtagcagctctgcaactccctggacagagcccccaggggcaattaatagcctgactgccatggtctctgcagtgaaactgcccttgctacatctggactaacaaaggagcaaagaccctatgtaccttatctgtacgtacctccaacaagctgcagtcgaccagaggaggggaggccagttcctctcccaagggtgccacacacccctccctgttcatcaccagacaggcccttccttcttagccatatgctaaccttctcctccctgggaaatttcctctgcaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 2367 - DNA, 36806 bp, Homo sapiens
  source 1..36806: mol_type = genomic DNA
ttaagcctttaactcagtatttatttaaatcaacttgcattttacaaggtaacatctttattttaaacagcttgcatggcactgccttttgcccttgcatgaactccaggtggaaactggtgtagggctgagctggcatgagttcttgagggctcagggctctcattgtatgtagcccactgctgtatcatctgctaggagcagtcaagtgtttctgaagcagggcctgaacaggggctacccccattttgaggaggtggattgttacactgcctttgtcttgtcttacgtcttccagagcatgaagaccaatttgaccagcaattccacttcccatcaatgggggtatctataagaaagaaggtcaataagcatcaatcagcacttcttatattctggtgccttactggggttgggtgagctatgtaagccaaaaggctttgggagtctgaatctctgagctccctgctgccattttcctggccattgtacttgtcatgctcttgcctaccacagggcctttgcatatgctttcccccctgtgcccagaacactcttccctcctctactcacctggtcaatccaattcacccctcggatctcagtaaaagtgttatttcctcaggaaaatcttctctgactcccccagtccccatcaattccctgtgactcctaactctccatcaattcctcatattttaagttctctgagcattttgtagcagttgttacaatttaaactttaaagaactttatgggacaattcaaatgatattggccttcctttccaaagcaaaatctctattgtgactggggctgtatcttatttgttcacctagcagctaggcaggcaaacaggaggcccttgctaaacatgtgttaaatggatgaatggatgaataaataaatgaatgaatgttttccagcttagacagttcccacctataggatgctggatagttatcttcttctcaaactatataatgggagctgtgttatctactgtgagcaatggatgttgtagatgaagtgacaacagacaccagtgctttccacaccctgacacttggctttcacttgaggatttttgattgttggtgagattggcaagtcatcaatcacttccatcacaatttatcatgtgtccagctttgccactacctcacagtgtaattctgggtaaattacttaataactgggcctctccatttgaaaaataagagagctggagtgcatggttcccaagggctcctccaaccaataggaaccctgtggttgtgtgactgcagactcactgggaagatgactgctaggggcatggttgaggtgcaagatgagagggtggacaaccttgagtgttttactgggaacataagagtgcaggcaggagttacgatcaaaggctgtgggggcagacccctggacctgaacctgggtttccacacttcctaattgtgtgactattgggtatgttagttagtgacccattgaacctcagtttcttcatctataaaatgggaatatcaataatatctacttcatggggttgttgtgaggattaaagaatttaatatatataagatacaaagtaacaatgtgctctttaaaaagtaaccaatgtttatcttgcttttacaatgtgtaaggtatcattccaaacgctttatatgcctccttacaaagtcaagacaactctatgaggttgttaatatgatcatattcatcttacaggcacagaaactgaggcataaagaggtcaagtatcttgctccaggtcagttattaaatgatggagatggaatttcaatccaagctgagtttaagcactcagcaaagtgtctattatatagtaaagtgtccagtaaatgttcgttgtttgttttacatgtgccatttccatattgaacagtatcaccaaaaagtcgctgaaaggaataaaagtgagagaggagtgaaagattgagagctcttatgtgttaaactggccaaagaatttgagatctggaagggatcttaatgatagccaagtctttcatttgttaattcaactattatcactgagcaacagctgtgcctggctactgagacacagaggtaaatgggacatggtccctactcacagatgcaggggagttagatagatacatcaacccaaaatacaatgcacaaagagctataatagatacatgttcaaagtcccgggggagccagcaggaggaattagctcattctttggggattagaggaattttttatggaggagggggcatacgtgctggaatttgagggctgaatagcagtatactaagcaggaaaagagggtaagcattccagaatgatccaaagagatggcttacaaaagccacgcattgatatttctctaacatgaagcactctgtgttgtaaaaataatgaaatgcataacaatcaatccatcagttattaaatgatggagatggaatttcaatccaagctgagtttaagcaggatggatctcaggtttcctagtatccagccccacactccacaccagctccttgctcttcttctggtgaattattctctggacctccccagagttccttttccaattaacttactcttccgataggagacctcacaggctaggccttgggatccaacaggacagatgcagtcacagcgtgatcctgagaagacaaggcagagaaagtgtgaatcatgccaggtggagcaaagaactcctggagctcagccctccaatcactgcagttccatcaggttaaaacagagcacatatttagttaaatggcttgctataggcaggttcagggccaggaatacctactcctttcctgagggcctttgccacgaaggggtgtttattgtcatccctaggaatacatagagttgttgaagacaattactcatgagctgacatttgacccatacttaaatgctttcagtgtcagaagctacattagcagtcactgaggccagttgtcattgatgttcaatttcacaccaaataattgcctagcttagacttgaatacctcgaggatggggaactcattactcttagatgtctcatctgacttttggccagttctgactccttggaagtgatgccctatgtgaatttgtaatctgtcaagcaacttctcatatgaatcacaagaaatctccttacagggtgtccatcataggtcaggccctgcaagcatcccagtctctggctccatattctccctcaccttcactctatagcctcaggtgggtccaagtttctaggtccaaatttcgtacaaggcaagggagagttcagcaaccctagattaaaatcttgagttgatgagctgaccccacttgctgcagaactaaccctcacataggggtccttgtgctgatagcagaacttctaggctgtatgctctcacttatgtcttctctgctcatgtctatcctctccaaggagccagagacatattcctcaatcccagtctggcaactggaccctttctgcctgagaatacaccttcttctatatcccttccgttgagctaacttcatccacgtgggctctgccttgactcctgctggttccctgggctgagacttgctgtaaccagttgctcctgatgccctgttttgtgtgctgggctggcctcttttttagagtcttgctaggctatcacaacaggagcataagatcccaggctctcacccctcccagtctgccctgctcactgcagtgaccccaacatgactcttgagtttaacaatcaagttctagtggcccatccttgctgctacccccaaatcttcttattatgtattagtcaggacatgcacaaagggcttctcctactcagcccaggccccctttgggtagagattctctgagtttattcccactccttgctgtggaccacaggatctcagcctgctactgtcttcagcttaatgatgctgtcacccacggtaacccttggggctagaacccaggtatactgacagccagagtagtatctcccagtggactaaattctgacttctcagtaaacagaagcaggcaaatggctggcccccggcctgcttcagattatggcttccaccagggacaccagctgcctgaaagtggtacctttcaggacagggactccatttccttggcagggagcacagtggcaggaactaacttccttctggaactcctccagtgcctgcttcatgttctgcctcactgtgctggaataggcaaaatctgtggctgtcactagttcatacagaggctccacctggaaagggaaaagggcatttatttcaagagaaaaacatttatcaagtagaagtgtaaaacaaaactacaaaggaatggactgggatcagtgtatagagaccacatgtgggttcctatgaaactagatggatctcccatcttctctctgcttccccttacccgatatacacaaattagctcactcaagttcaggtcaacaaacacttagaatgcttaactaagtgctaggtattaagcataaaaaatgagtaagataaaatccctactctcaaggaactcagaatcgagagagacagacaaacataccaacagatggttaccacatggtggatacaggcaccagcagaaacttgtagaaagaagcaggtgagagcagaaaggagtggatgcttcatctatctttggtggggcagagaaggtgattttccagcagctctttggaaggattataggggtactgtcccaacatcactaagccctccaaacctatcaaaatcattcccatcctgcaagagtcactatcaggaaccttccagagctgcaaagctcacagaacaacttccctccattaatcactcaagatactgtctgcactactcatctgaaacaaatcccatgttttttattgctcctttatagtcaatactgtctttttttttttatgtgcagggtcctttttttttttcttttctgattagattgtaagctcccagagatcagggcaatgtctcagctctgtgtttcgagggtccagcccccagctaagtgaatatagtggctggatggatgtagggggatggaaggcctcattaaggtgatggcagggggcatggatgagagggtttggctgtcagaagcatagaggaagaatcagcagatgctgctcactcagtgggcatggccatgtttgagacggagaagtcacagatagatgtggcattatttgtgggttagaaaaaccagaggcacagacagtccaaatagatagttaaaaatgttctattcctcttggttcaagttgcaactccagggccaggttcctctccagcttttgcttgtgattctgccctaatcctgccctggagagtttagggtacgtctaaatgcaggcaatcatgactaatagaagcctcccttgggaagaaaattgcttccatttcttaatgcatctgatgctgacctttgctccagtgggcaaagcaaggccccttggtggtcccattgtctcaccattttgtggtcaatgaattgatccagaggctgtttgcagaaccatccaacctgctggccacacaaggggtgggggtgggagtttggagagagaaagaggggagcttgctttacaccaatgaagagctcctccaacatctgattttgctcccaaagcaccttgaaaggctgccattaaccaaaaaggcattttcctaccagcactggggtttgctgcaggaggcagaggaaatcagaggacaaactggaataaaccttccatatatactgtgtcctgggagctgtgtggaggtctacaaatatgatcctacttcatcctcacaaactagcaattatcagccccattttcaggtcaggctaagtaatttgatcaagatcacgcaattcatatatggtattaccagaattctattccaaaacctgtttttcctcctagttcaccatgattattgataaaaatggcttgattattcccatttacagtctccctcctaggcttctccaaattttgccagctatggtttgacttgcagcttaacagcaactcctcaaggctccaaatttcctttttaaacttaatatagcacattcgtctgttctttgatttgctgctcatttttttcctgtcttttttgttctctccttttgctcctccctccttaacttttgtcctccttttctctttctctttctttcccacttctcccccaaatacacagttctaaccactgacattgatcattggatcctcagcacacctgcccttctgaaaattttcttttatcatattgctgcaaagaaatggtgagcaccgactaaactctacacaagtttccatactaaaccttggtgttcttagtgataacaaataattatttccatagctagcatttattaggtgctgaattaaacactttatatacattatctaacttaatctttgcaacaatcttatgagttcgttagtcttttgtttccttcttgtacaggtgaaaaagctgaggcacagagacattaagtagattgacgaaagtcacatagctagtgagtggtggaaaaagggtgtgacctgttaaccctgtggtctgtttcctttcagtgtatatttttgggcaggtagatggacctatccaagggatgaataggtagcaatttacaccaaattggtggcataagtgtaattttatatctcactttcttcacttaacatcagaatatgagcatttttccacatgattccatcgtctttgataaaatggcttcttacatcttcagagtatccttctatatggatgagccacaatgtattcaactcttcttctgttcttgagcctttaggacatttcctttctttcttttcccttttgctacttcaaataacaaactaagacatgcctttacacatacatctttaccaacttgtcaaattatttctttagtacattcttgcattgggtgttgttggatgaaaagctataagcatttttaatgttctgaatatatctgcttaaattctgttcctaaataattgtatcaaattatattcccattctatttgacaaaaatatccatctcatcacagtcaatgtcattgagtattgtagactttcaatcactgtccctttaataggtagaatataatattgcagttactttaatttttatttttcatgactacagaagttaaacattttgcatctttataaaccaactgagaagtgttcatctcctttgagatgtttctttcttcaaaactatcattccttacatattaaggatctcatttgtggtaaatttttttttttttttttttggtgtgttatcagccatttagttatattcatgggttttcttggttttttcttttccttttttcttttctttttttttttgagacagagtcttgctctgtcacccaggctggagtgcaatggcatgatctcagctcactgcaacctccacctcctgggttcaagcgattctcctgcctcagcctcccgagtagctggattacaggcgcatgccaccacacccagccaatttttctatttttagtagagatggttttcaccatgttggccaggttggtcttgaactcctgacctcatgtcatccacccaccttggcctctcacagtgctgggattacaggtgtgagccaccacacctgctgggttttcctttttgaaattcagaatttatttttgcaggtgagctttgtcaatccaaatccaacattgtctttccaggcatatgctgccacagcatttatattttaagcactccctggaccagagtaatttgctttgagaaaatctttgataccttgctttgagaaaggtatgagggtcattattacagtttattaaatatttcagcttcttttccttctgggcacatggtaaggctgacattcttgctctctttgaaggcaggtttgcaatgtgacttgttttgaccagtgacaggtgagaagagagtgtcacttcaaggttgaggctttccaaacagagtgaggtgacttgtcccactcttttattatcactgctgtggtgatcttgggagcacacgacaagacgcagcccccatcagctggatctgtgagcaactacattgagcaaatcccccttgccaacacactttggacatatgtgattgagaaataagcttttgtggtatcaagctactgaaatgtggaggttgtttctctgcatcatgacctatgctatcctgatctctgtgtgggcaccattcattactgtattttttcccttctgccctgggcaatgccaataattcatacaatggcttctctaccagcataggacccagccaacaacctagctatcctgactagcatagaaatgtacatggatgacagactttgtgactaggattaccagttaaagacaggccattcagttatattttaatatgagattaaaaaacaaataattttttttagtttaagtatatcccatgcaatatttcggagatacttacactaaaaaattattccttatttacctgaaattcaaatttaattgaacttcctgtgttttcatttgcaaaatctagcaactttttatgtgacttctttactatctaaaatctctttggaattcttcacccattaatgaccatttcactaggtcacaagtttttccttcaagactcctcagttgttgctccattttcttcaagcatttcacactgcaaagaattctagggccagtttgacttttattcctgtaggatatatttgttcctaaaagtaaacattttcaccaggatgtgtttcagctttgttttgttttcagtactttggcttagttttcaatgagctgttcattctgcattatcagctcagggaagattgtcttcttatatttttgattaatgtgttttcacatttaattttgtctctttcttaggaagaggtctctgttttaagctttctactcctgtactctctgtctatcgtatttcttttctgccattgttttaatctccctgtctcttgcgtctgcattttaagaacatgtttataacaccttccacatcactgtctcaattttctgcaatgtcaattctgtcgtttatagcttccaatgtgggctttaattctgttattgtatgtttggcttcctgtattcagccacttgccttttcatctgattagtgtctaaacacctcagcttttatttcataaattcttcatttccttgaattgtatgataatcacagaaaatgtattctaaaatcttcttctatttttctgtttttttagacatcgttatttcctatagcatgaacataatttcaatcttttgtgttcaagatctctttatatgttcattgctgtctcttaagtcttctttgaacaaagagctacctatgtctaaagtttaccgctaaacattaagaatgggttcctctgtggtctccttccctgcctacctgcttctatagaaatcatgttttaggacttgatcttgaagactggtttacataattaagccttggttgaaactattgcatctagaaattgcttgtctactgggctctgctgtcttgaaatcaactgccactccagctacctggtaagttggctttgcggagaagaattattctgacataatgtgaagccatctgcagttccctcttgccagaaaaaaaaaatgcatgtgagagtgggatgcccagagtgtatatttccaactcagggtgggaaggtacagatgtgtgtgaaagccgtcaacactcttgcctcctctactcctgcaacactcccaaaacatctctgattctctgacacatcccacatcacatcacatgcttggcatctgacattctcagtgcccaggtaggcacattcaactgatctgagtgaccagggaattcatttggttctcagttttttaaaaaagattcaggtaagatatctcaggaaaaagagataaaggctagggatctattttcccttgaactctgttctctcccatgaccagctgtgatgccaaccaatgtcaccatggcatcggccaagcccagatttctcaggagcccctgcagctcagctgattttatccttttcatgtttgccagcaactgtaccctaagtgccactgttgagtaagtgcaaaggagaggttttgaatggcagccttcttgttctgcagaaactgtgtatttgtcatgcaaataaagaaatcaccaggctggggactgcagagtctctcatcagagcaccagtccctcaaccctccaccttgactgcaaggtgggatctccagtgagtaggtactggcccataatgactgtacagacattagcaagaagagcatggtgttaagacgtgctatgggccctgtgcagaagtccccacaggcaaggacctaccattgctgacgtgtatgacagtcctggtctaacaaacatctttttagtttaacattgtaaaactcctctagtttgggtgacaagtggttaggatcattatgttttattcatcaaacccacaggaaagtctagaggggagggaagaagtcaaagtcttttgtttgaaccgaatagactcttgagcagccaaagatggatacaacttctctagcccttgatttctgtcaaccacaatatggagataagaataattactttgcagaccagtgtggggattacataaaataacatttctagatgttagatgaagaaatatttctaaagagggtcgtgaatatattaggtgctcaagacatgttagttgttgtgatgtcttgtcctgtaagatagttacgtgtgtgtgtgtgtgtgtatcttactgttcctcgtagactgtatgttttatccttgcattttcctctatcttcccttagtaccttacttcctgtagcatagcaggaatttagcaactatttgttggttgaatgcataatgtttaaatgaataaataactaaatgagtgattctctaatgaaataaaaggaatattaatttaattgattaaatttaattgattaaattttaaataaattaatatttcttttatttcactagagaggctagaggccaggcacagtggctcacacctataatcccagcactttgggaggcaaaagtgggaggatcacttgaggtcagttcaagaccaacctgggcaacatagcaagaccccatttctaaaaaaaaaaaaaaaatttaattagccaggtgtggtgtcatgcacctataaccctggctacttaggaggttgaggcaggaggatcacttgagcccaggagttggaggctgcaatcagccaagatcatgccactgaaccctaacctgggtaacagagcaagaccctgtctctagaaaagaagaagaaggagtaagctagaattagaagctgattgttagtttcctttagcaacttggggcccaagtgagagggagtcaagggtctctaggtagtactgagcagtgtgttataatttatttatttcaaatatattttctactatcgtatatgtgtcccaaaattagggcctgggtcttagtgatctctgcattttataccttggctcatggtaggtcctcagaagctattttctgggtggaggaaaggatgggtagagcagcgttgtgtaccttaactttgatgatggctgggttgtactgcacagcgtctccccactcctgcatcaggtccgccgtcggcagctcctggtatgccagggtggtgatgtgctcacttgcccctcctcgtaccaggaccaccaagtcctccaccatggtgtccctcttgtttctgtctggaatggacacagagctagcaggtcacagaagatatccctttgccccctagaatttgctgcaacccaaccaacaatttgggtacaccatattcactgaacttgtctgagagatgtgggtggaccagacacttccttgtccacagggcagtcatggtgcatggggcaaagggaaactcacccagccataggctatacaaattgagggcaggacaagaaaaagacatttatcttgagcagctgtaagtgctagtttctgagtaagtttatggaagatagatgatagctagattagatagataaataaatagataataggtaggtagataggtagataatagactggtaaataggtaggtagataggagagtagataggaagatagatgataggtaagtaggtagataggtgataggagatagataatagattgatagaaagatagacagacagataaatagatagataatagtagataatagtagatagatagatacatagatagatagatagatagatagatagatagatagatagataatagacagacagacacacagacaggtagatggatagatagagagagagatagacaggctatgatattttcttttaccagatagcaattttaggagcccagcattattagctctacttcacaaattatgaaacacgtacctggaattgttaagtgacttgccaaggcccacacagctagtagctgataaagataaattttaaacaaggtctgcctggtttcatagccactgttccttggtcaaataactttcctctctccaaactggctcctgcaggtaaagtgtagtggagctcacctggtggaaactgagttcatcctctcctccactcaccctacacaccttgaccaggcatgagtccatctctgactttgtctagccttgtggtttgggacaaatcatttatacagtatgagatttcttttttgttctcatctataaagtggatactctgcatccgtgtaaagaataaatggtatattaacaactaataattattgattatttatgtgtcagtcagtaatctaagtgctgtacatgtatgaatgcatttgatcttcactacaaaatagtagctatataatcctcactgtgcagataagaaatctgggagagatgaaggtacttaccagacggccctgtccaggccttaaattgtctcacttctttgtgtgagatgacaattgtgggaaaatttataaaggctgtgctaagtaagcatgcagctgacacttactaaacagtggccactataaagcaattattattttgacttacggagttgcccagaaagccctcaatcatatcagtgagttatttccattctaatgtgtctatgtccccagtgccaaaagaactggtgtaaaacagcccagcgtggtggctcatgcctctaatcccagcactttgggaggccgaggtgagtggatcacttgaggtcaggagtttgggaccagcctggccaacaacatggcgaaaccctgtctctactaaaaatacaaatattagccaggcgtggtggcacatgcctgtagtcccagcttttgggaggctgaggcagaagaatcccttgaacccgggaggcggaggttgcagtgagctgaggtcataccactgcactccagcctgggtgacagagtgagactccatctcaaaaaaaagagaactggtataaaacagctcctcaagtctgagcctgcaacacctgagcagcattaaaaagtaggggggcgtctctgccaggcatggtggttcatgcctgtaattccagcactttgagggtaccgaggcttgtagatggcttgagcccaagagtttgagaccagctgggcaacatggcaaaaccctgtctctgtaaaaaataaaataaaataaaataaataataataataataattagccgagcatggtggcatgcaccggtagtcccagctactcaggaggctgaggtgagaggattgcctgagccccgaaggtggagattgcagtgagccgagatcacgccagagtaagactctgtctcaaaaaaataaaaataaaaaataaaaaataaataaaaaaaagctgggggaggggaggagtcctcatctactgccaacaggagtataaattggtacagccattttagaaaacagcttagcactatctagtcaaatagaaaaagcacaccctctaaaacccagcaattccagtcctgtgtgtattctctggaaagacacttgtacgtgcgtaccagataactatgtaagatgttcagagcagcatcagttataattgcttgaaagaggagataatccaagtgttcatcaacagtagaatggacaaagaaagtggtatattcaacaaaatagtatgcagcgatagaagtgaactaactatagttatacacaaaaacattatgttgaatggaaaacacaggactggaaggattatattccattcatataaagttcaaaaataagcaacactaagtcatgttagttagcgatatgttagatggtaaaactataaaaaacagaaggacatagttggcctagaagttgggatagtatttgtctcaaaaagggagggaggtgttgtaatcaccagaggcactaggaggataaacattataagtgtggaagtcacaagcccctgtcactcaccttttatttcattcagaatacctctgcatttgcctacagacacacccagactgacgtagacctcttcaatggcaccaccaattttaaaatcatttttggcacaggcatggacgttgttaagagtataatctgaagaaaacaaggaaaaaggtccatgacgtaaaaggtagttcactctgtcccttttcctatgatcgagtccagaggcctagccctgttgaatgtcacaaggactcgggttcaaataaataggtcaccagcctgataacaagaaatgtaggcagcaaatggcaccagggcagagacctcgtagagctcaggtccagcttccctttcagcctccccgcaacgctctctgaggattcttgctgactttgaaagaggggaagtgctcaaagtcattttctaaaaatttgatctgcttattgattctctagggatagatccagtgagtacagtgactgttacaatctgcctgccctccctgacccacccttctccaatctttgataaagtagaaaaagtgtgttaattaattagttgagaaaatgcatataaaaagtaaggcatagtatctggcaaagaaaaggggcaaatttccctgatttcttcttcatttttggactatttcctacttcttcctccctaattctccctgaggcatcctcctcctcttgtcttgctgaaattccagacgtgacttataagcacctctctaagcactctgaggccagttcagggagaaaagagcaactttgaccaccagggctgtctagaaatgttggtatagatcagtttttcccaaagtgcatttcttgaaacatgaatcccatgagatggtagcagatgttatgagaaaaggaacttctgtggtcaagaaagtgtgacaaatgttgcatcaaaataggtggagaggtcattttattggagtacattcgtgaaactttgagagtggaatctattatgtgttttcctaacttatttaatgattaagcccttttatgtttgaggaacagtggaaagtacttctgagaccatttttatgcaggaaggtacctctgattttgacaagactgaggccacactgtaaaaatttacatggtgtaccacgtgtcctcttgcaagtacatggactggtaatcaagccctggctccaccactgcaatctgtgtgacctacagccattcacttaacccaacaagtgccatgtcataggaaaggatattgggttggaaagcagcagacttgtagttgactggaattggaaagagctgggatatctctatgaagatgaattacaggggagggatgggggtggaatattactttggagaccacagtgataatctgagaccttgctatgtaaagtatggtctattggccagcagcatcagggtcactccaaagcttgttagaaatgcactcttaggtctcactccaaacctactgaatcagaatctacctcttccaagattcatacttgattcacatccacattaaattttgaatgtgaaggtctggtcatggggtgagcctatggtggtaataggaaaaatagaaaatataatttggaggtagagctgatggatttgaagaaaagaaaaaacagcagatttgaagaaaagaaaaataatcaaggtggactgctagttttatggcttgagccactggttcgttggtggaaccgtttctgagatgtagatggctatagaataaaacatattggagaaagaaagtcaaaagttctctttgggcacatgttcagctggtgagatttgctacacattcacatgcagacatcaaagaaacatttcaacataaactctcgggtgcaggaagagatccaggatggatccaggaagagatccaggaattatctgcatgctgaaggtatttagaaccatgggattggatacaattgcatagagagaaaagctgtagaaaagagaatggcctagggagctaggcagaggaggactgacattgtcaatcaaaaagaagaggaagaggaatctgcaaatgacactgtgaaggtgtagccaggaaggtagaaagaaaactacaagttcaacttatgactcttcccccagcttttaggaaagccatggtcccttgggcagtatacctcctctctccatggcctctttgttcataacgagggtgtattcataaatgcccccaagcacagcctctgtgatgtagtgggtcccaaaatcacggaagagatctctgtattccccgtagctgtactccaggggcagccgcttaactctctgaaggaactcgtaatggagcatgaggcttctgggtttcagcttgtaatgtgctacttcaaggtcagagcgtgcatgcagaaatacgcttttctaaatgaaataccaacatgggaaaaccagacctttaaagttaggaatctggaacgagaagatgaactttacaaataccatccgatgttcttggcctggggtcatcactcttatgattcctttaggatacttgagggaagacagcctctttgacaagctttcagtgctcataaatattctgacatcctgttcagcttggaagagcttgctcttaactcacctccttactgtagagaataaggactgggaagggtaacaaaagcaggcatggcagggagcagctggagggcatgggacctctctgatgggacatggggtttgctaacctgcaaaagtgcccgctttgctgatgcctgtaaactctggaaaaaaagccgtgcaagaaagagtaaaagtggtgctttaggaaaaccagctatgacagcgtatggcaggagtcagcaaaatacagcctcataccaaactcagtacctgtacctgtaaataaagttttattggaacacaactgcctccattacttacatacggtttacaactggtgtcacactccaatggcagtgttgaatagttgcaacagagaccttgcagtctcacaaagcctaaaatatttactatctggacctttacagaaagtttggtgactctccatgtatggaatagactgaaagctggtgatgccagatgaagtataaacatctagaaagtgttagtacaaccctaggtgagcattccctatagtgctgtataggcagagaaaaagaggaaggtggcaaacgcctgtgagatatgttcggcctaatcctaaatccttcagttctacaaagccatgccagctgtgctggtgcctattgccctggggcctcattttgtctcctagcttgctctcgccccattctaggcctgcctcagtgacctatgaccctcttccttctcccttacccttcctaaataagcagtcactaggtactctgttcattatttttctgaatattttaggttgcatctcattttgtttgcattattataaaagcctcctccctaatctccttcctttcttttgcctccttcaatgccccagtcagagttgacatcctaaaattcagattgtattatgaccatgctcctcttggcttaaagcaaaaccttgcatggcttgctgttgtcttcagaataaaatcagctcccctactctgagtataagatcatcacaatttgtcctccagtagcctctctggcttcagcttctacactcctgaagttttcttctccacactttactactttctaccaaccacgtacgtcagcattcatccaacttttcactgttccccaagcctgctattctctttcatattattttgcacatgctgttccttctccctgaaatgttattttctcccttttctgcccgacatatacctacttaccttttaaatttctactttgccattgcctccaatctgataacaacctgaaggtcccagatgcaccctggcactcccttttctaggattgcattgtacttgcttgcatttcctttatagcatatgccatgttgtattacaactgatataattaagaaaaatatggccgggagtggtggctcacacctgtaatcccagcactttgggaggccaaggcaggcagatcatgaggtcagtagatcaagatcatcctggttaacatggtgaaaccccgtctctactaaaaatacaaaaaattagctgagcatggtagcatgtgcctgtagtcccagctgcttgggaggctgaggcaggagaatcgcttgaacccgggaggtggaggttgaagtgagccgagatcatgccactgcactccagcctgggcaacagagcaagactctgtctcaaaaacaaaacaaaacaaaacaaaacaaacaaacaaacaaaaagaataatatattggctttcatgtttgctgctcctactacactgcactgtgaacacgaaggccagaatattatcctagaggctacagatccctagtctatctctaggatagtgcctggcccagtgctaacatcctataactggcaatttgaatcagggagctggaagggagagaaggagagaaggaaatggggagggagtaagcaataggaagcagatgatatgatcagattagtatcatagaaatatttcttcatgtgtttgaaggggaaagctaggagacaaactatttagttgggcacagtaagagatgaaagaacatggattaagaggtaataggagttagtgtaaacaaatattgaatagtaatactgaaggatttggtaatcaacagatgtggacatgaagcagaagtgagagccagatatgattctggctcagttcttagcctggaaaagtagaggggaatatgccattaacatccattgaaaatttaggaagaagacattgccttggagtgtcagcacaatgcccaggtgagatgctcagaagagtggatagggaaggtctgaagtttaaccaagaggttagaagcagtgatgaaggctcatagcttgtccctgtaaaagaggaagtgagtcgaagagggcaggcacccaggggagattggagagtacattgagaagagggccatgaattaaataaaggacagatgggaatattagacccaggaaggaagctgataaggagcagaaagaaagcaggagaaacaggagagcaatggtttggtcatctccactgagcaccctaagaagtcagagaagaggtcttgggtaacattccagagaggaatttcagctggatgtctgggataaaagtcaaattcctgtgggctaaaaagtctccagagaagttctggtcttcaaagctacatcttaagcttattgaaaccctaagggaaaagtttattagaaaatgaaagaaaataattagagaaggttatctctgcctggtctctctaaaaagtaagttagctattttttttttttgagaagatttcaagacaacagaaagataattggttgttagaactagttgtaacgtggaatatagacacatttggggcatgtcatttccaaaggatccatatgctatatctggaatgtcccctccaaaactcatgttgaaatttaattgccattgtaacagttttgaaaggaggcacctttatgaggttattatgtcatgagggttctgccctcatgaatagattaatgctgttgtttcaggagagggttagttatcgtaggagtgggctcctgataaaagaatgaagttcagcccccttttttctgtctcctgcatgtacttcctcaccatgtgatgccttctaccatgttatgatgcagcaagaaggccctcactatatgtggcaccttgatcttggacttcccagcctccagaactgtgagccaagtaaatgtcttttctttataaatcatccattctgtggtgttttgttacagcagcagaaaatggagtaagacaacatatacgtttaaaagcaacaaagacatacttacagtatgagagaatcgtttggttctcctaatatagtgtttgcctcgatcactttgactactgatgccaagttcaaatattccaggtattttaaaaccaaaactgaaaccagacttgcttgccattttctctgtgacattgcgttcaaaatctgagtatgattcatactcttttaatatgaattcgtatttgccttgggtctaaagaagaaaaaagaaagggttttttatttcatttgactcaaatcagttcaataccagtgagcagacagccactctactcctaccatgtgctggatactgaactagatgctctggatacagagaaatcagggccgatttgtgtccccacctcagggctcttggttcagtagcagagacagacctgatcaataccttgggtgaaaacttagaggttggtttttgatttgtatttcaactggcaaaaatgcaggggaacattctgggctgtgggctcagcttaagcaaaagcatggaggtgggaaaggggagggtgtgccccaggaactgcaaggatagcagtgcagttcattgagaagttgaaacagcgaggagaaaaaggggatgttgtgagaggatattctgacatcaaaataggcttttgaattacttctcctgaaatctgggagtaattcaagtatgacctagcagagggagtagatcaagcctcaggaagatgatgtgggacaacctggtggttggattggaagggaaaaatttagagtcagagagacaaacccatgaggaggctgtaagagcagtgcaggtgatggttgatgagggtctggtctaaggcagtggctggaggatcaagtgacaagggcaggaaagtgccttagagagaacttaggagagccatttgctctaaaaccagtgttcatggcactgtgtgtaggggaactgccaagggtactgccctgggggccctggagtgaccagtcctgagtcatctccctgcccacagctcccatcagcttcagcttctgcccattcagcctgcaactcccagacaagggtgcaacagctcagccgctacaaggggaaggaggagcagttcggacatggtctacagcatggccactgagatgcgctgtgtctctgctcttgtctagtcggatgactttggacaattgccttgacctctccatgcctcagtttcttcatgtgtaaaatggaggagataatggtccctttcatcaggcttgttctgaggattgggcttatactggtaagtcatagcacggcacctggcacagcgctcaaagaatgttggtatggagagcggagagtttaccatgtatgtcctgcctgagttaggatccacttgcacctggatggtaatggttgctgtgaaatcctcccttgaaattagaggttttgaggatggcactggacaccccaatggagagtgtgtttggcgctaagccaaatttgttctttcttggctaaaaagtgtgttggggaggaagggaaggaggagtaaggaggagctagccttcaaaatggtgcaataaatacattttaaagacaggatcttgctttgtcaccaagctggagtgcagtggtacgaccttgactcactgtagcctcaacctcctgggctcaagtgatcctcccgcctcagcctcccaagtggttgggactatagacacgcaccaccacacccggctagaaaaaagggagcaattttggaagtggaaattaccgtcaagatcttctagtctcgtcccccagtttcacagatgagaaaactgaggcccagagtggaaaaggaacttaacctaaggtaaaattgggacctgtggcagagccagtcctggaacccagtgtgttcccatcggatctcaagtgtgtgtgtcctatgggctattctataccccactgtctgtgagatgtttctaagtttgtacatcaatcataataggggcttacattggtagagcatttcataaaatgcttagagtaatgcctgcttttaataggcagggatttgataagaatgcaataacaacagcaaaaagagttaacattttctgtggactcaccattaagccaggtgctgtgctaaatacttacacacattatctcactaatcctctccctgcagggtaggacctctataactcccaatttaaagataggaaaacagaggctcatagcctttggattatatggatggtaagtggcagagccaccaagtcagtgtgactccaaatcctaagctttatttctatcttcaaggtagcttttgatattatggtttctattattactgctctacaaccgccctcctgttgctatatacagcatgtcatcttcaccacaatgtctggaggaaggaactgcccattttcacatatgaagaaactgaagctcaaagagaaaagggctagcaggctgtcaggccggaccatggaccctgctaactgggtgctcagctggggctccctccactgctacctggctgtctcttacctgtggcgtgtagctttccacattgtagggcttcctaaacctcgtgttcaggatgtaatgcggggagcatccacctgcataatacctgtgatcaagaactgggccctcaaaactgtttgtgaacaaatttatcctgtgaggaagagacagagatggcgaagaggttaaagtttgcggttgcttaatcttgactgtcagaccctactgaacgaaaacaaaaactccttggcacagccttcaaggcccttgatacctggtccaagccagctttccagcttcatttatggccgcccttaaccacagccacgtgccctagtccccagccatgtgaagaggcttgctcttgctccagtctactcagctccttctgtggtaggtactgttccctgcgcccagaatgcccttccacccagtcactgttttatctctgacttgtctgtcaagattgagctctgttgccactatggtgagaggttccactgacacttgtggtgcttgaagcccgcagcccagctgggttagggaccctcataacaccctgtgctcgcaccgttgtgcatttattgtcctgtattactacagttgccttgcgagagttgggtagcataatagataagtgcgtggactttggagccagacgtctgagatccaatctctgttctgccccttactgcccaggtgaccttgggcaagccaattaaaccttgggtggccacttactacctgtgtgcctcagtctgctcatatgcaaatagggaccatgaaaatactacctcatggggatgttgtgaggatcacatgtatcatgtttatgaagtccttaaaacactacttggtccgcgataaatgtgctatttatgtatttgtcaccctcactatactgtgtgctgtttgaagtggcggttttcttaatttccgtacaaccctcatcacaacgcatttacaatattattcacaataattactgtttactgagggtgtaactggtgacaaacacagcagtgggtagctacgtgcatcatctcattagtgtccctgcagctctgtgcaatagatgttatctccattttagagaggaaaagaatccagcccctccttagacattatttgtaactgcctcctaaggcaagcttccattcttgaccatctctaactactgaaatttctgtttttattaagagtctctgtctcctatcagcttccacttattggccttggttctgttcctcaccagaattgtctggggtctctttcccatgacatattccatgtatcaaaataatgtatacatatttattttctttaacaaatataatgtggtgctgactttgtggaggcatcatcctaatcaatttacacacaatggctcatttaatccttatgaggattaatcattaggaggttagtattactattatccccattttgcagatgagaaacatgagggtaactgactaacccagagtctccctgccgggaacaatgggtggactggactttgaaatctgacagtggagcaagaacagagtctgtattcttcccaccacacgagctgcccagcacctcgtatgttagtcacattcacttgttcaatcttcacagcactttgaaagaagcatgttattaacttcctcctgcagatgataaagctaaagttccacgtagataagtgccttgcccgaggtgccctggccagtgagccactccttcagttccctcctacagggtcctgtcagaccctactgctggctttgaatgtctgctatcccacactctagctgggtgaccctggaactcactcaactttcccgggcctcagtttccttatctgcaaggtgggaattataataactagcttataaggcaatcctgagagaagcctcccatgtgaagagtctctagtgacaactttaaaaattgagatttgatgggtttttttagaaagaaggtaaatcccattcggggtcagtgttcccctccccaggctgtgtctcatatgatgattcctaaagcatatgaggggaaggtctccctcttccacctgcaggctgagaagatgcaaaatatggcaggaaagtaaggtgcatgccaggccagtgtggccccttctgaacttgctcctctgtcctcgctagaggacaggaccaactcagagatccccaaaagccctggaaatccatcccttcactgtctaaatagagacctctcttcttggagggaccaatgctgggagataggggcagacctggataaaacctgcctgccaagttgtcaataggattcaagaatgtaaggcttagaaagcacctaacatggtcacactgcaggtgttaaaataaaggctcccctccctaccccagcccttgcatagcagcctgtgtggtttccacacatgcacagctctgtcccagtgttccaaaccagccctcctgatgcctatatctgtccatgggacgtgttcctggagctgcttggaactgccctcagagagcaaccggaagtgttacttacaatacagtcttttctcagaaaggtgagtgaggacctctgtttatatcagttctctcattctctatccgccagaattccatttaatgctgtgccttcccatctacgccacagaaaaatggtcacttacccactggccagactgccaattccccagtattggtccatttcatgctgacattttttataaatccttctacagtttgcttcatctgactggtctccacagtcattgtccccattgcaaagaagtctgcggtttacacaccttcctagaatggagaaagagtattacccacagccacatggttggcaagaaaggaactaacatagtataagcacctaccaagtgccagaccttttgtcaggccttgcatgctgccctgttttaattagtcatcctgtatccagatagattggttatggcactaacagtttattcctctattgccacctccctcagcagaagaggccagtgttgtattccagaaagcagcaggacagtttggactctctctccctggggctggaaagagggggtgggatgggtgtgtcctgtaaattgtgtgagctgggccacttttctcttgttacttaacctctctgcctcaatttactcacctgtaaaataggaaagtaaaatacctatcccataaggttgttcgaagtttaaatgaataaataaaacagtactgactcctaggaagtgctgtgtaagtgttatcagtactattcgtgtttttgagggccaagtgcacattaactagtaaatatttgcagtgggattgaaacctttaactgtctaatcacaaattcttcccactaaaccacactgccttcaacaacatagtcatttggattatgaaaaattatttgcatcccttttgcttcctttaaactttttcctcctgattgatttcctttcttattagtatatcgttgggagataaagcccataagacaggtagtcctatttcctcagatatgtctggtcattttaaaccaatgttcttggagtgttaaaagcagaaaaatagcaatctggccttcaaatgtttcttaccagacatttaaactaaagcctgtccaaataaccatcatggctttcatcagaatcatggaacacaggccataatgagtccacggatacactgtaaaaagtctctcagatttattggatagaattttgcatttgcaataacccctagaaattgctctaagaatccctaactctttcttgaaagatccccatgcacagtccacatgggtacagtaaatgtagagaattgcaacttccatctagaaaatgtgggtcaaaatattctcatttttgctggagatggagaaatagagaaccatctgtttgcttggattctctgaatgaattgaaaagttgtgtttatttagttttgcagcaggtgattattcatttctgtactcctttcttcctaccttccttccttccttctgtcagtctatccatctgtccttttttcttttcttccttttaataaacaataatttttaccgggtatatcatggattaaggatcatcttggacttagtgatgcagaaatgtaaatgacaggaaatatctttctaaagatttatcagtgataaatgatgctaactgccctatgtaaccgttctaggttttgtcatattctacttaaccccagacctctgagagagctaagggagccaacagtctacaaagagctctcatagctatgatgtcacttgatgcttataacagacctgtaaggtattcacatcacccctaattttcagttgagggagccaaaatgcagaaaggttaagtgacttctgctagtcacaaagtcaaaataaggcctgacccaacatttctgactccagcacacatactttttgtgtctttaatgtcaatgaatgtaatctgaattctcaaatttccaatagaaacttttccacttacctgctatatgaagaagtaacctcttcaagtcttgattttttaaggtatataatgaggataataataacacctacattataaggtgatttttataaaataatgcatgtgaaaggaggtcagagattttaggacaaggaggcctcctgagctgccccatgaccctgatcttgagcactggacatggcctgtcccttggtcatcaagaaccattacctcatttcaggctttcccctcttactcctacattgatttatacctgtctgtgcacacacaaagccttcacatcgcacttgacttccgcatggtctgttggtaacacagtcttcgacttccttgtcagagaagttgcacggttccccatggaactgagagggctggagcaagtaggcatacctgtactgtagcagagaggagccaggtgaaccaagggtaaagccttagatctcaggagctgagggatactctgtgtaaatgggtcttgagccaggatttgggcttcacaagagcactgaaatgtctgatcatcattcccccagccccttgtgctccccccattatatatacttaaggagctatgttgtgatttgctgtttgctggatggtttcttcaattagtctgtgagctctctgagggcagggaccttggctttgatctctgcttctgcagtgatcagtcaagatttgctgaatgtgggaaagtcagcccatgctgactccatgggctctggagtcaaaggttagtagatggactcatgtagccagttcaataacacaaaataaattatctctcagcttaattactccactgggttgattcaagtattcccctttattcctgaaggcatcagtatattataaatgcaaaaacatgggctttggagctacaactgattctgatactttatagttgtgtgatattgggcaaattacttaatatttatgaatctcaatttacccatctgtaaaatagggatcacgaattatctaaatgttcagttatgaagtttaaattatataatctcattatgttgttggatgtatagtaggcattcaatttcttggacttgtttttctttattattgctttttagcagtcaatattgctatatctctaccatcttatgcatttattccaaaatgattgattgagccacccagtgttgaaaaggtagatgttattgttgtttccttgtttggtcagttttattggtaattgtatcccctagcctgttctcaaggaggtcacagatgctggggttgggccccaggcagttgcagcacagtgcaatgagtgccatgacaggggaggcagagtgctttgcacactcatcgggagtccctcatgcaaacttaggagaagcccaagtggaaggctttggaagaactaagtgacacctcagctgaaacttgatggctgagtaggaatgtctgacaggtgtgaagaactgacgagagtggggctcagaagagtgatatgggtggaggaaattcctgtaccaaagctgagaggactagagaaggtttcccgtgttccagaaaacattaaaaagattcattgtggctggggagaagagcacaagtaggagagtggccagagtgggagggagacatagacaagagcagataacacaggggcctccaggccttaggaaagtgattacaggattttatcctgcggcaatgagaaactgctgcagaggaagaaagtgatcagatttgggtgatttccaaaagttagttgcagtcaagattttagtaaacaaaagaacacaggaggcaagccaggatagcagcccctgctttgcaggatgacattaataaggcatagttattacctttatggcatctatactttggccttggaaatccaaaaaaagaaatgtagataaccattcacctatgccctttgtacttgcaaagggtcattctttctagaaggcagagcctgtcaggacagggacaaggcttgcagagaacactgtgaaaaaaaaaagactaaaaagctccaggctccaaaggcaaagtgggttccaggagtgtgtaagtggtgcaggaaatatatcacccaatctgacttgagaggctttgctgagcccccagccagtgaccctgcagacagggatgataaccagctgagggaacgtctgcggcagactctgagagaggagctctggctgccaggctgactcatgctgagtcttcctagtttatggtgcagatgaagcaattatccagataattggatcaatgctgataccttcagcaataaaacctactttgggaactgaatgatccaccttggctctctccattgatccaattaactgggtgattgtcctgggcttacttccacagcctctttagagtctaagcccatggctggtttggtttcccaaggatctggggaaatagcaaccattctcttttctctggcatatctattgttctcagaagtaggatcctgggtcagccctcctatgaccaaggaggctgaatgacagatattgcggaaattgagtgtgttcactggaagaaccctatacaaggaatactggacagtagcctgagtttgaggtctgcatttactactaggtgaactcaagaagccatttatctgctctgatttcctgtttatctgtctgtttaacagaaagtgtaacaacaacattgccttccctgtagagatatcagaaaacagaacaagatcaaacaccacatatttatgaagaacctattctgtgccagagattggtctacacattgaaaatgcagaattaaatcagccttcacaagttcactgtgtattgaaggtgaaaaataagtggcatgatgtgataaatgtgaggatacaagggtaataaggagctatcgaagctcataaaagattgctttatccaactggaggtagggctgaggaggagtcaaaaagctttctcaaaagaggcagctcctgagtaggagtttcaaattgtgagtaggtgttcaccagtgaaggaagtgggaaatgtcatcctacctgagaaagcagcatgaagaaacgcccagagagagtgaaggccagagtcatacaagtgtccattgtgctggaaatgtaggctagattcggtcacagggatcctcgaaaaccatgatcctggacttgatcctaagggtcatgggtagactgtgaatggtttccaagtgggcaaagacaactcagacatacactatgattgcttcccctgtttcatgatgaaagattgattgaaagaacaggttcaaggcagagagtctaattaggaagctagtagagtgagaaaggctgggtgtgcttggaaaacactggagaaccaaaggaaagaacttattgctgcttggaagcacagaaggaaaggatgcatttattaagttagccgacatttattgagggccaactatgtgccaggcactgttagcaatggctcagccgatcttgctggggacaaaggctcctggaagcttagagctgtcccaggcctggttgcttacccttttcttctgacaggggtcacatgtggtccaagaggaccaactagacagctcacaatcaatgggcatcagggtaacatccacactccgcatctgtctgctcttagcaaagctcttgttgactgcatttgacccaaaggaatgtggcctttcacctctaaaagtcattatgagagaagagagtcacgtatcagaagggaattaagtatacatccaaccatctatttgtacattcaataaatatatatttgctcacttgtgcaaggctattagtttatcattccaggataacctatcctggaattaattaattaatccaacaaatatttaatccaacaatgaaatattaattaattccattccttaattaattaattaatttaggttaattaatccaacaaatatttattgaacatgtagtaagcacctaacattatggctagagaaacatatctgtgagaaacatgcctcacgccctagctctatgggactttatccagagggcagggatttccagcatgcaggccccatggctggagctgtgcaggcccagtgggagtcaggagagcctggtagtagggaaacaaggaagaggctggcagcagcagtcccactgagtggtataagcctgaatcatggcaatggccagggcgagaggatggggagaaccagcatatgagatgcttctcatgtggaatggatagaaagtgatggtggatggtggaggtggggtgctaaaggaaggccttttaagtggatgctgttttcccatttgagtgtgtgggcggtgggaaacacagcagaaaataaatcttgatggggaagacttgagtttcgggtggggcatgctgagttccaggtgccatgaaacacctacggagactcatttagtaaatagttcctatatgggcttggatctcaggatgagagatttgtgctaggtacagatctgatcatggaaagctatggaagaggaggagatggttcttgagaggagaagtgagtgaaggatacttattcttggaaacctcagcaccaccagcagagataaggcaatgcttttggttcatttcctggagcacattgggttatgagtggatgaatgaggatgctatttaatttgcctgggccttcagtttcttcctctgtaatatgaagtgtgtatgatgattcttatttttttcttacaattgaaagggtgtattacactgtaagattctttgtaatttgtgttcctttccagggcacaaaaagagatgggaagacaaaaggaatggaggtttgctgagcacctatgacagacatgtcaaggctgtgctcaatggcccagcatcacccacgctatcttcttctattttcacagcaatgctggaagacagctgtggagcactgccacctgggcagatgagggaagcggcccagagagacagggacacatccacggtcatgcagctggtatgcagtggtgttacgatctgagccgaggtctcttaggctctagagtatatacgggttttgtccgttgccccatgctgcctggaaggaaacagggccagcactgactccaataatctcttccaacatctatgtaaggcctctttctttccatatccaggattgagtcattagggagaagagcatcacgtagttttcaccatctcatatacacaggatgtcactcccgacaaggtcattaacaatatgttctcaattggcaaaagtcctaaaaagaggataatattaactacggtgaaatctgtgtccatgaccgccacagagaccagcaaaaatcaattgcctagtaaagctggatctttaatgaaaggtcaaagactactggaaaccacaggtggatactttaaaacggttacttgaggcaggatgctacacaccagtggggggcttcagagtgtgttcttatctactaatttgcccaggtttgacaaaacaatattgtctgtgatttggcttctcctaagtatgtatttgacagctctgcagggtaccctcttcctatttcaactacaaaactgttacattatgtttttagcaaccaagacaactccagggccataggtgagactgagcaggtaagtaatgtacacactagctattaagagtcacaattattttcgtctctgagatttgaaagcctgttaatgggcaagatgatcacttacggaaagaacttggtaaaaagtagttatatccaccacatctctcatttttgcacccaattttcattatggaaggtggcaatataatgaagtaaccagctgaataaatagtatgtttgtaaattacatcggatgagatgtgtgtggtttattagtactataaaatgcaaatctgaaagaaaggctaggattaaacagcatctttagttcctgggactaacgaggagccacataaattctaggttccctcagggcctctgtgtgtgggaacaacatgagcctttcacccctatggatttctatagaaacaaacctgatggacattttgaccaactgactaaacttctgtcattaaaaatcctctgtatgcttttaacattgaaaaattaagcatgcctagagaagtacaagaaataatataataaacacccatgtactcacatccagattggcagttgttcacactttggtacacttgcttcaagtctttttgtaaatttttaattttgacatctgcattttacagcagcctcgattttgctccccccaccttacccccagaggggctattgccatgaatttggtgtgtttccttccagtctcttttagataatttgatgtctatacactatctatagtattgcttgtgtgtgctttattcatacttacacatatgattctgcaactcacttttgttaatcaacattgcatttctgaagttatccatgttgattcataaagagatctagttcatttcttttgtctggatgttctatcatatgacacacattgcatttaatttattccttctctttttgagggacatttatattttcccaatgttttgcgattgcaaatagagctacagtaaacgcccttgctcagctccttgaacatgtgccccctctacttaaggactggcaaggaggtgtctttcctggggatgcagaaaatgctgtagccagcattaggacacatttaactgggcccaggtctcccactcttttcctaacaggcgtctctgatcaaaataaagatggatccatccagtacagcaggattgggtcagcagtaaattgcaagccatcagcttatatagatggggtgcgtcaatatattttggctttcggtagaaatgccctgacacaacaactttcttgtcacacacaatttgttaagcagctgcatcccctttgcaaacagcatcctttttctttgctagaaggggcagcttctaggtggcaggttttcaatttctcttctctctgtcgtttgctgtggtagacatgaaatttaaagcaacatctcaaggcaacaaatgtgtggcccagagatggagaaacagcacagaggccaacaagtcagatacacaatgtggaggttggggggtggtggggggtggggaggggacaacgcattagtgagaagcagaaggatgcagagagagtgcagggactctgagacctgaatgaaactggatttgaatccatagttagctgtttgttaagtggatagccttgggacacttatgttttctgtttccctctctgtgaaactgtaaacagtagcacttacctggaatagctgtgaggattatagctaatgtttccaagttgctggcacagagtggcaatacataataggtcttacgacacagtgattgtgatttcatcatctgacttgattacaagagtaagtaagaacaaaaaactcttttggccaatacgaaggtggtctcagcattttctgttccagaaccaaagactattcttctactcgcagatggaattcaaatacctgtcgtgttcaagacagccccatggggattataggtggatgtcagaactatacccagattcaggtaagggtttgaaaacctcaccacacatgcgtgaatcttttcttgtcactgaggatcagtttgttctcttacatagcgagaaggagagattacacccacctcatgatgttgtagtgacaattaaatacaatttctcagactgcactctaatcaacaatttgcccctccactccctacctcagagtgaacttcctaatatatatatttgatcgtgtcactcctttgcttcaactcttcaatggcttcccaatgcattgtggtgaggatatagttcaagttccttagctggtactccagcatcccccaactctgcccatgacatgatgcctgttcactcctactctatctcatccctctcaacttcctgccgggacctgtgttcaaggcccactgaggtgtctggaagcttcaggagcaagccagctctctcacactcacgcaccgttgcctgtgctgctccctctacctggcacacctttcaaccccttagccattcggcaaacacccacgcacctgtagagattcagccctcacactctctgttctagaagcctttccaggccctatgccctgtagagctgatcattccctccttgtttcctggctgccccgtagcatcttttgtaacggtacacatagcatatgctcacatgttggcattctttgtgagaacataggctcatctctgtatcctcagagcccaacagaaagctccacccaggggcacaatgctatagatagggttgctatggttcccttaagtcctccattccggagacattttcttgggtcctgaatgcttctctgtgtacacacagtacacacaaggaaggtcttggcagcttagttattctctgggctaaatggagtttcttgatcatcctaatagctgttacttattgagtggccaatagatagtgaacgaatgctcatcatcctgtggttcctaatggcagctcaacagaactgagaccagaggctgtgtcccatgggtaggaggtactcctcacataaagtgaaaggtttgttcagatctcatttttggactaagtaaaaggaatggaattacagtccctcttcccacaggagtgtttacatggaggccggggacacatgcacacttcaacatctcatggcaggggtttctcatgcacacggagcatccccacattgctacgtcactggctcttctatcactggagcccaagtttgagctcccactaggatattttctttagcttgttttgcaccttgttaatggagactaacaatgatgaaataaatcagccagcatttaactgctgggaaccttgtggggggtgagagagagagagagagagagtgtgtgtgtgtgtgtgtgtgtgtgtaagaagggggtgggaaagaacctgagaatctgaagatttggggttgatgagcaggtagagtaggtcaatctcatttattaaaatcatttcatgaatttgctcttttgtcctctgtatgtaacaaactttctttttcataaagaatcacacggaggctttgttcagaatacagaaaaaatatcctattcttctcagcatgacaaaatacatttaaacctgtcagtttcttacaggaacttttgttgaaatcagctacttggttccacaataatttgaaaagagttgttgatagtatgttatcagatgcatgcaaattgccttaagagacgttcctcattcaataggcatgcaacaaagagatggtcagcatcatgtggctgcaccttccctgtcatattattgatcagggaattattggtaactgtcacttacctggagccaggcaaactgagacagcccagggcagcacagagaagaaatagctccaccggcgccctccaagcccatgtcctggaattcttcattttcccaatgtgacaggagatgccacagaggctgctagacccataacaagcctgtgctgtgagtgcc

SEQ ID NO: 2368 - DNA, 1729 bp, Homo sapiens
  source 1..1729: mol_type = genomic DNA
agagtagactctgtcctgggacttggtggtgctacccttggcctcccacagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcaggtagaagttggggggggtagagggaggcaggtagaagttgtgggaggggtagagggagacaggtagaagttgttgcgggggagagggaagcaggtgaagttgtggggggtgtagagggaagcaggtgaggggccctcccacagtgccctcgagttctcccatggtctgcccccagtttgcagggacctggctccttgtggctgtgggctccgcttgccgtttcctgcaggagcagggccaccgggccgaggccaccacactgcatgtggctccccagggcacagccatggctgtcagtaccttccgaaagctgtgagtcccagagcagccctgcaccctaaccccaaccctcctctcagcccccggacttcagccctgctctggcccctgaccccaccccggctgtggcctggactaggattcctggttggggtctcccagcctgtggtgcctcctccccgcccccccagggatgggatctgctggcaggtgcgccagctctatggagacacaggggtcctcggccgcttcctgcttcaaggtgaggcaggggctgcagggcatgtgggtgggggatgacgcagccactgtggctctctgacatggctactgtggctctgccccagcccgagacgcccgaggggctgtgcacgtggttgtcgctgagaccgactaccagagtttcgctgtcctgtacctggagcgggcggggcagctgtcagtgaagctctacggtatgtgggggccagcctctgtgaccaggcaggcgctcaagctctgcacactcactgggccaccccgaggggctgggtgagcccatggggacacacttcctttctcccatcctgatcctcctgctaagcaggggcccagggagtagtgacagacaggcctggtgtgggagcagggagagggccccgagggggcaggggacacacagaccccgtttccagagccctccacgccgcctggtgccaggaccccaggaaccctgtctgccctgcagcccgctcgctccctgtgagcgactcggtcctgagtgggtttgagcagcgggtccaggaggcccacctgactgaggaccagatcttctacttccccaagtacggtgagtgtccccagcaggtccccagctcagccacccccactctctgggctgatgtccagcctgacccctgccttgggcccccaggcttctgcgaggctgcagaccagttccacgtcctggacggtgagtgcacagcggggcaagcatggcggcgtggtgaggggggccactgccaccggctgagtctcgtctctgctgcagaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcagacccc

SEQ ID NO: 2369 - DNA, 80278 bp, Homo sapiens
  source 1..80278: mol_type = genomic DNA
ttcctttttttaaagagttctcagacctttcaaaaggtctcagaccctaagcaccatgttctctaatgaataagattgtacaaccaatgttaatcagcttctcaggtaggtaaccttaccttatacaactcataaggctaggtattaagttggactatataaaattgatgttttttcttgtaaaatatgatcaaatagaaggaatttcacataatttaaactaatagtttatgttcattctattctgctactgaacactatctatattattcctttcatctaactggatttttgtacccattaaccaactcctctttatctcccttcagtcctctggtaaactagtagtttttggttacaaatataatatgttttcccccttggacacatggatttaaatcgtagagctaagactagtaaaagcaactgctgtgcacgtggctggtgctcagcatttgctgaatgaatgtatgcacacctaagcaaataaccaaactaaacataacaatgtaaataagagttaaattgcatggtacagacgtgtggtcatggacctggcagaatatgttaaccatacaaagccgtttgaaaattactttgaagttttttaaaccaacattctgtttttaatttaattttgtttttttttagaagagattggcattttccgtgggataaagcagttctggcgtatttcactgttgacttctcattagggaacaaaaaatggaaacatcacaggagtttaaggaagaaaaatttaaaaaaaaattatagacctaagagagaagagacttcagaggttggtaggattttcatgaagcatgttgctatttacttggcagctaagattatcttcaggggtaggatctgaaggtactagtgttttcttcttccactggagctcagagaagccaacagctctatttttcattggggaactctagggctggcaatcctagagaaaacaaataagtatcaaatcttaatcatcaataggattttactttgggtccatccacccatccgctttttcaccttcttatcctcttgcaccacgttgtgccatactgtctaggtactgggaatagaatgtggtgtaaggtacaaggcacattttcataccagaaagggctatttgtcttgtatacagagagtcaatgtgattagtgctggaaaaacagagggaaagttctcaggcagcatagatagagaactgattcctggagaaattggagaaggtttcatcaaagatatgctaattggactgggttcaaaatagaggtttttaaccctggctaaagattagaataaccagtagattttttaaaaattcaaaaaacaaaaaacccatgcccaggcaggatctaccatggctgcttttgtttaattggcttaggatagacatctgttttgttttgtttctttttttttttttcctttaaggaagtgagccagatgaatccaatgaccaacctggttgagagccattggtctaggagtagaaacgcacacaaggaataagggagaaggaggttcggttagttgagggagagaaagttggaagcatttcaagctaagtaaatggtatagaaaaagaaagatgatgtgttacggttttcaatctcatcatgggtgtaagctagtgtaaattggaaactagaacattctatgtcaacatggatgcttggaagatctaccttgagggaaaaattcaacaagaaaatgtctaatgtctcagcaagaagctgtgggccatcctgggtcaggtttgaaaggtcaaccaaacaatgcctagtgatcaaagataattttatattggggaagggaccttgatattcattatctatgaaacacaacatatggaacccgaaccaagaactttacataaaaatctagtgcaagactgatgaaaatgataggacctcctaagaaacaaactaaccctaagaatatgttcattatccagggaagacgggtttccacaggaaataattcccaccaaaaactaagcctgtaataaaaaatcactaagtactgaagaaagcataatatgccatgagaatgaattggtagacttagcagagaattgcactgcagaaacaatatatactggaacaatttgaaagaattccgtgaagatatatttaacatgttgaaagctataaaggtaggaaaataatccagtagactagacaacagaaaaaactagacaaaagaaaattgaaaaagaaccaaatcaaaattttagaaaaatacttttaaaataatctcaataggtcagcaaatggatcgactatacaaagttgaataaaataattggaaaattaaaagctagaactaaagaaatcacagagaaatcagcagaatattctacatagagagaaataggtagaaaatagacgttccaagtaccaagtagtatacatttttggagagtgagagttttttttggaacgcaaagcactagattgagactttagaccgatgagagacagagttagcatacatttataaatcaatcattctaaaatttaaattaaattctaacttacatattttgtcaccacatgattgagtttctaagccatttgctgagaagtgtaaaaaattcataaaatattaaaaatttatattgtaagagatgaaaatatggttgaatgataaacgaggctgtgaactttggctacataattgttttagaattttgtttcaggaaactgtatttgttcaaacaatgattgccatagaaagttaatcttaatagctaatcttgtgatattaacacttggactaagatctcactaatctattaggagtctgaataattctaccagaatgaaatactaagcataaactcttaggattagaaacatgactaaagtcatgtttacttgtaggaagtaaaatagtttaattgagtcctatttgtctatttttgtttttattgcatttgcttttgaggttttagttataaattatttgtctaggccaatgtccaggagagtttttcctagattttcctctaggatttttatagtttcagatcttacatgtaagtctttaatctatctcaagttaatttttgtatatggtaagagaatagagatgatttctcaaaaaattaaaaataggactaccactcaacagtcccactactgggtatctaccgagaggaaaataatctttatatgaaaaagatgcctgcacacatatgtttactgcagcacatattttgatgtgcaatagcacatatttacaatacatatttacaatagcaaagtcatggaatcaactttcatgtccatcaatggatgattggataaagaaaatgtggtacatatgtaccatagaatattattcaaccatgaaagagaatgaaatcatgtcttttggagcaacatggttggagctggaggtcattatcctaagtgaaataacccagaaatagaaaatcaaataccacatgttctcgcttataagtgggagctgaacaatgggtatgtatggacataaagaaggaaataatagacagtggggactccaaaaatggcgaggatgggagggggatgagggttgaaaaattacctgttgggtacaatgttcactatttgggtgatgcgtacaccagaggcccaaagcttatcattatgcaatatatccttgtaacaaaccttcacatgtaccctttaaattcataataaaaatatttttaatgtaaaataatgtttccttatgattaacttaaaaatacaatacagaatctcagctttcaaaaacacaaatacagttaaaaatgcaaaataaaaatctagtgaatatcatttatataaaatttaaaaacatacaaaacaatatcacatatttttcattggtacatacatatttagtacaagcacaaaaatatgaactggaaagatacataccaacttaatgaaagtgactgtatctgagtagtagaagagagaaaaggcaatagaatttttttggggggcggggatgtggtacaaagtaattaattggatgtattattgttgcttcttaaaaaagggttttaaagtatatatgtctacgtctatacacataaacacatatatatgcaaagtgtatatgatatatatgtattaacattcatcaattctatatagtgaatacctgatgtttgttgtatttctgtaaaccttctataagaatatttttataaagagtaatacaataattataatttatttatttataattctatcttaatatatacaagtagaatatgtcagaatgacacataaaggctgatttacccattttcactattcactcaatctttatcttctgtttatataaataatctagagatttagtacaaattaattcaagagctagttttcaaattagataaccccaaagtgcatatttttgtctttaatcacatcaaataaattgtcctcaccttcagaaattttttgtttactgatttcacaggcaattccctcaaatttgaatgggcaggcacacaaacactttccatccattagaatcactgtacctccattttggcatgtgtggcattttcttacactaaattcattgatatagtcttcaatggctctttccaagttttgtttctttaggtgtgcatttttcattttcactggaaccagattatatataggagacagctgaaaggaagcaaaacatttaattttaggtcctttttaactgagagaacttgtagaatacactttacttaattattcattcactgattcattaattcaacaaagacttattgaatgtatagtattgccagatgtgatgttagcttttaaacaatcaaaactagtcaagatgactgctatcagggaggtcatattacggagttaaggaggctgatattaataaaataatgatgcataaatttcaaatagaaagtgtgataggtgctacaaaaaaaaaacaggtatatgtgctttaaaaatgaacaactgagggacttaaacttctggcttgataatttattgacatattttgtgaattgtttttgctgccttcttccttctcttccagaaggtaaccagatgcttgctatctcttgcctaagaggaggtttgtgtgcaaggccaagtccagaatgcccctgaaggcaacctttttctaatttctttcttgttttttttttcctctaaaagtctaaattcattgagaaatttttgtagagggaaggaatatagaagaatgccaccaaggaaagagattcctccagaatagaaaggggatagaagttagtatatacctcaagtaacaggaaaccatagctagatatttagcagctattttgggagatagaaggacctatggggtgccttgaggaagctgcatatgaagtatcaggaatccagtcttgtcagtgatttccatttgcaagcctggcatggagggcttggaaatatttgacttctagtgaacatgtgagcctgaacaataaggttattgaggtaactacgatgaactaaaggcatatgtaaattatatctccatttcccagatggaagtgttaggattcttataccaatttagacagcagggaaaaaatttcctgagccccatccaacaagtaaatgaaaggtgaattttctagcaacatggagggacatgatctcaaaatcacatttaattagatgtaaagaaaatgaagtaaaagtatttatttggcacactcaaattcctgcagtaagatacacagttgctacactgaaatcaaggaagtttggaaagctttgacaataaatactgagctgagatttgaaggtgtcaaggcagagagaagactatttcaggcatacagtaaagaattttgaaagtttttaaatggaggaggaagttgggaagatgttgttccaaagatacaaaattgtagttagatagaaggggtaagttcagaagatctattgtgcagcttgatgatcatagaaaaaaattaaaaagttcttataatggagatatcataacatatacagggaaatttatatgttcacttaatttaagcaaattcaattgtgtaactagcaagagctgtttgagtgaataaactgttagaaatagaggcactttggtggcagagcactttaaaacaagagaccacaaaacttaaaagaaatgagaatctatagagcccagagctaaaacaaacaaacaaacaaacaaacaaaaacaaaaaacaaaccaaaaaaaccccacaaattcctgcagaagaataatgatggattaaataatgtggactcatcttttccctaaggacaatgaggaaagctaaacaaaataaaaccaaacatttttttttaaaactgctaaaatgccctggacaactaataagaaaataaaaaatcactgatctaagatctgggaggaggtggaaatccaagaggtgggcccagtattctagggctactagtcctcttgacacatttcctaattcagcaagagttagtagagagactaggaggtagagcaacacattactgagctgaggaaaaaacactggaattcagatcaaccaaggtagacatgctatcctttgatttggggactaagagggaagtggaagtaggatagctctggcagaaactgcagcccagtttggattaaaataatcttggatcattagtggggatgctggaagcttttcaaatataaatatatatgtttgaaatatacaaaattaccccaggcatcaggctactcctataataattttacgtacagtatttagcccacagtaaaaataactaggcacacaaggaaataacacaacatgaatgagaccagtggaaattatggaaaatagaaacagctatggtggctgccaatgtttgtgctatcagacttcaaacaattatcagactttaaaccaactgtttgcataaacagggagataagagacaagtctgaaaattttagcaaagaactggaagttattaaaaatagatttgaaaaaaagaaacaaatattagaatacaaattagtgaattagttaaatagcaaatgtgataaaactgaagcaatttaatgaattgcaatataggtaagaagaaaatattgacaataaagcatgaagagacaaaaggataggatatacagaaagagggaaggaaacataagtgatagtgtgggaagggaaaagatccatatattttgagccccagaaggagaacaaaggacagaataaataagaagcaatatttgaaaaactaatgactgagaatattccagacctggtgaaaaacaacaagatatcttatgaataaaaactacggtgaaaaataattttgcagctaggtattatcagagaaaaattgctaaaaaaacaaaacccaaagacaatggagaaaatcttaaaaacagtttagtaaaaagccttagtattttgaaagtagactaaatttgactttactagatacaatcaataatattataaagagtcaaatggaaatgtaaaaaataaaaagcatgataaaagagatgaaaaatatctttgatgagtttgtcagtagatttgacacagcaaaagaaagaatcagtaaacttgataaaagggtggtagaaattagccaaattaaagtgcaaagagataaaagaattgaagggagggaacccagaactaagcatccaagagtgtggggcaatatgaaagagactagcacatgtgttactggaatccttgaaaaaagtgaagaggttataagaaggggttgagagggggagagaaagagaatgtgattgtggcagaagaaatatttgaagatataatgaccaagaatttttcaaaagtaattaaataatcaaaccatagactccagaaatttagggaacttcaagcagaataaatatacatctcattcaaactgtggaaaaccaaagattaaaatgaaatcttcaaggcgatgacaacaaagggaaatgctacaagcagaaggtcaaagataagagttacagcatactgcttatttaaaaactatgcaagccagaagacaaaggggtaatatctttaagtactgaaagacaaaaacaaaacaaaacaaaaaaaaatccacacaaactgtaaacatagaattttatacctaatgaaatgtcattgaaaaaaatactttttttttcagagaagaaaaagccaagagagtttgatactagctaatgcacactaaaagaaatgccaaaggaaatttttcaggcagaagaattaccacaaagaactaaaatttggacctacataaagtaatcatgagctctgagcataactaaaatgaaggcaaaaatatacctttctagttttaattgctctaacatatattatctacagcaaatgttgtcgcattgtagtatgagtttatagtgtatgtaaaaatttaaaaatatgtatgtaaaatatacatacactataaactcatgatacaatatgataaaaatagcattaaaaatgggagggaggatttggaaatatagtgtatttgttttacactatacataaggcagcataatatcatttgaaggcagactatgataaattaaggatgtatattgtgaatcatatgttatagagtaaaaaatattttttaaaagagacatgagtaatatatcaatactggaaataaaatggaatcatataacatactgaataaaaaagaatagtcaggacaagaaaggaacaatgtaatgaataaacaagatttaactgaaatgttaaagggagagtgctggagttcagggggaagcagaaaggcatctctggtggttggaaggccagggggtcttacatgcccagattactacagaaagccattcaactgcaaagataaacaactaggaaggaaaaaagaaacaaaagatattcagaataaccagaaaacaatcaataaaaagacaggaataagtcctcacctatcaataataaccttgaaggtaaatacattaaattccccatttaagagatatagatagcctaaatggacaaaaagaaataatagccaactatatgttccctataagaaactcacttcacctgtaaagacatacatagatgggatgtgaaggatggaaaaagatatttcatgcaaaggtaaaccaaaagcaagcaagagtagctatgcttatatcagacaaagcagacttcaagtcaaaaactgtaaaaaggagaaaaataataacattatataataataaagggatcaattcagcaagaaaatataacaattttaaatatatatgcaaccaacactggagcacccagatacataaagcaaatattagatctaaagtgaaacaacaaaataatatttgggtacttcaacatttcactgtcagcgttggagagattatctaaacagaaaaatcaaaaatccaagaacacaggatttaagctgcaccatagaccaaatgaacctaacagacatttacagaactttttgcccaagagctgcagagggcacattcttttaatcagtgcgtggaacattttccaagattaatcatatgttagaaaacataacaagtctcgaaaaaattttacaaattgaaattatattaaataccttctaagaccacatggaataaaaccagaagtcaataatcagggaaactttggaaactgtacaaatacatggaaattaaacaatatgctcctgaatgaccattaaatcaattaagagattaagaaggaaatgttttaaatttcttgaaataaatgaaaatagaaacagaacataccaaaactgacgatacacagaaaaggcagtagtaagagggaagtttatagaaaccaatgtctacttcaaaaatctagaaaattttcaaataaacatcttaatgatacatttcaaggagctagaaaagcaagaacaacccaaaccccaaaatagtagaaggaaagagataataatgatcggagcagaaataaacgaaattgagactgaaaacatatacaaaggattaatgaaacaaaaagttgattaaaggtttttattttaaaagaaagacaaaataaacaaacaatagctagactaagaaaaagaaaaaagaagccccaaataaataaaatcagatacaaaaatagagatatcacaacagataccacagaaacacaaagggtcattagatactgctatgaacaactataaaccaataaatgtaaaaacttagagaaaatggataaatttctagacacatacaacctctcgagtttgaaccaagaataaatagaatacctgaatagcctaataataagtaaagagattgaagttgtaataaaaagtctttcaacaaagaaaggtccaggaccagatggcttcaatgttgcattctaccaaatctttaaacaagaattaacactaattcttctcaaaaatttttttaaagactgaaatgaagggaactcttcctaactcattttatgagaccagcataaccctgatatcaaaaccagacaaggacacaacacacaaaaaaacccatagaccaatatccccaatgaacatagatgcagaagtcctctacaaaatattagcaaactgatggcaacaatacatcaaaaagataatacagcatgatcaagtgggcatgaattatccgagaaatagttcaacatatggaaatcaataaatgagaaacatcacatcagcaaaattatgaacagaaaccatgtgatcatctcaatagatgcagaaaaaccattggataaaatttaacttctctttgtgatacaaattctcgataaattaggtatagaataaaagtaattaaacacaataaaggccatatatgacaaacccacagccaacataatactgaatgagaaaaagcagaaagctctccctctaagaactgaaacaaagatgcccactctcaccactcttatttaacatagtactggaaatccgagccagagcacttaggcaagagaaagaaataaaggacacctaaattggaaaagaggaagttaaattgtccctgtttgcagaagacatgatcttatatgtagaaaatcctaaagactttaccaaaatacacttagaactgacaatcgactttagtaaatctgcagaatataaaatcaacatgcaagaatcagtaacatttctattaaagaacaacaaactaggccaaaaaagaatgcaaaaagtcaataccatttacaatagctacaaaagaagatactgaggaataaatttaaccaaagatgtaaaagaaaaactatgaaacactattgaaagaaatggaagaggatacaaacaaatggaaagaaatcccatgctccaggcttcggccttactaccaaaaacaatctacagattcagtgcaatctctatcaaaatgacaatgacattcctcacagaaattgaaaaaaaaatcttaaaatttgtgtagaaccacaaagacctcaaatagccaaagcaatcttaaacaaacaacaacaacaacaaaaacaaagctaggagtatcgcattatcggatctcgaaatatattacaaagctgtagtaaccaaatcagcattgtactgccataaaaacaggcacataagcaaatggaacagaacagagaaccggaaattaatatatctatctacagtcaactaatttttgacaaaagtaccaagaaaaataactggtttcttttcaatcttttcaataaattgtgctaggaaaaactgattgtccatatgcagaagaataaaattaaccccccactttttgtcctataaaaaatcaacccaatatagaatactttattgtaagacctaaaactataaaactactggaagaaaacataagggaaatgcttcaggacattggtcagggaaaaaattttctgaataggatctcaaatgcacagggaacagaagcaaaaatacacaaatggtttatatccaattgaaaagcttctgtacagcaaataaaacaatcaacacgtgacctgcagaatggggaaaaatattttcaaactatgcatctgacaggagactaatatccagaatttagaaggaactcaaacaactaacaacaacaaaataaataatctgattgaaaaataaacaaatgatctgaagagccattttgcaaaagaacacacataaaaggccaaaaagtatatttaaaaatgttcaatatcaaacggataaaaataaacaatgctggcaaggatgtggaaaaaaaaggaactcataacactgttggtgggaatgtaaactagtatagtcactatgtagaactatatgaaggttcttttgaaaactataaacacaattatcacatgatccagcaattccaatactggcatttatccaaaggaaagaaaataagtatataaaagagacatccgcacccttctgtttattgcagcattattcacagtagccacatggataaataaataatgtattttttctttttaaagaaaataatgtatgtacacaatggaatactattaagccataaaaaagaacaaaatcttgtcatttgtggccacatagatggaactggaggatattatgttaagtgaaataagccagaaagagaaagctaaacaccgcatgttttctcttatatgtggaagctaaaaaaaaaactgatctcatagatgtaaaaagtagaacagaggatactagaggttgggaagggtaggggaaagacaatacaataaaggccatatatgacaaaaccacagccaacatcatactgaatgggaaagagcatactgaaagggatatttgttaaaagatacaacattacaactacataggaggaataagttctagtgctctataacattgtaggattactatagttaataattatgtgttattatacatagtttcaggtatctagaagaagaatattgaatgttcccaacacaaataaatgacaaatgttttagatgatggatacactaattaccctgatccgataactatacattatcattatcaaaatatcactatgtaccccataagtatgtacaattcttatatgtcagtttaaaaaagaaatgtcggaaatgagcaaaaaggagacaaagaatatacagaacaaataaaaacaactagcaagtacagattttaatttaactgtttcattaattacattaaatgcaaatggatttaatacactaattaaaatacagatagttactttagataaaaatagcaagacccaactatatactgtctacaagaaactcactttaaatacaaagctgtagatagtttcaaagtaaaaggatggaaaaagttatcccatacaacattaattaaatggaacctccttggctatattaccatacaaaaaattcttaacaaataatattgttaggaataaaaagatgaagttttcaatatacaaagaagatatataatctaaatgtgtatgcacccaatgacagaactttaaaatacataaagctcaaactgatagaactgaaaagagaaataataaatatacctagacatttcaaagttctgctctctataattgaaagagtaagggcacaggaaaagaagtcctgggctgtgctatcaactaattgacctaactgacatttacagagcattctacccaacaacagcagaatacatattcttttcaagtgcacataggcatatctatgccttaaaaatactcaatatattgagaataatgaaaataatacaaagtatgtcctcagaccaaacaaaatgaaagttgaaataagtaacagaaagctatctgaaaaatccccaaatatttaccccattaattaccacatttctgaataacccatgtgtagaagagaaagtcacaaaaaattagaaaatattttaaattgaatgaaaatgaaaacacatcaaaacttgtgggacacagttaaagaaatgcttaaaggtcaatttacagcacaaaatacctatattagacaagaaaaaaatatctaaaatcaataataacagcacccagcttaagaaactagaaacagaagaaaaatttaagtacaaagcataaggaaggaaataatgagaattgaaatagaaattgaaatgggaaaaaaatagagaaaatttttttaaagctgcttttttgagattacaaaaaatgataaacctctaccagattaattaaaaatcaaacaagataagacaaaagggaaaaactttaaattaacaataccaggaatccaagacaggatatcactatagaatctacagacatcagctgcttaataaaatggaaaaattccttgaaagacaattgataaaaactgaatcagaaaaaatgcataattggacttctaatatctatttaaataattgaatttagagttaaatttttttctaacaaagaaggcctagatggcattattggtgaattctacaaacatttaaaaaagacatatcaattctacaaaaactttttcataaaatagagaagaatttacttctcacttattttacagttagcattactttgataccaaaaccaaataaaaatagttaggagaagaaaattacaaatcaatatcactcatgaacatatttgcaaaatatcccaagacaatagcaaaccaaatacaatagtttttaagcaccaggtttgctcaaaatttaaataatcaatatcattcaccataacaacttattaaaagtgaaaaaccatatgatcatctcaataaagaaaaattcttggacaaaattcaacatctatttatgacaaaaattctgagcaaactaggaattaaagggaacttcctcaacctgatagagataatctatgtaaaacctacagctaacatcatacttaatggtgcaatattatattagatgcattagacaatgcaataatgcaagaaaaagaaataaaatacatagagattgagaaaataaagaaatctctatttcagatgacatgattatctaaggaattgaaactctcatatatttctggtggtaatgcaactactttggaaaaaaatttggctatttcttatgtaattttgtataaacacacatatcatatgaccaagcaatctctctcctagagaaaagaaaaatatgttcatgcaaaattctgtattcaaatatttataatggctttattcataatcaccaaaaaatatccccgtctgggaacaaataaatgtccttcaacagatgactagataaacaaactgtttaatctatatcatggaactacatataatggaatactactgagcaatgaaaatgaaaggaactactcatacatacaagaatgtcgatgtgtgaatgtggatggatctcaaatgtgtaacactaagtgaaagaagccaaattcaaaaagttacgtgattacatttatatggcagtaaatagatcagtggttatgtagaagtggggcaggaaagaggagttgattgaaaatggacatgatagaactgtgtggtagaaatgttttatgtattggttttcatggtggtttcatgattgtaagtgtttgtggaaacctagggccctttacactaaaaaaaataaattttactttacataagtaatgtctatttttaaaaatctaattacattaaaatgtatctatatactactcactaaaaaccaagatataaaattatattatatgaattcaaattggctaactatacctctgataaagactctgatgactggaaaatgtacactaaaatattaacattatgatatctatttcacttgtgtttttggattatattagaaaaggtttgttaggttagagatttttatctcttttattcactgctttagactcaatgccacaatagagcctggtacactgcaggtgcctaagaagtatttgtcaaagatgaaaataggctgggtgcagtggctcctggctgcaatcccagcactttgggaggccaaggcaggtggatcatttgaggtcaggagtttgaaaacagcctggccagcatggtgaaacctgtttctactaaaaatacaaaaattagctgtgcatggtggcaagcacctgtaattccagctacttgagaggctgaggcagaagaatcctttgaagccaggaggtggaggttgctgttagacaagactgcaccactgcactcctgcctgggtgacagagtgagactcgatctttaaaacaaaaacaaaaagaaaagaagcaaaaagaaaagaaaaagaaaagaacaaagatcatcacatttgatttaaaaagtccaactaatccaaacaaaacttgaggacacaaacaaattgagaaaaaaagactggagaatgtgtgctatgtgcataccaacagagacgtctggcaaacataggtaatttaaaaaaaaaaattgaggcagaaaacatttactagaaataaaggaagacattttaattgaccaagaaaatgtaataattctaaatttgtatgcctttggtaatatgccttaaaatatataaaataaaaattgatccaagtacaaggagaaataaatacacaaatgtagtgtagagttatagatttcttagaattttctatttaaacaacataccatgtatagaaagacagtttaacttcttccttgcagtccttaggtattttatttatttttcttgctttatttcactggctaggactcagtgtaatatgaaataaaaatgatgagagttaatatttttcgtgtattccttattttagtgagaccaagtttaatattgtagatctaaatataaaagcaaaataataaagctgttgaaggataatacataggaaagtatcaaggccttgaggtaggaaacaactttaattcaaacattaaaagcactaactatagtgaatagaaagatacatttaactaagtcaaaataaaaaaatcatcaacatcataacccataatatgatgcactgagaataacagaacattacttctgtagtattcttgccaaatatgcataaccttaacctacttgaatgctaaattgggagacatttgacgtgataactgaccagtcctcataaaaagtgtcaaggttgagaaagactaggaaagtctgaagacctataacagattgggagacagtaaagagatgtgacaactaaatgcaatgtgggaccctagattggatcctgaaacaggaaaaaaaaaaggttaagggaaaaacttgtgaaatttgtacaaaacctgtgctttagctaattactcagtgtgaattttctgattttgataattttactatgcttatgtaaattactaacattaggagctgggagatgaagcttataagtgaattctctctactatttctgcaatattactctctgtactattctgcaatattacttctgcaatactacttctgcaatattactatctgcactatttgtgtaattttgctgtgtctaaaattagttcaaaataaaaagtacataagaggacatctgtatcaaaaacaccattaaagatgaaattctttagtgggagaagatatttgcaaaactttagttgtgaatatgctcatatatggaatatatcaagaacttctacaaagtcagcataactgttcaccagtgtagtcttttatgaattagtatatagtatataggattcagatttcaaccatgtcatatttatttgaaagaaggaaacctctcaccaacattgtcacattggcacaaacaacataggcatgtggtagaattattttgatttttttttaaagaaattcatcttgttatacccttcaaaggaaagtcaaggccagacagtctaagatacaggaatagagggtcatgaaggaaatacaatttggattaaatgtataaacagtgttggaagagttaaagatgaaggacatgcaatggcaatagtttcagaggagcttcaaatcctggagttaaaaattccacaggaggacaaaggaaaattaaaatgtactttttgaagttttcctgaagggttccatctttttctgatgaacttttatcttctattaagtaagaaaatgattttactttttctcctatactacataactctatctttctaccatgtgttgatatatttatggtaggatataatctaccataaaagtggtaaagtataaataagttgataatatagtttaataataaataggtggagatttccttcagacatccaaaataaactatgtataccaactgtagtttgttgatagaatgagtgttgttttttatccctaaacaagagagttagaaatgattttcactggtactacaaccctttaaaatattgatgctctttaacatctggttcataactgctaacagttacacaatagagcaaaaatgacgggttaattaattcatgaattactacatcatgtaactctggaagaactaatacagcttaacatatagacatatgagtggttgagggaaatgggaaaggagaactgagaacagaaaaagcaagatggaggcaaaagcaacaaaaatgaactacattcatgccaggaggacccatccatttgcatgaagtaggtcacaaatttagcttcattttctagtgcattgagtaagacacagttgaatttactgatctcatgcatttcttaccaatcaggtagaagaactcacctgattcccaagagaaacaaaatgagattaaagagtaatatttcttatgagtctcataaagaggacacagcattacataacaaccttttagtaaataaaacagtagattacataactttgtttctaataatggaaaaacaaaactttacaggaagccaatattgtagctgtactcatcttgctgctattgctctagaagaaataataatctttatatcttccaggcaatctataataaatgtaatttctcttagctgacattttaataactaatttgtagcagtaggtttaagaggaaaacaaagtgcagctattctgttgagttaaactgtagaaccacttgtgttaacattcaggcaagttggcaatagaattaatatactttcatggaagctgaagaccatgacaaaagtaagtactgaaagagagggccagcctatgtcctctgcatggagaaaggccaaggagagatttttgggctgggccaagacattcctcaagaagtggttttgggtttgacaaagcagacaaatggggcctcaaaaccacaggttctacctaacagagcatggctatagttactttagtacggaaaaatatataactgtatttatagattttataaactatattattttatagtattttataaattatatttataattatatatactatatatttataacatatatattttaccacatagtttacttagaaaatctcagtaacatattcatacagcattccacttagagtaaaacagcaggtcccagaatgttatttcattcaaggtcatttctttgtaatattgagaaaaaaatcaattctcagctggggtcactgtctgcatagggattttgacattctccccatgtttgtgtgggctttctctggttctgcttgtttcctcccgcatcccaaagatagtcatgctagacaaatcagtgtgtctatatggtcctagtctcagtgagtgtgggtgtgtggagtttgccttgtgttgagacggtgctctgtccatggctgattcctgctttgcaccctgagctgctgggatagactaccctgaactagaataaacaggtaaatcattatcttacttgtttttattaatctttttaaaatgtgtgaatagcttacatatatttcaaaatttaatattagaagtgtttcagtttttatttagaagtttggtgatgtttttgtgaccagaaatacactacaggaacttaacccattcattagcgtatggtaaaattggttttgttacaggtcattttggttaaggtcacagtttccaagaacctattgataatattaagtgagagcttacagtcacctttctggtctttcctccaagataatcagtttgcaacataaatacctagataattgctttaatttgctacagaagatttaatattgaccagtttatagtttagggtgggtggggagaggttctagtaattcttcaaaagactatcccctatgtttgaacatgtcatctgcagacaacataatgcttcaaattcctgaaaatgaattagtgatcatagattgtgtaattgtctcctggaaatagctacaagttaaccagaggtccacttctacctgaattatgagagtaaaataacttggaatctaattcaagatcaaatttaactatatctcatgtttcttcagagacttaaaagtcatacaaagtcaacaaaacccataattttgcttttcctcaactctttctacaagaagataaatttaaaaagtggtccatagtgaactaactatagctaccatttccttaggtagaatgttgatatgaaaaggccagccttccagtttatcaagaaagaaacttatacagatagtctaaatggaatgcctaccaacctgaaaatttggggaagtaaatggttgtccctaaaaatgggataaactatattgtgcatccatacagcaggactgcaccaacaaagttgatgagggtctttgaatagttttaataaatctagtagtaaatcttcagcagctgccttatttacttgagatttaaaaaattatctctagaacgtgctgaactattattaagacctcttcagagaacactcttgaatttgtagaaagacagttgaatttgctttgtagagatgagaaaataagcctcctgggatgttcacctcgatgtaaatattcacctaaatcacccattttttttcttatttaagatcttccaacataaacttattttactgagttcaagataatgaatttgtgttagatttaaatttaataagatcaaagaggcatcctctgattttaatttcatacatggaatttcaccagcttttttccccctttttgtcctactttgggacaaaatattttaactcataaatacattgcatatctatgaacggctgtatttctataacataaagggagaatagattataaaaattttcagtttctgagttccttcttcacataaaggagatagtggtttcactcattctttaaagacaataaaatagaataaaggaataaaattctccaataactagtcctatgaaaatgttaaaatttctgtaactcaagttaatcaaactggagtagggagcagtcaaaaataaatgtgacctgaggaaagcaaattgtaaaacatacggcgaaaattgaaagttataaaggtaagtagaaaaaaagcacttactaatagtaccagtaaaagaagtaaagaaaaatgcatactagttttaggcagcttggggaaagaaagatgaggctaaataacattgtcatttatatctttacaatgataacacatttttttttgtctaggaataagaacttgactatgaactcccaaagggtttgtaagctgaaaactattataatcaagatagaaaaaggaaaaaaatctactgaccataagaattgttcaccgttagtcttattttcttgtagactttatgaacatttctttcataaagacccttaggccaggcatgggggctcacgtctgtaatcccaggactttggaaggctgaggcaggcagatcacttgaggccaggagtttgagaccagcctggccaacatggcgaaaccctgtctctactaaaaatacaagaaaattagctcgatgtggtggtgcgcatctgtaatcccagctactgaggaggctgaggcatgagaatcacttgaactcggaaggcggaggttgcagtgagctgagattgcaccactgcactccagcctgggtgacacagtgagactctgtctcaaaaaaaaaaaaaaaaaaaaagacacttagtaaatacaattctcctgtgttagacgtgatagtggaacaccacgggaaggcaagaacagccaggggccgacgggagggaactaatcatatgtgagtacctatcttgttacagtgtgtgctgtatgctctatataagcaatttcgttaaattctcagaacaaagatggagtcctagagaattcagtgttgtagaggtcagaaaacatcccacacatagtgagagacagagacaggaagtcagccaggatggtctgactctacaccatgccttttctctatgccatgcctccttttggggaagaaatgggagtgtatctgaatgttcacgtctctttcagatgaagctaacagttcacctgaaacaatgtgacatttaataaaaaaatgacacagtcttctgtttgaaaataaacacgtttcttactttttgactaatgagaacaggagcatcatttatggaagaggcccagttgacaaagtcagtcacatcaatcacggttcctcggagaagcttttctttcagttcaaatgcatattttctggttccacctcttatgagtgaaacaacatcatctatgaggttttcactggtgatgtttactgaggagagaaggaagatttaaagagaagcagaagaagtttaaagagaagccagttatcaaaaggacatatgataaacatttattgagtccttttagtaaaatacagcctaatgtatttattaaattttaattgtaaatattgcttatgcattttttcacctcaaatctacaatggaaatttacattagtaaccagttgtagatttctgtcatctcttttaaaaaataaaaatgatacccatggtctagatacactgataaattcacagctcctcacatacaaacatgtactcacgggaactaaatatgactttgggtgtaatatatattttcttttgcaaacttaccttcataattatattgtgtacatttgctttgatatgttttaatattacaaaaagaagagttcaaaaaagaataaagtgaaaagtaacatttctttccactcccaaatcctacccatcgtttccctcagtgtctctctgtagatgaagccacttttaacaaaactttgtaagtcttttacagctgtgaatttttaaaactggaaaggaatttcaagataatttttgtcatcccctcttcatttttatagaagagaaattggaaacttagagaggtggagtgactagtcagagatcacacagttagcttaaggaccaaatatagaaattataccgtataatggcaaattcagcttttttccactacttcatcattggtttttcaatcatggacacatattattggttggtatgcttttaaatatatcaggtttttcctcacttttgcctccccactaccagttgactcttcctttaaaggtgagctttaagcatttgtattttaaaaatgttctcaggtatttctgattagaggaaaagttgagaactctagcactaattcatgcttgtaaatctgctaaagattaacagtaggaagtaatatttataccaaacatatttgtatttttgaaaaggttaggcaccaatttaaagttaaggatgaattagggatttcaatttagatggaaggtggagttggggaaatggttttggccttgtcctttgttaatggatgcacgaacattgtcgcttgcttatttggaagctttgttaaaattagggtgaagaaaggaaactttttatgaagatacttttttactattgccataataaatatacaagtctaaaatgactaccgtgtgaatcacacccccttgagttgtgtactgtacaactggcacaatagtgatactggtgaatacatgtccatgcgctatcggtgtttatagtggtttgaaaaccgctttaaatgtaagatagtttttaagcacaaagaggacagacaattaagagggctcattgcaagagggcagtgctcattgacatctaccctcaggctttataaaatctaacaagtgaggccacacttaccagctctaccctctcccctctttacacaatcatctttattaaattcagctccaacagagatttcagagaaagccagagatacatccagatgatacccaaggcatctctttatgtcttttagttcaacacctgtttaatgaatttatttgaaaattattagataatgtctaccaacatcacaaataaattccaattttgctattttcaagcaacatccttacttaggttcctatacaccatgactaaattcaaatgtgccatcatgtctgtcctgctttgtcctcatattagattatagtgacctccttttgactttgcttgtcaacttaatggcaaaggacacattaagtctaccacatggtttaaagggatataggtcagactatggtggttatagtaaagtcttttatctgtaatatcatagaaaagggacaacaatgtctaacatatattgaatgcttatcatgtgtctggcatccttctaagcattttgtgtgctttaactaatttaatcctcacactggccttatgaagtaagtccatattgtcctcattgtacagatgaaaatatggaattgcagagcagttgaataacctactaatggctcattactcagctagtaagtttggatttgaacccagagttgtctagctactaagcacttctctgtatcaacttcataatttggatgagatacatcaacatctcctgatcctctttggaagactcagttcatccttaatgtagctggttcatcgctttggacagatggctgatgtatgtggtcactttgttttcatcctatgaatgctacttggtagatatcagtcttggaagctgactcattatggtgtgtagatgcccaaacagttactagaaagaaaaatcctaatattttcaaagtctatcagttattatctgtttttgcaattcataaaaaaaataattattcctctattttaagggtaaacatcccagaccacagttcactgacaatgtcagtttttgccgttatttatcatttatttcatacatgcaaacacacacacacacacatacacacgaatttgtgattatttgttctgggagtcaaaatgctttatgaaaaaggaaagaaaaaaatgaaatgaggttaatcatggggttctacaaggagtatcaggggtagacatctgggggcatttaggcgtttattcacctatcaaatatttctcatgcacccacaattagtgagaacttagaaattatcaggtggcatttcccatgggaagggaagagagaggataaaaatcgaagacaatactagaaatccgtaattctagatttctaaccttatccttaagaagtgtgaggactctgcttctgaagatgagggtgaaagataacctgggtgaccctaaagggctcagattctctgccttagcagtggacactcatgtccagacatcttaaattgaggtggaggacatggcttggttctcagatattggcactggagaagtgagaaagagcacttcctcttcaaagtcactagaattgacctgatgatccttgtctattaaggccagaaggtaagtagcttctgagttattcaggattaaagatctcttcctatggagctttttcatcaaaacaactcctagtctgaagatttctttgtgttttgatcaccactcataagcctttctcttctcattttcaagttactcaagacctgtgtcctcttgtacccttcccttacgtgatatctccatcaatatagcttccaggtggagctcacagcaacttcactatgctgtggatatagccctgtgaaagtgtaagctaagtaacattacattccactcccccccgggaaagcttctctctgcccaaaacaagactgaggcatcaagaccagctggttctggctatgtcatgttttgttatccataaagtatttgctgaccttggggagaatatcaggcttttacgtcacagttacattccacccttcacttaacacctgataccttgacactgaccccgtaaaagccattaaagtggtttttagcaacgctttcctccctaagagacacacctatagttacaagggcagagaggaagcatcctggcatccatcacctccttaaggaatattataactagccataattactcacaacatgaatgattacaacttattaatatagtcactttgcatttacttttttcttaaaagacttagacgaaccctttaggccaggctgataactatgtatcagtaggcctatcttctacccatgacagacattgataattaaccatggcccttttccccatgatttccccatgaccagaaacctacttaacatgagcccaattcaaccaccaccatataatgagaagtgtcatcacatgaggtaaaactaattttccacccttgctttaagatgttagatttatatgataacactgcttcttcttttccctctaaaagaaaatttagaacaatattttccctccaatattgaagtatactctggaagataactgtgatatagaaattgaactagtctattgattaagaagtaggttatacaaattatgtctgtactttctttcaccttttgtttagtatttcactaaaagtaccaccttctaatagatgtgaagctgcaatacaatggatccatctctcagtgctactgttgagtagagtatgaccaagtcagcttgtttgagatggaagtcaatttgctatttaacagggttttaggtgccaaagggcaggaagagagtcctctcaaaggagcaggttacagggctttgtattcttaagactttaaccattgaaacaggttggtgaacaaaataatgtttggtcaaaacagtatttgaagtcagagctctatttctaggcatacctttccgcttcatggaagctttatccaaaacatatattagttcatagagtcctcctagagacccagagctactgtagtgagttccataggtttccaaaaaggcaaaatattctcccttttcataggtagttggcaaagcttttatatcatccacaaaagttgttgtgagcacaacatcgcgatttctcattacaaatcttcccagatgaatttctcctttcacatgcagaaacattttttcctgtgttgtagagcagatgaagaagagaaacatgtgttttatccaccatttcaaatgaaaatttatgaaatttagaacttccataggcactaaatgttttagcagtgaccatgagataccactctaatccaccagaagggctaaatgtaaaatactatcaacaccaactactgatgagaatgtgcagtgactaaaactctcctacattactggtaaaattagacagccactttgaagaactgtgtggcactttcccatagtgttaagcacacatttgcttatgaccagccagcaattccactcctacatatttacctaataaaaattttgttcacaaaagtatctgtataagaatttcatggcagcattagtcagaatagcttaaaattgaaaacatctcaaatgtccatcaagagagaaatcaataaacaaccatagcatattaatacaatggaatactaatcatcaataaaaaggaaaataaaactactgatacatgtaacaacataaataaatctcaaaaatattatactgagtaaaagaagtcagacatagaggagtatatcctatataattccatttatatgaagttctagactaggcaaaactaagctgtggtcagataaatctggtcagtggtcacctcttaggtggtagggaacggaaaagggcataaggaatttttcttggggtaagaagcctgagtgtctcttcatgatggaattttcttggtgtgatgttctttaactcaatgtattttaaacatagatcttaaataatttccatctaaatatgctgctgtgtcttctatgttaaaacatttaaaatattctcttgctaaaggagatggctactctaatgtacataattatcaaaactcatgaaactatacacttaaaatctttgcattttattttatgaaattatacctcactaagttgttttaaaaacaacagtggaaggaaatggagacattatcaataaagcccaatcttgctattatgcagatgagaaaactaatttaaagatatcaagttatttgtcccaaaacatatgaataatacttgacagcattggtactaaaaacctagatctcaggtctccttgtccctttcagtccaccctctcaatttttaatgacagagacaggacagacaatattttgagacgtggaactcaagtcagcctaagcaactcaacagttaaatgtttccagggccagggctgatggcttacctttcccggagaaaactagggcagtgaactgtgtgattcaatgccatagcttgtcctgatgaaaactaaactacaattgacacccacaattttgcaaatggatcttttgagggtctcctaacagctgtggttaacatatgatgattatgtgggagtttaaaatattttatttctttttaaaggtatatcttgcagtatatgaatatcataccaaactgtctgtcttcttaaagcacattgttgtcatcatgatttaactttaggtgacagtgggtgatccagtctttaataaaaatcttagcctgtatgttataggtcatatgagctcttcatctcctgacttgcacaagaattctcaaatatgccttattcaaagcatatttggatttcttttcagttttgctaaaactgggaggtatatcttgggatttggggtaagaaagacatgtgatgttctttgggtcaatttacttcaaaggtagctcttagctcattatcatccaaatatgcagttgtttcttctatcttaaagcaacaaaaagtttcccttggcctcgcttgcctgaccagccactacccatttctttgccctcactagaagcaaaatttattcagttttctatactgtatattttgaattctccccttccctgtttttcttaaatctaaattattcatgcttctgacctcactactccaacaaaatgtctcttatcaaggtctccaatgactttcataatcctaaagcctatgatcacttcttagccctcatcttcttagccctcatcttctttgacatgttagcacaattgacacagttcatcactctcttcttcttaatagagattattttcttgtcttctaggccagtgcttctcaaactataaaatgtgaacaaaccacctagagaatcttgttaaaatgcaacactgagtcaggtaaaatgcaattctggagcacagtctaagattctagcctcccagcgatgctgatgctgctgttccatagaccacactctaagtagcaaagttcttgggcactttttggtttcttttacttgttttctattgaaattcaggaagtttggtatttgattgtattctattttctatgtacactaactctgttagtgaccccatgacgaagtcaacaagtcaatgtatagctcaattccaggtctttttcccaaactccagcctcaaaacaccaactcctacttggcattgtcaattggatgtctaataaacacctcaaacttaacctaactaaaatttaattactggtctccctctccaaatctgctctatctgaagctttctccatcagcaactccatttttctagttgctcaggccaaaaaccttggacttatgtttgactctataattgtcctatctgaactaccatcatgtctcacctggattccttcagtaatttttagcaagactccttgctttggctcttagcacctatgatctcttcttgacaaaataccttgagtaatcatttaaaatataatagagaatgtcaatcttctattaaaaaccctcaagtaggctgggcgcggtggctcacacctgtaatcccagcactttgggaggccgagacgggtggatcacctgaggttggtagttcgagaccagcctgacaaacatggagaaaccccatttctactaaaaatacaaaattagccaggcgtggtggtgcatgcctgtaatcccagctactcgggaggctgaggcaggagaattgcttgtacctgggaggcggaagttgtggtgggccaagatcacaccattgtactgcagcctgggcaacaagagcaaaaatctatctcaaaataaataaattaaattaaattaaattaaattaaaattaaaaaccctcaagtgacctcccatgtcactcagaaaaaaagccacactgagtggacttttaagttcttcatgatctgattcaaggtaacttttctaactttttatccttctgattcaatttgactaacttttatcacaccaggtttttcctacattagagacttctctaacagttccttccgtcagataaataatctgaaatcttactctttggctatctcctctcctccaaagctttggttacttctcatctccatgaagctaagcctgagcttcctttttaatcatgccacctacaggcatccctgctttccttcatgttactctaattttccttgtatcccacagaacttaatactttctaaataccatattacttcttttttgctattatatgtattatttttggctgtctctttctgtggagttttcaactccatgaggacacaaattttcatcagcttggttcacaaatatattctaagtacctaggccagataggtcacaattaaatatttgttgaatgatttaaagaattttccacctgtacacttgagtgggtatgcatgtaaatagagaggtaatgtacagacccatacaaaacaattacatagttaggcatcatataagtactaagagtgaattattattgttaatgtgggagaagcttgtctaaataagtgactgtggtatcagaaaaggaagaatgagcattttactggcgtcatgctgattacagagagtatattttatatttattccaagagtggtagaacaaacttcaaaatctggttcaaatattttaaaaatcacattttcaaagtctcaaacgtatgattacaaaataatcagaccaattttatgtgcatgtgtataatttcatagcatcatttctttagagacacagtttgtagttaataaacagtgatcattctaggtaaggcattgcaatgaattaccagaattcttcagtataattcttcattaaaattctgatgatcatataaattgaatggtatattaccacaatctcagtcaaaaaatgctctaaattcttaatacgcattttctgctcactaccaccaaacatattattcatttaccactgccaaagattctatcagacttttctccagttagtattctttctgacgtgctagctacatatttgagaatttgatccatgtttcttttcctttttatgatttctatttgctcaaaatacttaaagagtctgggtagtttggaacctttctatattcctatattaactgttttgtcttaccttctttgaagaatatgacaaaaatagttggtaagtttcatttttggaatatgaaaaccgaaaactacccttgccatgtaaagaaattgaggaggctgtttcctcacaacattgttcagctttatttgtttcagtgggtgtaaattttagagatatagctgcattaaaatttgatgtcttctcttggatgatacttttaaatgcttcaatttgttcttcgtaatgttcggttctgaaatttttctcgcctttggtctaaaagagaataaaaaagtgttgttaaaaacaagatacgaaacaaaaggaaaaacaagcagaacagaaccaaagagaagtcaaacaattctttgaaaggcagtagaacaaaggagttaagagcaaaagtgatggagtcagattcctggggttcaaatacagactctgtcactttgaagtgattatgcaataatctctatgtgcttagtatgattcttagtctataaaacagggatattcatcatacctagcacaaaggttcttataaaaattcagtgagataatgcatacgaaggacttatagtatagcaaacttttttttcaacttactttaagttctggggtacatgtgcaggatgtgcaggtttgctacataggtaaacatgtgctatggtggtttgctgcacagatcaacccatcacccaggtattaagcccaacatccattagctattcctcctgatgctctgtcacccctacccccaacaggccccagtgagtgttttttccctaacgtgtccatgtgttctgatcattcagctcccacttacaagtgagaacatgaggtgtttggttttctgttcctatgttaatgtgctgatgataatggcttccagctccatccaagtccctgcaaaggacgtgatcttgttcctttttatggctgcatagtattccatggtgtatatgtaccacattttctttatccactctatcattgatgggcgtttgggttgattccaagtctttgctattgtggatagtgctgcaatgaacatatgcatgcatgtatctttataatagaatgatttctattcttttggatatatactcagtattgggattgctggatcaaatggtatttctgcttctagatctttgaagaattggcacactgtcttccacaatagttgaaccaatttacacacccaccaacactgtaaaagcgttccttttcctctataaccttgccaacatctgttgtttttgactttttaataattgtcattctgactggtttgagatggtatctcattgtggttttgatttgcatttctctaatgatcagtgatgttaagctttttttcatatgtttgttggccacatgaatgtcttcttttgagaagtgtctgttcatatcctttgcccactttttaatggggtcgtttgtttttttcctgtaaatttgtttaagttcctcatagactctggatattggatctttgtcagatggatagattgcaaaaattttcacctattatataggttgcctgttcactctgatgttagtttcttttgccgtgcagaagctctttagtttaactggatcccgtttgtcaatttttgtttttgttgcaattgctttggcattttatgaaatctttgcccatgcctgtgtcctgaatggtattgcccagattttcttctaggatttctatagcttttggttttacatataagtctttagtccatcttgagttaatttttgtataacatgtaacgaaggggtccagtttcaattgtctgcatatggctagccagttctcccagcactatttattaaatagggaatccttttcccattgcttgttttggtcagagttgttgaagattagatggttgtaggtgtgcagtcttatttctgagttctctattgtgttccattggtctatgtgtctgtttttgcaccagtaccatgctattttgattaccgtagccttgtactatagttcgaagtcaggcagtgtgacacctccagctctgttctttttgcttagaattatcttggctatataggctcttttttgtttccacatgaattttaaaatggtttttttttttctaattccatgaacaatgtcagtggtagtttaatggtaatagcattgaatctataaattactttgggcagtatggccattttcacaatattgattcttcctgtctgtgagcatgaaatgtttttccatttgcttatgtcctctctgatttccttgagcagtagtttgtagttcttgaagaggtccttcacttgctttgttagctgtattcctaggtattttatgggttttttttttagcaatcgtgaatgggagttaatttatgatttggttctctgcttgcctgttgttggtatataggaatggtagcaatttttgcccattaattttgcatcctgagactttgctgaagtagcttataagcttaagaagcctctgggctgagacaacggggttttctaaatataggatcatgtcatctggtcatctgcaaacaaagataatttgactttctctcttcgtatttgaataccctttatttctttcccctgcctgattgcactggccagaatttccaatactatgttgaataggagtcatcagagagagcatccttgtcttgtgctggttttcaaggagaatgcttccaacttttgcccattcagggtgatattggctgtgggtttttcatatatagctcttactattttgaggtatattccttcaacactaaaatttcaattagaacttttttttttttttgccaacttggctattgtcaggttgttgtcagtgagagacttgttatataagtggttcagttcccttttcagaaatcttctgaattaggtataactcttgtctgggaaggggacacctgtatcttcagacagtgtcatggactggatttagtattgagtggttgttctgcatgagaaacctaaagttattactgtctcatgaaaagactgaaatgtatatagttatctttaaaacaagacatgttgaagaaactgcctagcataacagggaaaagcaaactaaccattgccacttccctacttagatctttctaatgtatttctaatgactttaatatagtctaaactagatttatttctagtcaatctctccctaactgtgtgtcagccatccagctgttccacaacccatgctgttcttaccataagtcccttttatgctgctttttctttctagaatgttctcttactctttccccccaaccctcccatagcacagacatcacacacactccctttcacacatacacacaaaacataggcctcaggttgattaattcccactcctatttcaagtcttacctgaaacatcacttctttaggaaagcccctcctgatataacagactaacaaatatttttgctacaagcttttctggctcctcttttaaaacaaaataaaatgaaaaccacttcttttataattacttattaaataaaacttcagcctttgactctagttacatcccagcaccctatagatatagggtccaggcttaaccagtgccaggccagcctccatggcctcaggcccgaggccagtttcacagacaaagtttccagcctcaactcaggctttagacaggcccagaatgaggctggtctctgtagccctagactcaggattttacttgcagactaagactccagctataacccaatgccaggtcagcacccgtacacctcagcttcaggccagcttccatgacctcaagcaccaggccagcacctgggactcagtctcaaaggctggtcactacagactcaggctccagtttcacccagtgccagaatggccactgcaaatcccaaaatcaggcgcgagaccagggatccagcctctagggccatcccagtgcaaagccagccctattggccccaggctccaggccagccttcatgagttcagcctccaggatggtccttacagcctcaagatccagtggacccactggacccaggatccaggcccacttctgtagactccagtgctaggttgacctctatggatacaggcaccaggctcattccagcagacccaagctccaggccttccccagtgaaccaaggaaccaatcacgtctacccaaggactccagcatcaagcctgcttgtggaccatgccagatgacttgcccagaatctctggacacactgattaatgaagggttatccctgctgcagttagtctttaaggaatggaataagtgcttacttcttcaaaggcatagatatgcatggtcacaaagatcacacataatcagggaaacatggcatcaccaaaggaacaaaataaagcactggtaactgaccctaaagaagtggaaatttacaaactgcctgataatgaattcaaaataatcagcttaaagaagctcagtgagctacatgagaatacagacagaagactagatgaaatcaggaaaaaaatacatgaacaaaattagaagttcaatagagagaaagaaagcataaaaaaacacaaacaaccaaatttagggagttaaagaacataattagggagttaaagaacagagctgaaaaatttcatagtgagattcaatagcagattctatcacacagaagaaagaatcatgagctcaaagacagttcatttgaaattaccaatcagaaaaacaaaaaataaaaaagaaatagtgaagaagtcctgtgggaactatggggcaccatcaagtgaaccagtatatgtattatggtgccccagaaggaagagagaaacacaaaagtgtagaaaacttatttaaagaaataatgacagcaagtttccccaatgtggagaaaaaaaaggagcacccaggtccatgaatcccaaagaaccccaaatagactatatatgaagagatcttcacttagacatattataatcaaactcaaaagtcatacaataaggagaattttgaaaacaagagaagaacaactcgtcacatatgagggagctcacataagattactagcagatgtttcagcaaaagccttgaatccaggagagagtgagatgatatattcaagagtattgaaagaaaaataaactgccaatcaagaatagtatacttggcaattctgaccttcataaatgatgaaggaataaaaaatttcccagagacacaaaagctgtggaagttcattacctctagaccttcctataagaaatgctaaagggagttcttcaagttgaaagaaaagaatgataattcataacataaaaaatttatgaaattataaaattcactggtaaaattaagtacatagtcaaattcagaatactctcacaccatattgatgatgtacaaatcaagtatatctgtagtatgaaaattaaaagaccacactattagatataataatagctataatagttaaggaatacacaatataaaaagatgttaattgtgacatcaaaaacaaaatgtggggaggaaaagtgtagaagttttaaaaatgtgattgaatttatgttgctaacagtttaaaatagcctattataactatagatattttatgtaagctgcatggtaactcatgaaaaccacaaagcaaacacctataatagacacagaaaacataaaagcaaagaattaaagcatatcagtacagaaaattatctaatcacaaaggaagatagcaagagagaaagaaatagccagaaagaacatacaaaacaaccagaaaacaatgaaaaaaatggcagtggtaagtccttacctaccgataattatcttaaatgtactcaatcaagagatgcagagtagctaaatggattaaaaagcaggtcccaactattatatatgctgcctatgagactcacttcacctttaagtgccaaaatagagcagggatagctaaacataccagataaaattttgacttgttaaaaactgcaagaagggacaaagaaaatcactatataataatgaaggggtcaattttgtcagaggatatttaaatttctagacacccaacatcagagcacctaaatgtataaagtaaatgttaatagatctgaaaggagagacaaactgcaataaaatagtaggggacttcttaatactccacgttcaacaataggcaggtcatctggagagaaaattattaaggaaacattggaactgaactactctttagtccaaatggacctaacaaatatacacagaacattccatccaaagtaacataatacatgtttttatcaagcacacatggaacattctcgtggacagatcgtatattaggccataaaacaagtcttaaacattttaagaatattaaaataatattaaggatctcttttgatcacaatggtatgaagctagaaatcaataacaggagaaattttgggaaattcacaaatatggaaaaattaacatgttcctgaacaataaataagtcaatgaagagattaaaagtttaaaaatatcttaaaataaataaaaatgaaaacattccagaacttatggaatgcagcataagcagttctaacagaaaagtttacagtaataaatgcttacatcaaaaaagaatttctcaaataatctattgttacatcttaaggaactaaaaactgaagggcaaactaagcttactaaactaaagtcaattgaagtaagagaataataaagatcagagcagaaataaataaaataggtagtagaaaaacaacagaaaaggccaacaaaaccaagagtttgttttttaaaaaagaaacaaaatgaacaaacctttagctaggctaactcaggaagaaatgagaaaactcaaataaaatcagaaatgaaagaggagacattactgttggctcttcatatctgcaggttttgcatccgtggattcaaccatcattggatcacaaatgtagttgggcctgcaatggttgcatttgtactgaacatgtacaaactatttcccttgtcattatcttctaaacattacagtataacaactatataaatagcacttacatcacttaggtattctaagtaatctagagatgatttaaattatactggaggctgagcatagggtatatgcaaataccacaccatgttatatgagcatctaaggatttagctatttgtgagtggtcctgggaccaattcctcatagatactgagggacagctgtacaactgataccacagaaatataaataaacataagatattactgtgaaaaattatgcacaaagaaattgaataacctggaagagatggatacattcctagaaacatacaatctatcaagactgaattatgaagaaatagaaaatgcagaccaataatgattaaaaagattgaatcagtactacaaaaagtctcccatgaaagaaaagcccagaatctgaaggcatcagtgatgaagtctaccagatatttaaagaagaactaatcctagactttcttaaaatattccaaagaattgaagaagagggaatatttccaaattcattttataagaccagcattaccctgatatcaaagccagacaagaacactgcaagaaaagaaaattacaagccaatatccctgatgaacatatatgtatatatatcttcaataaaatataaacaaactaaattcagaaatatattaaaatgatcatacacaatgatcaagtgagatttatatctaggatgcaaagatagtttaacatatgcaaatcaataattgtgatacaccacattaatggaatgaaggataaaaattatatgatcatctcaatagatgtagaaaaagcagtcaataaaattcaacgtcatttaaagattagaaaaactctcaacaaattaggtatagaaggaatgtatctcgacataataaaggccatatacaacaagcccacattgaccattatactcagtggttaaaactgaaactttttatcagacgtcaggaacaagacaaggatgcccattgtatctctgttcaaaatagtactagaagtcttagagcaattatgcaaaagaaagagataaaaggcatttaactcagaaaggaagaagtaaaattgtctgcagatgatattcttttatgtaaaaaaccctaaagacaccacccaaaaaacaaaacaagacaaaaaatgttagaactaacaaattcagtaaagttgcaggatacaaaatcaacatgcaaaagtctgttgcatttctactcactagctacaaaccatctaaaaaagaaacttttaaaaataccatttactacagaattaaaaagaataaaacacttaggaataaatttaaccaaggaggtgaaagagctgtatgatgaaattcataaaacattgatgaaagaaatggaaaatatacaaatcaatggaaagatatccaatattcatggattggaagaattaatattgttaaaatagcaacactgcccaatatgatctgcagactcaatgcaatccctatcataattttatgtcattttccacagaaataaaaagaacaatcctaaattttgtatggaaccacagaaaatctcgaatggccaaagcaatcttgagaaaaaagaacaatactggtggcaccatgctttctgatagagggggtgtaatttgtaggcacctgcacttgtatgtgaaatgactagaaaggaaatggcataaggcaattatcaactcagcagcgtagagggccactttcagatataacagattgttggtcagggtatcaattaggatgttgttgaatggctcaagaaaaggtagcttttctcactatgccagaatggtagtggcgagtacagcctgaaactctgaggatggagtcatcccagaaagcataggaatgaaagctgaattgggaaatggaaaaatccatccatgcgaaaagaagtctaggctcaatgttaagcattcagaaatagaccaatacttgtaaccatcatagagagaaaagcaaaagtcttggacgagagaccaaggggcaagattacagaaagcagaaaaacacaaagatggaagcaagtttctttatgagtactgaataaacagatgttggagaagctagattcagagagagaagatcaaggggcttgcatgttctaggaggccagacatattataagggtcagttgaagttatcctgtttaagaatttgttcatataatactccttgaaaagaaataaacattgcttatggcactaaaaatggaagagatagacacgatcaagaaatatttcagagttcaagttgtggaggtttggagagcagttgtaaatagagagtaagtagagaaaactgttgaagatgtcattaaaattttatttgtacaaatggataataaaaccataaaccacatattagttattattatcaaagccatctctcactaattgagagaagaaacctatgaacaacagattcattgtaaccttttgaggcacccctctgccagaaccatctagccaagctactgtcacattcttaaccctttagccattaagttttggggtaatatgacagtaaaggataacaagtacaatccatctctattatctatagaatattttttctgtgcctaaatcttaaacgtttgtgtgctctaggacttcagtctctatgttcttctcttctccctcattgtacacttctttggtaatctcaggcaccctcaagaatgcaatgatcgccaggcgcggttgctcacgcctgtaatcctagcactttgggaggccgaggcaggcggatcatgatgtcaggagttagagaccagcctgaccaacatggtgaaatcccatctctactaaaatacaaaaattagctgagcacggtggcgcacgcctcaaatcccagctactcaggaggctgaggcaggagaatcgtttaaaccctggaggcagtgattgcagtgagctgagattgcgccactgcactccagcctgggcaacagagcgagactccatctcaaaaaaaaaaaaaaaaaaagatgcaatgatcatgtgtatgttaattaacacctagatctctttttacaatttagatcattctctccattttgattcaaataatctccttgttgtaggataactccatctaatttcatatagaccctcaaactcaaaattaccagcattcgaatcattatcttcttagaacccactccttctttggtagatttcctgcacatccaacttcccacatctcttttgatggcctataattcactggttgtttgtgtggggttttttttctttccatttttatagggtccatctatagaaaatttagtttgtgataggcactattctaatcacttcacagttattaacacatttaatctttctgaaaccctgtgaagtgtatactattatcatatgattttatcatggaaattgagatccaggaaatgtaactaagttgcctaaattcacataggtggtaagtggaggaagttaccaaaatttaaacccagagaatcttaattcagaaccttgtgattgatcatatgctatactgtctccaatttattaataatttcttaattcttaaatatgctggattttatctcttcttcttcatctctactattacagacccagattagccttttgtcatctgcttcttggaccataaaatagcctccttctgttctcattacctctggtcttgttcccttaaaatttatttccacaaaacacaaagttctaaaatgaaactctcagggttttgctctccggagtggctccctcattatgctcaggactatgctcagtgtatttattatggcacatgagtgccttcatgatttaacccctgcctatgacttcaaccctgaatgcatgagtttatttgtagaacagagtccctttcaagatagcagtttctatagggaaagactacatattttccacttgagaaacatcaacataggacaaataaccaggtatgtaataagctttatctgctgctagattttctaaatgggcttaagttgtcagtagaaagaatagttggaatgtgtattaagcctctgcttgcaattttgctgtcaactttaatggcaattccaattaaatatttgttttttgccatcattagaaatattaacttacagtgttaatatgctggcatgaattttttattcattcaataggcatttatctagcatagtatacaatatagtttttcagtattctgtggtaaataaaagggtgagatagcaaccaaaaagcacgtattatacagcaaaatatataccaaatagagaaaaaatcaaagcatattgcatttatttgtaggagaagcattttagaagatggaggattcagaggagaaagctgagggtggagtggcaatcaaaaatcagatcagggatcactttgtactccttgccaaggagattgactactacactgcaggctatagatagacactcaccaaatttaagcttcaaggagaatgatcagatttattatttttacactgaaatgtggggaatgaattgaagttgagaaaagctagaggctgtaaactaagaacactattttgagtcattcctacatgagaagtgatgggagcttaaggcagtggcagtgggaatggggaataagaaacagatttaaaggagattataataatagaacttgaagattgattggatattgtgggttttgagggaaatgagtctgtaaagaatgtcttaaggagggatttcaggttttgagtttgatgactaggttgatattatttccacttaccaagacagagaattcaagagcaagaagcaggaaattgggagtaagattggttatcagctgtaggtatgttgactctgtgacaatggcagacaactggatatacaagcatctagttcagagagagatgtgggctggaaatataggatttgcatgcaatcagaatagagtgaaaactgaagccataggagaagaggaaaaggaaatcacttaagaagaatatatagagagaaatcagtgaagcaatgtaggaactctggaaagagttcaatactatttaaggattctccaaaagggagctcaaaataagcttgagatagacttgaagagggttgaaaaatgcatagacacaagataacagagagtggggaataaatgcaatgcacatatgttgagatagcaagtgtagacaacatgggtatatagagatggcagaggtttcttcatttgtttctttatagatgagacccttgaaaaagatttatatatgaaggccagagtggaaggaaaaagagggaaaggttgagtggaggcttagcagaatgtctagcaatgtacttggagtgggatccaggctagggaagagaaagaataacttcctactgagagaataggatgtaaagagggactgagtagcaaagtaagtacacagaataactttgaagaaacaactgtgaaagctcctgcctatgacttgggtattctctgtcaagttggagctaatgtcatctgctgaacccaggatcaaaatggtgagtaagagtaagaggcttgagggtgttgctgaaagattgagcctgctcatgtgaagaacgagaatgaggaaagcctgagaaggtgttacagacctactgaacaatgtggaggactcagttgaaattataatgctagctgtttttgtgtgagcataatattctctttagtgttcagcagtgtaagtttacaagtagggcagaaaacaataaggttcatgccaaatcagagtttttctggattgtaggaggaatggaaacaaggacattgctaatattggcaaatgtagtcaaaatggatctagcttggatgaacaaaataatttaaagtaggaagagcaagatataccaggagaaaaaaagattccaaaaagactgaaggtctagatgaggccaagaagaggtttgtgggcataaatgagggtgagagctgagaggttagacaactgtgataagatgagagggttaaaagttggattttcaaatttcagagacagcaaagttctggtaaagacaaagccaagggttaggtggctagaaatgagagtggctgtagtgaaatggtataggaagttatgaggcaacaagaaatacttggcagtccacatgatattgaagtcacccaggattttggcaggattggggcgaaaactatgcttataatctgtgtgcattttgcaaatttttgttcatctcccaaatcttacattttcatggagactcagatttaagaagaattataatgaacacctgaaacctgatttaggcttacaaattgttattcaacaacaaaagtgaagaaacaaccaaagaaaagtaagtagaaaaggacctaagttataaacgcaatcatcactcccccctcccctttttacttctacagttgttcttggtcattactgctaatttataaagtggtcagtaagtcttgacctgctgtgtgaccactaattatgtacctagctttggctaagtctttaactaattatactctaaaatgaataatagctaatatttactgagggcttgctatatgccagtgactttctgagtgtttcacatatttagacccatttatctccatgaggtaggcattattatttctattttatagataaagaaactgaggcacaatgatgataagtaatttgcctgagattttacagcactaaggggcagaggtgggatttcaacctaagcagagtggctctagaaccacagcccattagagacaaaagaccctaaatgagagagtatgaatggatgagaataagatgtcattatttaggtgcattcccatgttatgatggaccagtataattctgtcaaaaatgaaagccaataaattattgccaataagtaactaaggcaagagttaaaaaattatttcatccaacaaaaactggtgaggattatatggagttggtattggtaataagctataaagaagtataatatgtataatttgccttcaggtactactgatacacatgagaaagtaaatgacatatttcattaagtagtaggaattaaagaaaaaaatcatctctaaggagttaaagtagatatttcccctcatgtaagtttgtgttcttttatgtataataataatgagtttggctacttattttccaagaccataacagatttgaataaggggattatcagcagtgggagcagcaacggagtgatgtggaggccttagccaacccctattcaactcccactgccccagttggcatcaaataaatattcaagtccacaattcctatcttctttctaataagcttgacatcaaactcttttgggggtattaatctcacctgaactagtaaaaggtatctatagtcttcatttttcccaccatatatgaacatagattagttttgctacagaaatattgatgtgttagattatgtgatgctgctccaaactccattgtgatttatatcacaccacatcacctttctaaaataccaaacattctgaaatgctgaaacacatgtgtttccagggttatggataagggaaagcagtgcttcctttccaaacgtggcttcaagatcagtcctgggcagcccctagccgtcactattctatgtcgtacaagttattacccctctggagaagctaagagctgatcacagtggtgaagacaggaaaaccgtaaaatgcagactaaactccaaacaaactaaatcaacacaacaatagcccttctcccatcagcaatgaccaaggtgaccatgtttggtattttctatttaagaaaggagaatgtatgtaatactttttaaaaataattgtcatctttccatcacaaaaatctgtgcttaaagaagtttaacctggcattattggggaaaaccaacagcccaaaagatttcctcagattttttggcaactgacatattctgacttataggtataagaaacatgactacatgtgaaaaaaaacatgccagtcaaatggtcaagatatgacagtctttagcattcatgagaaaacatgattgcttctggctgcaatatgtagagactgatttatgatattttcagaaagtaatgcttatttaaaagcatacacatttttcaaactggtgggactgataacaataagagccctgtaataactgaataaggcagaccttgtggctcttctttaccaatgggaccactttaagaaacagactcttgtagctcctgggtcagagcaagcttattattattcttcattatattttgcttggaacaaagaaagaatttctaaaggtgataaatattaatccttttaatggtggagggctacagtctgtcattgttctagagaattaggtgactttaagaaagatagctaagtttggaatagtgttgtgtagagtaaaaatcatttttataaatcattttcaagaggtagaggagtttaaggtgagtgaaaatagccactcacattagtcaagcaggctcttcataggcggatgctgaaggaaaaccaacgcaaagatgagttttcatcaggaggctagcaaacaataacagcaaaactcaagtagcacgtaagcagtgttatcactacttaaatcagcactgatttaatttttagttatgttagatcctgagataattctttttatggagtctaggtatttgccacatctttatcactaggtgcatgttactgaggattgagaagacacaattgtatgtttctaaagagatccaaactacatcgcctcttctttaagtcttgtgttcatgtgaaattattattctactgagtttttcacattgtttggtactaaacttatttaagcaatttttcagccaaaagttgaacaatgtgttttcctccgaggagacttacttcatagatcaaagaagccacgttccaaggtcttcggtagtatgtcagagtgtttccatcccgatcccggttacagagtccattgtagaactcattgtcaaaaggtgtgcttaggggatccatccctaaaatgttgatcctgagaatgaacagagtagtatcagaagtggaaataccacaacacaatgcaaggcagccctctgtagctggaaaaagtgagacagcttcagttcatgtcaccgtcacccaatatgtgtgtgctataatcaggaacagaagcaagagcctgttcaccttggctcagtgtctctggcagaaagcataccttaggagaggcttatgaactcttttaggcaactaaggcactgtttagagtgcaatgaaagaaatgcaataagtaaggcacatgggaccatctggttcctggagttttaacttcactgctgtaactcttacctaacctcccttagtgaaccaataactgatgctgtaataccaactatttaaattatttgagaacagagcatctcagggggccaatataacatgtgcatgtaatttttcatctatgaatcaacattggggctttctctcactcaccccattctctttaaacttaagccttttcctccagctgtctcattgcttgtcaagaacctcattccctccaggcttatattattcccgttatgctctccaagatgaacacaaaaattttagcatcctggcaaggcattctcaaaagttctattttttcccatagcaaaatatttttatttggcaagctttcattcataaatataaattttatttagcttttaaaaaagtttaattttacttgtaggcttagaaacaatatatgaactagaagcagttatttccttgtgaaatatacctctgttcattggaggaacacagtcattgctgtctaggctgtatctggaataaacggccccaagccagggaggccaataggtttgaggatcaaatctataacttaccttggtacaaaaacaaaaacacaaactcttccattgccctaggccacattcctaactccaatgaactggattacaaatctggatgttggttttaagaccaatttgtcaaagagtgggtagtttactgtaaacccatggcttatgcaagagaaataattgaaagggtttcctactggtagtgggttagttaaaaacaacatctttatataaatagcacattttacataaactttgaatctacgaagttccaaagtgaatctaaaatggttcaactttaatggaaggcaagttaagaaactgatgcatgaatatcttcctcaaggctgacatatagataaaattgaccacctcccactgcctgtcccaccaaaatacctttcatgaaaaatgctatggccttaaagttctaatatagggtcaaaaattagacctattaatttgaatatgagaaaaaataaaaaaacattatatatttgatttatttttttaaacaccttattcctcatgataaattaaaattttgtcccaatcctttacccatctctgcatgtacacccttgccatgacctcatcaccggcaaagtatacttccctccctagtggctttgtgcttggccatgtgacttactttaagccaatggcatgtagttgagagtgacagtgggccagttcaaagcatgggaatgaagaggcctcattcattgcttttgctttcctgtatttgtgccattgccttgaaaagggcttctaatgggtagctgctgccccttcaacctggctatcccagtgatcccagtgaaaagcagaaccacccagctgttgcagcttgaggtgaagctcccagtgaagcccagccttgtgagaaataaacacttatatctccctctccctctccctctccctctccgtctccctctccgtctccctctcccctttccatggtctcccctctccctctctttccacggtctccctctcatgccgagcggcagctggactgtactgccgccatcttggctcactgcagcctccctgcctgattctcctgcctcagcctgccgagtgcctgcgattgcaggcgcgcaccgccacgcctgactggttttcgtatttttttggtggagacggggtttcgctgtgttggccgggctggtctccagctcctaaccgcgagtgatccgccagccttggcctcctgagttgccgggattgcagacagagtctcgttaactcagtgctcaatggtgcccaggctggagtgcagtggcgtgatctcggctcgctgcagcctccacctcccagccgcctgccttggccccccaaagtgccgagattgcagcctctgcccggccgccaccccgtctgggaagtgaggagcgtctctgcctggccgcccatcgtctgagatgtgaggagcccctctgcctggctgcccagtctggaaagtgaggagcctctctgcccggccgccatcccacctaggaagtgaggagcgcctcttcccggccgccatcccatctaggaagtgaggagcgtctctgcccggcggcccatcatctgagatgtggggagcgcctcagccctgccgccccgtctgggatgtgagaagcgcctctgcccggccgcaaccccgtctgggaggagaggagcgtctctgcccggccgccccatctgagaagtgaggagaccctctgcctggcaaccgccccgtctgagaagtgaggagcccctccgcccggcagccgccccgtctgagaagtgaggagcccctccgcctggctgacaccccatctgggaagtgaggagcgtctctgccaggcagccaccccgtccgggagggaggtgggggtcagcccccgccaggccagccgccccgtccgggagggaggtgggggggtcagccccccgcccggccagctgccccgtctgggaggtgaggggcgcctctgcctggccacccctactgggaagtgaggagcccctctgcccggccagccgcccagtccgggagggaggtggggcggtcagccccccgcctggccagccaccccgtccgggaggtgaggggcgcctctgcccggccgcccctactgggaagtgaggagcccctctgcccggccgccaccccatctgggaggtgtgcccagcagctcattgagaacgggccatgatggcaatggcagttttgtggaatagaaaaaggggaaaggtggggaaaagattgagaaatcagatggttgctctgtctgtgtagaaagaagtagacatgggagacttttcattttgttctgtactaagaaaaattcttctgccttgggaaaaaaaaaaaaagaaataaacacttatttttgtatcactaaggttttgacacaagctctccaccagtaagacataaaatactggaagcaaatgacctgggttgtttcttaaacaagatctcagctacattttctttatatgatagtgaactacatatctggtgtggctactttaacagagacattgtacctctttattttcagtgaacaatgaaatcaacttttgtttatattgatgattagctcttaggtgactactatatctatgtgttgtacagtgtttgcaattagcaggggggaatattaagacagtttatattcactctctgcttccatgcaaattgtgttcaaattaaggagtagaacataaaatcaccaatttcaaaaactaggccaaggaagaatacacaatcagccctccatatctgtgggctctgtgcctgtggattcaaccaatcatggattaaaaacatttggaaaaaaatgtacatgataagcacgtacaaactttttttctcttgtagtatagcaacaatttatatggcatttacactgtatcaggtgttataaataacccagagatgatttaaagagtacaggaggatgtacataggtatgtgcgaatactatgtcattttatatcagggacttgagcatcctgaaagttttgtacatgtgggaggtcctggaaccgatccctgatgggtagaaagggaggattgtacttgtgccaaatgaggggtacatgtgagtgctttacacattgagtcttctggaggaggaaatcaccatgggagggtcattaaaagagttttagaagaaagatttgatatgggttttgaggggtgggtaaattgggatggggctagtgcaggagaaatgtgtgggtaagagctcagagacggaaatggcatgttatgagggtaatggtcttcagatactctgtttgtctccgctataaaggaattttgataaattatactttcctgcacatttttagcgtgacatctaatatttttcatcttaagattaagtagatgcaaagaatataattcctaataatgttgtcattatttgtactttaacatataattattttaccactttaaagataaaatcaataaatataaatgctgtagtgatgctgggtcacacagcattgatatttttctaacagttggaaattttttagttatttttattcctttttatttatttttttaataggctttactttttagagcagctttaggttcacagcaaaagtgaacagaaggcacacagacttcctatatactctatgcccctttttattcttgaatccacatttctattccatttccctcacagaattttaacctaatgtaatatagtttattttttaaagtttttattgattgtcttgtcatacttttctgtaccaaaaagatattaattgaaatttaaaaatattaaatactctttgaccatagggtctaagtattaaaaattctttattaatagtgccatatataggtatcttaaatttttaaaaatcattactgtaagtaaaattttattggaaagctatcttaatgaaatgaatgagtcttctttttaaattaatatgttggttcccacatccatgaatgaatattacttcattcattcattcatggtgctaggaagagacagtgttcagtatcaatttgagtcctacttttcatttttatagttgtaagtgctgagaagttttactcacataaataagtagataagaataaaagaaattttattataacaatgtcacacaattttaatccctttttctgagttatataccaaaaagagatcccatagttagtgatctttcatcaaaaattatttttatgctccattatctaaaagttgattaggtaatctttcagtgttgataaaaagaattagagatcacaaaacttcaaggtgtcagagtccagttgagtgctaacatttggagttgtgtcttgttttttttttcctctctatagtaaaatgtgagtgtgagatgggtgaggagtatactctgctcttaaaaagtaagaagtaagtgattgtttaaaaaagcaagaaaggagaatgggcctgacagcttgaatgcagctgaattgtcatgcttattaattttgtgaaaaacatgtacgtatggaagttgaggatttactattagcttagctacataattaatagttgaggaaactattaccttaagacttatttgtctgcccttggaaagtttttgtgcaccccatggtttgcatatcctagtttgaaggttattgttttatagatcatcaaattggccagttggctggacccatctggaaagttaaaatgaagttgatccacagtctaaagcacaacaaaggaagaaatgtttcaaaagctttggacttggttccactactacagagacagccagtctagtccagaataagccaattttttctgccaagaaacatgaacacttctcatggatggaaagtcatcacctgggaaataaaaaaagaatatgttctttggcagtgcttatagatgcctgctttcacacctgcatctagaaccacgggcagttccaatttaccaggtgaactgaagagaaagctcccttcacagaagtggtgttatgcttagatcacaaaaaataattccttgcatatcacttacagctggctggatgtatgccttttcaatgaatgcaagatgggttgggggatttccccaaacacttctggagaatctcagatgcctacaaataagaggctgaaacatttgtgatacaactcaattctcctggcataagaacatagatgtgagaggccttcaaatgaaaacagtataaattaattaccatgagtgcttgtgactttcacatgtagaagaatctaactgtatgtgactattgataggactttttgaggttgtccagaatgaattgggtagatgtagtttataagcatgttgctatgattagggagtgtactcctattacctctatttcacaaagaatccacagctccatataagaatactggaggtttgtagtgagtaaacatgcaacattaatggtatgaaagaatattacaaatataacaatatatgttgttttgaaacctcttcctaaatattaattactgatttataccactctcctatattccttaattcaaatatttgtgtgataagtagctacttaaggagtttcattttttaaggttagttttgctttgaagttaaggtgtcgaagttaagacttacggattttgtagtgatgtgagggaaccgctgtgggtgttggttggggttttaaggaggagagggtaaggtggtatggtagaaaaatatagttttatgagactcagagaaacttgtttcagctctactagaactaatcagtcaaatggccttatttatttcactcagttcttatctataaaatgaatataatacctcctctaacaatctcccagtattatttggaaaatctatggagatacagtgtggaaaaatattttgaaaagtttaaagtattatgcaaatgaaagtcgtcatagaacaataggtttcatgaagactaaatttaacataggttattactcatggtaatggggaatttaattaaaaaatgttgatggactgattctatcaagacctacttcattttccatttctgcagctgacctttccccatagctagggcaccaccttcttacacagccttgaagactcagctgtgggatggttcctaacaccaaccctgactgtggtaaagcgtgaggtatttaagaattcctagctagccctgcttcattatgaaactctctgacaaatgctatgcaacaaatttttcttttccctgaacaaaggaaaccaatagattatgaatgattgtttttcagctaaatgggccaatatttctatattcttttcctataagacaaactataaatttgcattgaatgagaataaataacatatgttaagctgttttatttagattaaaaagaaagttgtttcttggatcccaattaaagcaaaataaagtagtaatgggctttcaccatggactcacaatctttccctgaggaaataaataaaaagaatcaggaccatttgagcacaccatgatctagttataagatttgggaaaactcccatgccatttactgcctaaaatttactaagagggcctgcagaacttaggggcctaagaccatccatttgatttgagattcccacctttaggctaagggccaaaggcactgtaagtaattttgaatgctgcttgaacaagattttataaagtgcatgaagggcacgtgaaatgctttatctggtgcctgactcttggtatcctgggatatttttcttacctagatttaagaagtagaagtttcatttggcttagagagaggagacatctccttcattagctaaactttatagaggtcttatcataggaactgcctagtaactttgtgtagggtttctcaacctcggcactgacgctttgggtcaggctgtcctatgcttagcatcatctctggcctccacccactacatgccaatagcactccccattctcaccccctccaagatgtcacagctacaatggtctccagatactgtcttttctctcttttttttttttttttttttttttttgagatggagtcttgctctgtcgcccaggctggagtgcagtggcatgatctcggctcactgcaagctgtgcctcctgggttcacaccattctcctgcctcagcctcccaagtagctgggactacaggcacccaccaccatgccctgctgattttttgtatttttagtagagatgggttttcaccgtgttagccaggatggtctcgatctcctgacttcgtgatccgcccgcctcggcctcccaaattgctgagattacaggcgtgacccgccgcagatatcgtcaaatgtctgctgggggaaaaattaccactgattgagaaccactgccttacccttctaccagccttgctcttaccatcacccctgtcttttttcctctcctcatctccatacccgggactggagtcctatccgggaaaagaaattcagtcttacatgatgccaattgacaatattttagaaagtagttaaaggatattcattaattaataattagccaatgtatccacctaccaagtatttactgagcacctactatgacccaggcacaggaattatgagcataaagagacacattacattataggtgaggaaataaagccatataccatctctttcaatatactactgggtggaagaatgaccatgtctttgttggggacaattttccaacaaatccacctttaccaaaaatagcaacaaatccacctttaccaaaaacagctcagagtgagtaagagaggctgtgtagtagatattcctaggatgccctctgactatgtatggaacagaacagaatagaaccgaatctctctgcatatagtctctattctgtataatcctgagttctaaactccaagacatcccatctgagcttacagccatctgtccagagcccctaggttttgtatggaaaatgagtgaaatgtcagctctctataatgagaaccagaacctcaacataatcatcctctggcatcaaaactacttcctctgatcacattcctcctgggtcagctccagaatgctggaaactcccaagatccaggagaagttccaatggaagacagccttcccagcaatgcaaatatttgaattgaattgctagatctcgtattggaaattcattccaaatgttaacatatcatgtcaatgttgctgtggtctcccagaggttcctaaatgagagatttcatctcttgctccactgagagacaattatctaacatcttgatcatctagtccactctacagacccctactgagggcaggcaatttgtccaaattatcctgagatgcttatttagcacttcctttaagcttaaaggtagttcaaaaataatacagacccatcagctgtatcacctatgtccctcgcacaaatgcttctaccagtctatcacaatgagagagatggagatcattttcactcattttcatctgaaaaagtacaagtaaaatacacacccatagcctgctgttcgtgccagctcagactcttctaccactctgtctctgcaggggggacggggctcactttcacaatcatcctcatctgaaaagtctccgcagtcattgtcaccattacaccgaagtcgcatctttatgcatctgcctgcaatcaaaatcaggagagactcaatgtatctaatgtcaaattttctctttctttctgaagttatcaaatgcattttaaccctggaggtgaggtatcagaaaaacacatttgagttctttgtacagaatatatagatggcctcttttggggcctttcacgcttggaaatccaagtgtccagaagcatatgcttttttttttcttttcattcaggaaggcacacagaaagccacaatgagcaattcaagcacaaagattacctgtactgcattgaaagtcatttccgcagtcatcctcagcatcctcacagggctctgtgggcacacactgtcgtctgtctcccacagcgtcggtgcatcttttcccattaaattgtccaaagacctcaatgcttcttgaacgaaactgcacaatatcagttggaatgattagaatttctaatgccaaaaaaagggtatggtctaaaggtgcatccatacaactatatccctgcaatgagtcaatggttttaagatagaagtggtggaagaagtcactgatgttatttagggtaacactctgcattctaggtttggcagcctcttatacagatgattcctctggacactcatttagtattctgtacaacataaagatttcctggaaaagttagcaacatacatttaaatgtttatctctctttctgggtttggaactcagttgtggggctccctgcctcataatcatttttctggagaggctagcaatacagtttccatttggggaggtcagtggggaagggagatgaacacttaccatttgtctgagacaaggatcgcattgtgaccattcactccaggggctcattctgcagtctatgtgtgatgcagagccactgctttctgttagctctgggtcataactaagataacagaacatcccagtttataatgaccattgtgtatatctgtttccaagaagtcttcataaacacagttcattttgtactttatcccctctcaaattataccacttatctttttactatatctctcatttcaccctcaattgcatgctgttttgtattttcaactcatctttttgttaattcttgtctgtattgtaagttaacttttaacttcccaggaatgcaaatatttgaaacaacaaaacaacggcaatgaggaaaactagcaaagcatctttccaggtgttttacatagattaatcttatatttccaactagattatgaacataatgaagccagaaatctgattttatttttttgtgtgtcttccttcccatccaccataccccacccctcccaagaatctggtgaggctaagttacctcattctcttgcaaatttaagccagccagcccaggcccagccattcctgtagcgggcacctcataaatcaggtttcccctctctggtattctgtatgccctaaactggatgccttgccacttcacacttcacttcaggacttattcctgatctttctgagttttaacatcatatattttggcacttatgcctccctttccacccctaggcccactgctcagcaaggcttttctggctttgaactttcctttctccgttggttcaccatttgagtctcttctggttgaaatatcacccaggataattacaaaaaaaagaaaacacatcagaaccagaaaccacccaacaagaatcctacaaattccctacctctacttgcctgacctgacactgatccttcctatagttaggcctcttaaaccacagaaaaggctagctgaacaggaacagctcgtttacagctcccagcgtgagtgacggagaagtcaggtgatttctgcatttccaactgaggtaccgggttcatctcactggggctcatcagacagtgggggcaggacagtgggtgcagcccactgagtgtgtgctgaagcagggcaaggcatcgcctcacccgggaagtgcaaggggtcagggaattccctttcctaccaaagggaaggggtgacagacagcacctggaaaatcgggtcacttccaccccaatactgtgcttttccaacggtcttagcaaacagcacactaggagattatatcctgcacctggctcagagggtcccaggcccatggagacttgctcattgctagcatagcagtctgagatcaaactgcaagggcagcgaggctggggaggggcgcccgccattgctgaggcttgaatatgtaaacaaagcagccaggaagctcgaactgggtggagcccaccacagctcaaggaggcctgcctgcctctgtagagtccacctctgggggtagggcatagccaaataaaaggcagcagaaacctctgcagacttaaatgtccctgcctgacagctttgaagagagtagtggttctcccagcatggagtttgagatctgagaatggacagactgcctcctcaagtgggaccctgatccccaagtagcctaactgggaggcaccccccagtaggggcagactgacacctcacatggctgggtacccctctgatatgaagcttccagaggaacgatcaagcagcaacatttgctgttcagcaaaattcactgttctgcagcctccgccactgatacccagcaaacacggtctggagtggacctctggcaaactccaacacacctgcagctgaggatcatgactgctagaaggaaaactaacaaacagaaaggacatccacaccagaaccccatctgtacgtcaccatcatcaaagaccaaaggtagataaaaccacaaagatgggggaaaaacagagcagaaaagctgaaaattctaaaaatcagagcacctctccccctccaaaggaacacagctcctcaccagcaatggaacaaagctggatggagaatgactttgatgagatgagagaagaaggctacagacgatcagacttatctgagctaaaggaggaagttcgaacccaatgcaaagaagctaaaacattgaaaaaagattagacaaatggctaactagaataaccactgtagagaagtccttaaatgacctgatggagctgaaaaccatggcacgagaactacgtgatgaatgcacaagcttcagtagctgattcgatcaactggaagaaagggtatcagtgattgaagatcaaatgaatgaaatgaagtgagaagagaagtttagagacaaaaggataaaaagaaatgaacaaagcctccaagaaatatgggactatgtgaaaagatcaaatctatgtctgattggtgtacctgaaagtgacagggagaatggaaccaagttggaaaacactctgcaggatattatccaggagaacttccccaacctagcacagcaggccaacattcaagttcaggaaatacagagaatgccacaaagatactcctcgagaagagcaactccaagacacataattgtcagatttaccaaagctgaaatgaaggaaaaaatgttaagggcagtcagagagaaaggtcagcttacccataaagggaaacccatcagactaacagcagatctctcggcagaaactctacaagccagaagagagtgggggcaatattcaacattcttaaagaaaagaattttcaacccagaatttcatatccagccaaactaagcttcacaagtgaaggagaaatataatactttacagacaagcaaatgcagagagattttgtcaccaccagccctgccctacaggagctcctgaaggaagcaccaaacatgaaaagaaacaaccagtaccagccactgcaaaaacatggcaaattgtaaagatcatcaatgccaggaagaaactgcatcaactaatgagcaaaataaccagctatcatcataatgacaggatcaaattcacacataacaatattaaccttaaatgcaaaatgggctaaatgcgccaattaaaagacacagactggcaaattggataaagagtaaagacccatcagtgtgctgtattcaggagacccatcttatgtgcagagacacacataggctcaaagtaaagggatggaggaagatctaccaagcaaatgaaaaacaaaaaaaggcaggggttgtaatcgtagtctctgataaaacagactttaaaccaaaaaagatcaaaagagacaaagaaggccattacataacggtaaagggagcaattcaacaagaagagctaactatcctaaatacatatgcacccaatacaggagcacccagattcataaggcaagtccttagagatctacaaagagacttagactcccacacaataataatgggagattttaacaccccactgtcaacattagacagatcagtgagacagaaagttaacaaggatatccaggaatttaactcagctctgcaccaagtggacctaatagacatctacagaactttccaccccaaatcaacagaatatacattctcagcaccacatcgcacttatctcaaatttgacgacacagttggaagtaaagcactcctcagaaaatgtaaaagaacagaaattataacaaactgtctctcagaccacagtgcaatccaactagaactcaggaataagaagctcattcaaaaccactcaactacatggaaactgaacaacctgcttctgaatgactactgggtacataacgaaatgaagccagaaataaagatgttctttgaaaccaatgagaacaaagacacaacataccagaatgtctgggacacattcaaaggagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggacatagagacacaaaaaacccttcaaaaaattaatgaatccaggagctggttttctgaaaagatcaacaaaattgatagaccactagcaagactaataaagaagaaaagagagaagaatcaaatagatgcaacaaaaaatgacaaaggggatatcaccactgatcccacagaaatacaaactaccatcagagaatactataaataccactacacaaataaactagaaaatctagaagaaatggataaattcttggacacatacactctcccaagactaaaccaggaagaagttgaatccctgaatagaccaataacaggctctgaaattgagacaataattaatagcctaccaaccaaaaaaagtccaggaccagatggattcacagctgaattctaccagaggtacaaggaggagctgctaccactctttctgaaactattccaatcaatagaaaaagagggaatcctccctaactcattttatgaggccagcatcatcctgataccaaagtctggcaaagacacaacaaaaaaagagaattttagaccaatatctctgatgaacattgatgcaaaaatcctcaataaaatactggcaaaccgaatccagcaacacatcaaaaagcttatccaccatgatcaagtgggcttcatccctgggatgcaaggctggttcaacatatgcaaatcaataaacgtaatccagcatataaacagaaacaaagacaaaaaccacatgattatctcaatagatgcagaaaaggcctttgacaaaattcaacagcccttcatgctaaaaactctctataaattaggtattgatgggacgtatctaaaaataataagagctatttatgacaaacccacagccaatatcatactgaatgggcaaaaactggaagcattccctttgaaaactggcaaaagacagggatgccctctctcaccacccctattcaacatagtgttggaagttctggccagggcaataaggcaggagaaagaaataaagggtattcaattaggaaaagaggaagtcaaattgtccctgtttgcagatgacacgactgtatattgagaaaactcccttgtctcagccccaaatctccttaagctgataagcaacttcagcaaagtctcaggatacaaaatcaatgtgcaaaaatcccaagcattcttacacaccaataacagacaaacagagagccaaatcatgagtgaactcccattcacaattgcttcaaagagaataaaatacccaggaatccaacttacaaaggatgtggaggacctcttcaaagagaactacaaaccactgctcagcaaaataagaggatgcaaacaaatggaagaacattccatgctcatggataggaagaatcaatatcgtgaaaatggccgtactgcccaaggtaatttatagattcaatgccatccctatcaagctaccaatgactttcttcatagaattggaaaaactactttaaagttcatatggaaccacaaaagagccctcattaccaagataatcctaagccaaaagaacaaagctggagacatcatgctacctgacttcaaactgtactacaaggctacagtaaccaaaacagcatggtactggtaccaaaacagagatatagaccaatggaacagaatggagccctcagaaataataccacacatctacaactatctgatctttgacaaacctgagaaaaacaagaaatggggaaaggattccctatttaataaatggtgctgggaaaactggctagccttatgtagaaagctgaaactggatcccttccttatatcttatacaaaaattaattcaagatggattaaaggcttacatgttagacctaaaaccataaaaaccttagaagaaaacccaggcaataccattcaggacataggcatgggcaaggacttcatgtctaaaacaccaaaagcaatggcaacaaaagccaaaattgacaaatgggatctaattaaactaaagagcatctgcacagcaaaagaaactaccatcagagcgaacaggcaacctacagaatgggagaaaatttttgcaatctactcatctgacaaagggctaatatccagaatctacaaagaactcaaataaatttacaagaaaaaagcaaacaaccccatcaaaaagtgggcaaaggatatgaacagacacttctcaaaagaagacatttatgcaaccaacagacacatgaaaaaatgctcatcatcactagccatcagagaaacgcaaatcaaaaccacaacgagataccatctcacaccagttagaatggcaatcattaaaaagtcaggaaacaactggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataagtcatgctgctataaaggcacatgcacacgtatgtttattgtggcactattcacaatagcaaagacttcgaaccaacccaaatgtccatcaatgatagactggattaagaatatatggcacatatacaccatagaatactatgcagccataaaaaaggatgagttcatgtcctttgtagggacatggataaagctggaaaccatcattctcagcaaactattgcaaggacgaaaaaccaaacattgcatgttctcactcataggtagggattgagcaatgagaacacttggacacagggtggggaacatcacacactggggcatgttgtggggtgggggggaggggggaaggaacgcattaggagatatacccaatgtaaatgacgagttaatgggtgcaacacaccaacatgacacatgtatacatatgtaaccaacgtgcacgttgtgcacatatgccctagaacttaaagtataataaacaaaaaaggaaaaaaaaaaaacacagaaaagactaggtgatgccaatctctcctcaaattctctagatcccagctccccttagagactctgattcattgaatatctccttccttttaaactctccctctctactatctcctttccatttgtaatataaagtgttcaagcttgtgatattaaacataaaaagccaaggaatgaacaaatcatgcaccatccctgattacacattttcttccaaccactaccatctccctcctgcccttcacaataacacttcttagaataaatgctggaagcacatttatgtctttctgacatccaaagaacaagtcttatctccttcaaactctacatgcccttttagttacttctaaattctcttttcttttagccaagtttcttgagaaagtagtgagcaccctcgtctcttgtttcctacatcccaacacttctcaaccctcctgccctgtgaacgctgctcttgcccaactccgtgatgactgccatgtgcctcactgttcctttcagtccttatcttactgactgcttcatggcattcaatgtattcaccactgttgctcttcaggacactctcttctcttggattatagggtctttctttcatttcttttttcttctctgcctggtactcctactcttttatgcaggcgcctcttcttctgatagtccttgaaatactaattttccctcgagatcctttccttggatgtctctctctctctcttatttttctctatattttcaccagaactttggttttcatgtttatgctaatgacactgtattaatctgttctcacatggctataaaggactacctgagacaaggtaacttataaagaaaagaggttgattgactcacagttccacaggctgtatgggaggcatgactgggaaggtctcagaaacttacaatcatgtcagaagggtgaagggtaagcaagtacatcttcacataacatcaggagagagagagtgacgggggaagtactacacagtttttaacaaccaggtctcatgagaactccatcatgagaacagcaaaaaggaagtccagccccacgatttaatcactttccgacaggctcctccttgaacatgtggggattacaattcaacgtgggagatgagtggggacacagtgccaaaccatatcattccaccctggcttgtccaaaatctcatgttcttctcacatttgaaaacacagtgatgccttcccaacagtcccctagagtcttaacttattccagcattaactaaaaagtccaagttgaaagtttcatctgagacaaggcaagtcccttctgcctatgagcctgtaaaatcaaaaacaagttaattactcccaaggtacaggcatagggtaaatgctccctttccaaaaaagagaaatcagccaagagataggggctacaggcaccatgcaagtccaaaacccagttggacagtcattaaatcttaaagctccaaaatgatctcttttgactccactaatcatgttcagggaatgctgatgcaaggagcagctctgcttctgtgccgctgcctgtatagaccctgcagctgctttcatgggctgacattgagtgcctgcagcttttccaggtacacagggcaagttggtggatctaccaatctggggtctggaggatggtggcccttttctcacagttctactaggcagtgccccagtagggactctgtgcaggggctcaaacctgacacttttcctccacattgcccaagtagaggttctccacaagggcaccgtccctatagcaaacttctgcctggacatccaggcatttctatacattctctgaaatctaggttgaggtccccaacctcaactcttcccttctgtgcacctgcaggcccaacaccatgtggaagccaccaaggcttgggtttgtaccctctgaagcaatggcctgagctgtacttggccccttttaggcacagttggagttggagcagctgtgatgcagggtgtcatgtcccaaggctgcacagagcagtggggccctgggcctagtccatgaaatcatttttacctcctagatatccaagcctgtgatggaaggggctaccacaaaggtctctgaaatgccctggaggcattttcccctttgtcttggctattaacatttggctcctctttatttttgcaaatatctgcagctggctggaatttctccccagaaaatgagtttctcttttctaccttatggtcaggctgcaaatttcccaaacttttacacattccttcccatttaaatataagttctctttgcttatgcgaatgagcataggattttagaagcagccaggccatattctgaacactttgttgcttagaaatttcttctaccagataccttaagtcatctctctcaagtccaaagttccacagattcctagagcatgggcacaataccaccagtctctttgataaaatatagcaagaggacctttgatctagttcccaataagttcctcatctccatctgagaccatctcagcctggatttcattgtccatatcactatcagcattttggcccaaatcactcaacaagtctctaggaagttccaaattttctctcattttcccttcctgtcttcttctgagacctccaaactcttccaacctctgcctgttacccagttccaaagtcaattccacattttcaggtatctttaaagaatgtcccgctcttgttaccaattttctgtattagtctgttctcacatggctataaagaactacctgagactgggtaacttctaaagaaaaaaggttgaattgacacagagttccacagattgtataggaggcatggctggggaggcctcaggaaacccaatcatggtggaagggtgaaggggaagcaagcacatcttcacatagtggcaggagacagagagtgaagggagaagtactacatacttctaaacaaccagctctcacgagaactccatcacaagaacagcaagggggaagtccactcccataattaaatcacctttcactatgcctgtccttcaacacatgggaattacaatttgacatgagatttgggtagggacacagagccaaaccatatcagacacccagagataagtcagcagcccagacatctctcctgaactttaaacttttgaatacaacttccaattggaccttgcacttgaaggtcttcatgacttactgaactcaatgcattcccaaatgagtgcgttaatttttctcccctctcaaatatgcttctcccttgtatttattgtcttggcaaatggcacttccatttatgcagtcattctaatcagagacctggtgctacttgtctcatcctgcactccaatcctcatctatgccatctagtcaaccacaaaaatttgctgttacagtcttgtaaatgattctcaaacccatccattctcttcatctctttcagatgtttttcttgtctacaccaacattatatatctcctagatgactacaaaaattactctctaattcagtttccagaaggcatccagaggggtcttttaaaaatgcaaatttgatcttatcattcagttacgagaaaccttcagtagcttcccaccactcttgtgatgaagtctaagtttttttttttttttttttttaacataatgcaataggcagaataacgactctcaaagatatccctgttccaattgctggtacctgtgaatatgttgccttacacagcaaagggggctttggaaatgtgattatggggagatcatcctgtattattttgttgggcccactctgattacacgggctctttaaaggagaagagtgggtgagagagatgtgaagacagaaaaggcaggagaaattcaaagcatgaaaagggattccacctgctgttgctggctctgaagatggaagaagagggcaatgagccaagaagcacaggcagctgtagaatctgggaatagcaaggacatgatttttctttagagcctccagaaaggaatctggccctgccaacaccttgattttagcctagtgaaacctaattcaattttctgacttctagatctgttaaataataaatttgtgttttaagccactaagtttgtagtaatttgttacagctgtgataggaaacaaaagcacaatgccttgagagctctacatggcctatccctttcctaattctccaactttactttactccacttaagctccagctacactgaacattaaaatttcaagacaagccactttttctcatgtcttcaggcttttaaccatgctattcactattcactacattgatctcatcttggacacacattatatttttctgggaatccaccttaacctccccgtgtaatttagttttctatatacatattcttatagcatcttgttctcatatttcattgaattaattattcactcatcatttatctattcatcaaatatatattaatttcctattattggctaagcatgggagttataatggtgttcaaaacaaaacaaaacaaaaaacatgatccccaaagtaagagtttacattttagctaaaaataccagtgagcttggggactttcctgttttgttcagcttgaatatcaaatacctgaaacataataggtactcaggaagggtttttttttaaatgaataattgaataattgaaagaggaggaaggaagtccttagtcatggggttttggccaaatctaggcctgtatctctctagggtgtgatctcctggggaatcatccacatggtttttgagcaaggattgcaaggcaggcttcctggctggaggtggcatttttgtaagcctggcccttgcctacaccttccagaatatctggaggtgtgatgagcttcatcttctaaaattgcaggctaaaaatgtattacatgggatgccaaaacgtctagaagaacctgctttcttggaagtctgagtactagtgcatatctgaaaccacatgactaagaaattctctgctggaatgtttccataaaactacagcctcatctggaactgacaggccacatcaagaggcaatagcacatacaccttaatgccctatagcagtgggtctcaataccaagtacatatcataatccttagatattaaaaataggaattgtaaaattgtgatccccattctatactgattaaatcaagctctctgaggattggctctaggcatcaatgtttttaaaaagttacccaggtgattctcatgttcaaacaatgttgagaaacactgcttagcaacatctggtggaaatccatgatatctgaagggtggacctcaagtaggtgtaggagtactcattatatcattacccaagattgaaaccaccatagacctaaaattgtcactgagctggtatcctttctgagtacctactatgttccaggtatttgatattcaagctgaacaaaacagaaatgtccccaagctcactgatatttttagctagaatgtaaactctagctagttagtttgaggatcatggtttttgttttgttttgttattttgaataccattgtaaccccctgcatagctaataataggaaattaataaatatttgatgaatgaataaatgagtgaataagtgagtaaatacttaattaaatgaaatatgagacaagatgctatgtacatagaaaactaaattacactaggaggtaaaggaatctcattggaacatcattggtttcaggaattgctctaggctctattaacatttctatgaatctttttaatgtctgatttctccagtgttagtgctgttgttgccttgaactggattatctgtttttgtctattacttttgtatttgtcgtttacttagatgaatatgttaacattttgtttcaacatttccccaagatagattacttccttggttccagaaacctcatctttctcacctgccactcagacaagcctcagtgaatgctggttcagaggatactgtacagactggagaatcatgcatggaaggtaaaactcactgcaaatactccagagtgagttacagtccattactggataaatctagaacccaaccagggctattcatctttcccacacgtaagtgactagaccctgctccaatgatactggcattacctctagacagttctctaacatgatttgcaataataataggacctcgttgactatgtgtacacttatttacttccttcttagcttctaacccaaggactcctttttgtttttttttattaaaagtatgactcacgcttgggacttaatagaaagcaccagatctttgccttttatcttttattgctctcccggactgtgacttgaattcattctttgaatgattcaatctatcaccataggaaggttcttacatatcactctcttgccctgggactaggacttacattctctggatgttaagctcagtgtatgagttttctagggccaccataacaaagtaccacagactgggtgccttaaacaacagaaatttatttttttgcaattctagaggctagaagtctgaaatcaagatatggttgtgttgactccttctgaggtcccactccttggcttgtagatggccatcttctccctgtgtcttcacatggccttccctggtgtctgtgttcaaatttcctcttcttataaggacaccagtcgtattggattaaggcccaccctaatgacctcattttaacttaattacctttttaaaggccttaactgaatatacagtcacattaataggtattgggggttagaacttcaacatatgaaatggtggtagtagtggcagaggatggggggagatcagcccataacactcataaatgattttgattaagtaaacccttatatttgtctattcattttactagacaattttcaaagctcattttctcattaacctttactctaccttttcttggtaaactttgtaagcattactagttcttttttatagatgggaaactaaaaatggagaattacactacttatccaaagttgaacagttagtagaaaactgggtctagactcgacaactcttagctcttagttcagtgcaatgtttccctgtctcctgtgctggctttttcccccaaacctaaatcctctttgaaataagctgagtggtcatagcatatttagtaacttctgcatctaatagcctcatgccttttagacatcttgagatacagcaagtggacaagaatgcaagtatttttaaacatatagcagccccaggcaaagcacgtcagtgggacagcctgacgcttgcctggacctactttaagcttacacctaaatgatgtcaaattaggcaaaaataaattgaaaattgttttaacacctggttgttttgccttcactgtgccagctacctggctcactggaagcacagtgaaggcagaactcatgggaatttttagcagagaataacaagtcatgcaaaaagaatatattattgaaagaatatgctgcataaatactaagaaagaacataggtgatcttgaatagcttcttctgtctttcatcctttgagcccaacaccccctcctcagcccacttaactcactcagcagatcatcttttgtagttcaaggactgcatatgtacaacacttaccacctgcctattaccctgctgtgctattaggctgagtggagaagtatttgtaaagcactttctggattcttagatgaaatgtgtttatcaaataaaacgtatctccaagtgtttcaatctcagcttgaaagtcacttcctagatcaaagtgatgtacatcaacatggcaggagatctacctctgggccagaaatgcatcaaatgaagagtcattgatatacgcctggtcctattatcctgccatgaagaaaagtttccagttttagaaaaagaaagcctcagtagcacctcaaattccaggatactttgtggtaggcccagacaggaaagcacttactttatgaaggaatcttttggtcaataaatatgataatgtggcttctttgaggggagaaatataagccaattaggactacatttttaaccaatggatttggcacagtttctttagttcatgcaactcgtcaagatgaaaagataatataacagcagtgtcaaacacttaagtttttaacgaacctttcctgatttctcaagtcttatttcagagcttctctcatgtgctttaaatgagccaagggtcaccaacctttactgaggaactggtacatgtcggaaattgttctagtggctaaggttgcaagacagaaaatgtccttgtcatcatgaggcctacactctagtgggtgagatataataagcaagtatgctagaaaatacaacatgcaatatttcttaagacatgtgagttatgaaggaaaacaaagcagaccgggtaagaggatagagactgccctaggactggagttgggagggagggcagtgaaagaatcctctcgcaggtggtgtggtgcttttaaaatatgtccagaaattctttgacactcttcccatcaaaagtagggtttatgtgtgcttctattgaagttggctgggcctttgtgacagccttgatgagtagaaggcagaggaagtaacactgtatgaattttaaggctgggttacaaaaggccatgcaaattctgctggtttatctaaagatatttgcttgaaagcctttcaccactgtgtacgaagccacctacgagcatggggtggagagagagagagagagatattcctaaagacacccagttgttcagctccccagctgattgagtcttcccagcccaagtgacagacatgtgagtgaataagccatcaagatgaccccagctgcagccaccatctgactacacctatgtgggaggtccatgagaaccgctcagctgagcccaggcaacccctggatttatgagcaaaagaaataattgctattcttttaagatactattttggaatgagttgttacacagcaaaaaagcaaaacaaaaagagagtagaaggtgatagtccattaaggtcctcaatgaatttagagaggaagctctgtgagggtctggataaagttttccaagctaagggaaaaataagtgcaaaggccctgatgtggcatgttggaggcacagcaagcatggtgttagagcagagtgagccaaaaagagagtgcaaatgccctggggaacagggaagggtgcagctccaccttgtaggccatggacaggtgtttggatttgattctgagcttgctaggaatacttagaagagttggagagcagaagtaacacaagtttgtgttttccaatgatttctgtggttgctggatggagaattgactactggggagtggacaaaaatggaggcaggcaagaaataatagtgatttgggctggagtgagtcgtgcccatggagatagcgaaaagcaatcaggtttgggatatgtttaaagatagtaccgggccgggcgcggtggctcacgtctgtaatcccagcactttgggaggccaaggcgggtggatcatgaggtaaggagatcgagaccaccctggctaaaacggtgaaaccctgtctctactaaaaatacaaaaaattagccgggcgtggtggcgggcgcctgtagtcccagctactagggaggctgagacaggagaatggcgtgaacccgggaggcggagcttacagggagccgagatcgcgccactgcactccagcctgggtggcagagcgagactccatctcaaaaaaataaataaataaataaataaataaaaaatatatatatatatatatatgtgtgtgtgtgtatatatatgtgtatatatatatgtgtgtgtatatatatatgtgtgtgtgtgtgtatatatatatatatatatatatgtagtaccaataggactcactgttaagttgcaagtgggaatgacacacgtagaggtctcaggtatgattcccaggttttaatctaagtaacttggagaatggtggtgcagggtgggtagagacgagtacagaaatcaataggtattctccagacatgttatgtttgggatgcctactagatttttcaagaagagatgttgactaagcaattggtcactgggctcagggaaacaattgcactggagatacagatgtgagagttgtcagagtctaagtggtatttcatcataggtatagatgtggggatgtcggcgtataagtggcgtttcaccatagatatagatgtgatgttgtcagaatataagagggtatttcataccacgagaccggatgcaagggagtgggtctagagtaaagtggagaaatgtgccatttttttttaagttaaaatatgtttgtatgtcattgagattgattcagtaaaagggaggtattgatgctgcaggagaaaagtggcagcattattggagcaaagtgctcgattaggctagagcagaggaagctggtatgcaagtggactggtgaagcttcacaggagcatcacaggcctcacttggctgaggtgcaacaagggaacttgactgagttgtaattgccatttccttgttagcattcctcactagattgtaagcccagtgagggcagggaccctccgtaatgtgttcaacattatactgcaattcctgacacaacgtctggctcattcgacaaagttgataactgtttgctgtattaaatggacaaatacacaaattatcctatttggccaaatgtagttcataaataaatatctgttcacttgcatggaatataaaaatgaaaaacttaggcaaatataaccaaagtaggaggaaaaagtgacattttaaatatctttggtttgttagatatccaaaacttttctattaatgaatgtttggatatttttccagattgttgagataaattgaattaaaataaattaaataatagttgctaacatttgtgagtgcttatatgtgtcacgaattcttcccttaagcctttgtatttatcatctcacttaattcttatatcatcccttagatatctactactattattattattattatactttaaagatgaggacctgagccacagagatggtaaggaattgccctcagattagacagcagctacttggtggcagagttggaattgaaacccggacaacttctctccagagcccaggtaactagtcactttcaggtcttctaaaccccaatctagtactccttagttatttaaaaagtgaagaataaattaaatatgaaagtaactccactaaaacataccacataaagtcaaaggaagaatgacaaactgggaaaaatatgtgtaattcatatcagagacaaagactaatttatgaagtgatcatagaaatatgtaagagaaagacaggagactcaatagaacaatggacaaaggaaatgaatagttcgcgaagaaaaacatatatatggcctttcaatgtatgaaaaaaatgtgcaatctgactcaataagagaaaggcaaattaaaaccgtgccaaaatacctattttttttttaacctatgaagttgacaaatatcaaaaggttggcctgtggttcctgtcgcaaggctgtgagaaacaagtactcttactctgctggtgaaagtgcaaaataatacaaatagggcaattttagcactgtcacaaagtgattatcttttgactcagatcactctgggaattaatcctcaggtacacctaaccacttacaaaatgatatataaacaaggatattcattgcaacattatttctagtgcgaaagattggaaacacccaaatgttcatcagtaagaattaatcagctatgacaatgaggaagttcccacatattgactcagaaagttatccaggacatgccatgaagtaaataaaaaaaaaaaggaaagtaaaagaaagtaaaaaatagtatatataatatgatatcatttgcaaaagactgggagagaataagattacgtatgagtctatggtttaacctacaaaataagtactggaagaatactcagaaacttatatatgtgacaacctgtagaggtaggatgaggtgggagcgaagaagtgtttttaaactctttatatatactttacatataataacacaaatctcacggaaagttatgagtagggaaagtaagatactcaatgtataccttgttttatttttgatctttgaaccatgtgcatattttgttatttacaagttagagagaaaaggtaatgatagctacactcacagagcacttcctgtttgcctggcactgtgctaagcatgttgtctttgttatctcaggtattcctcacagcaggacacattattattcccatttagcaggtgaggtacaggtttagagaagttaaggaatttacttaaggcgcagagccagtaaattgtggagctgggatcgaacccaggccacctggctccagaagcaacgctctgagctactattctactctcatggtggttttaaacattgatgctctaccttgagaaacataagagatgatgtccccctcatggccagttctcatgggcacattaatctttgtaaaaaaataaaagaaaaaagaaaaaaacaatagttagaaatccctgacagttctccagtaataataggtcactgtagctgtggcatgagatgtcttcaagccatgggagagccctgaaggctagctgtaattccaacccttccgtcctaaacaagaaagatagcaaagtgaaagcacaggaaggttattattttttttaaatacctggcatttattaagttcttaccatgcgccaggcacagatgtcataaggacattacatgtatacctgtttaatgttcacaacgaaaaccttattagacagatgctatcattaccattgtgatgagttgaattgtgcctgcccgccaaccctgaaaggtatgttgaagtcctaaccccagataattatttggtcctaagtgtcaaataagactgggaccttatttggaaatagggtctttacagaggtaatcaagttaaaatgacatcgttagggtgggccctaatccaatatgactggtgtccttttaaaaaggggacatttttataaagacatacacaatgggaagatgatgtgaagatggccatgtgatgatagacacatagactgaaatgatctgaaaccaaaaaataaaatacaagggagtgctggccaccaccagaaactaggagggacccttcccagagtatcggagggagcacggccctgccaacaccttgatttcagacttctaacctccagaactgtgagacaatacatttcttttgtttgaagccatccagcttgtggtgctttgttatggtagtcccaggacataaataaaaccacatcttacagacgagggaagcgaggtacagagaggccaagcaacccgcccaaaatgacactgttggtaagtaaaggcaccttgacctgagcctgggaagtctagcttcagaggattttaaaagttattttgcaaatttcagttagctattattcaaacaaatcgtctcacttcatgactgagggctctgaacactctgttttgacctcaacccccgtcaaagggcaaagcacagagcattcagagcagggcaaccggggcaaactcaagagggcatagcaatgggagcccacgaaaccaaaccaaactcagccgtgcagctgctggagctggggtccagctaatggggctttccggtcctccctgaaacagctgagtgtggccaggacccagggggtacgcacttcaaagcaatcaaagcttccccacagcctctcatttttgatcagcaggagctgcaatctaggaatgtgggttgtttgaattattattattattttttagcttaagaaagggtcaggtgaagttcaagggagctaaagcaacttggaggaactgcctttccaaatcccttttgtgcccagatgcccactaaacaaaaatatttcctgaatggtacaatgctttacagataatatggaaagaggagggatgaaggaaaggtctggtcgagcactggatccagggcccatgttcatctgtgtagcacctctgggtgccccctcctgaaagatacagccctgtgaataacccacttgttgagtggagcccaggctgaatggcggcctccaactgcagccaagaggcaggcaaatatgtactggagacgggcatcaaagttcaaaacagcatttgggtaaaccaagagtcaaatgactaatgaggaattggaagcaggttatggttatgtctgagcagaggaacagggcttgggcagacatttccccccagccacactgttgaagtgaggaatatttcagtactctccccagaacggatcatcctgtattgaattatacaggtcgatgtctactctgatgactccaggatggaaggaaggatgcctcatgtgaccctaacctccaccatttctaggtacagtgtagctgttcaataaaaacttattatatgggtgatttgtttcctggatgacttgccatgggctttgcaattccgattaggatcagagaaaaaggagaaaaagtatctttggtagaagcatgagtgacaggtctgcatcactgcaattctggaatggaagaaatatgacctaaatcccaaatggccctaaacaaaatgcatgcctctgaacacaactcaggatgtcaagggaaagaaacaaaatagttaacctttgcctaatgtggaggcaaaagggtgatgtatccaaatgttaaaggtgtcaggcattgaagcagagtgagggaaagattaatttccttaattttaaacttctcagacatcaggcactaataaacccaggttcatcatacactggtgaaaacaagctttattttataattccagatatttaaagaatacctcaatcttaacatttgagtgccttgttgaaaataaatccccagaaacagcagcacatttccacagaaaactcataaagatgcaccctatgtattttcttatctcttttcgaagtttagattctagggctctgtatattgccatgtggattaacattgtcatgtactttgctgctaagaagaccttgagatgctaatcctacaggaaacttccagagacaagcagaaaagtaactgactcacctggtcgtgtactgtgctgtgaggatgcttatttctaaaatgcagattgcaactgcaaagctccggcaggctgacatgctgctcttgctgggtggctgcgagtggggtggcagggcaggtctggtaaggcatttatttgcaaagggccagaggacagggaacaagc

SEQ ID NO: 2370 - DNA, 26397 bp, Homo sapiens
  source 1..26397: mol_type = genomic DNA
gcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtgggtaagcaagcccggttaggctgcagaccttatcccactctgtgatgcgcctctcctcccaaccttccccgtccagaccccgccattttcccgccagcgtacccccttcccccattcggtgcccatgggccccagcgccataaacccctcgcgaccaaggcagcctccactggggcgtgctcatcgcgcggggagtgttccgaagggtgccctaccggagcccagccctgcttctttcttgcagtgtttcaaaccggcatggtcggctaccccgaggccctcaccgatccctcctacaaggcacagatcttagtgctcacctatcctctgatcggcaactatggcatccccccagatgaaatggatgagttcggtctctgcaaggtagccacacccagtgctttctctacattccttttcaagtcagtaattgttaactattagtgaagtaggagacgttgacaccctgctgggcatcctgcagaaaacatacccactgaagtagtaaagtcaaggactaagatcactagtaactgtagttaggggttgttaagtgccttgggaggcacagagtgttggaggcctcaggaaaaagctaccgcctttgttaagggcatcaaggctccaggtatagctgaaagcattctgtatgtagtgaaggcatggatcaaggaaaagtaaaagaggtgtaagggaacagccttgtccaacttgttaggcatgcagaagtcaggagaaaaaagcctgcagataagttaaatccggtgggcatggagggacctgaagccaaagcagagtcagcttagtttggtaaaggatccattgaaggtttttttttagcagcagagtcagatgggagcagtgctttttaggactacataaattagtggaaagagactggaaactagggtcacatacttctctgtgacagtgagtgccagtttacctacaaaaccagtgacattatcttctagacctactgacatggcctcgtctgattctctgcttttcagttgtgttcttacctctaggtgagaaaactgagtttcttcctacagtgaggtttcccctattccttcacctctgaaatttggaaactaagttgccctctgacagttcaagcattaaaaaaaacccaacatatagtaattaaggtaatagaggaagtcaatctggcctagagtagtatctctcaaaatttgtttggcctcactgcaggtgtaagcctttaattcttaatttgccttcccagccaccctgacgctggggagagtgagctccggataaaggacgtacatgttgttcttcctggaaaagaatttctaggttcatcacaaacctacaaatacactgcattctagttgatagtgaattcttgtgaatttggttaacctttgtcagtcatcacctttgtcaactctagacacactgactaaattgagtttataaaactacaaaattgaggcctgattaggatcagggtgggaaaggcctcttggagccactcgcacatataaatggattactccacctggccagggagggttctgccaaactatccttcagatccctggacagtctcagaatgcaggttccttaaactgttcatcacccagctgaatgcagtttaaatatgctgatccctcccacataaactttctgtttctatgtagctattaaacgcttatctattgagtaacaagtttatggtttttgttttttttttggggacaaggtctcactttgtcacccaggctggagtgcagtggcataatcatggctcacttgcagcctctgccacctgagctcaagtagtcctcccacctcaaccccccaagtagctgggactacaggcacctgccgccatgcctggctactttttttgtattttttgtagagaccgggtattgtcacattgcccaggcttgtatgttatctttttttatttaatttttttttatttttattttgctttgaggtagagtttctttcttgttgctcaggttggagtgcaatgggcaaccttggctcactgcaacctccgcctcccgggttcaagctattctcccacctcagcctcccgagtagctgggattacaggcatgggctaccattcccagctaattttgtatttttagtagagacagggtttctccatgttggtcaggctggttttgaactcccgatcacaggtgatctgcccacctcggcctcccaaagcgctgggattacaggcgtgagccaccgcgcctggccttttcttttttaaataatcccaaatgaagtttgggaggcatgcttagtattgtgccctgaacctttgttttttatttggtaatggggtattttgtacctccctatcttactcagtttttaatcacactctataattaatatttatatgggtgttaccttgttttctagctccctaagtcagaaataaacatcatgaagacaggaacctcatctttttttgctcattgctcttttctcagcatcttttgcaatgcctgcacctcaataaatgtctgactgacaccatgtgccttgctcttgagttctctgtttcgtgacaaagacacaaatacatattcatcatatgacgtaaatagcaagagaggaaataaagtattaaaacagctctaagatggaggcacaagctgtattgggtgagtgggaggggcttcacagagaaaggatttgtgatttcagttttagataaaggaagaaagaggcggggcgcggtagctcatgacttgtaatcccagcactttggaaggctgaggtggggggatcgcttgagcccaggaagtttgagagcagcctggcaacatggtgagacgctgtcactacaaaaaattcaaaaaattagccaggtgtgatgatccacacctgtggtcccaactactcaggagtctgaggtgggagaatcacttgagcccaggagattgaggctgtagtgaaccgtgtatttgtgccactgtactctgcactccagcctggataacagcaagaccctgtctcaaaaaaaaaaaaaaggaatggctaggtgcgatggctcactcctgtaatcccagcactttgggaggctgaggtgggcagatcacaaggtcaggagatctgagaccatcctggctaacatggtgaaaccccgtctctactaaaaatacaaaaaattagccgggtgtggtggcgggcgcctgtagtcccagctactcgggaggctaaagcaagagaattgcttgaatccgggaggcagaggttgcagtgagcttagatgtcgccactgcattgcagcctgggtgacagagtgagactctgtctcaaaaaaaataaataataaataaataaaaaggaaaatgtcattttcagtgatcatcggggcaccctgggcctgtgggttgtgtttcgtataggagagagcgttgttggtaaatggaaatacctatgcaaaagcaccaaaagtttggtatattgaaggccattcaatgtggctgaatatagggtctgtggccacacaatcgggaaaatgctgcaaagaaataacttggcctgaggcttctcacaatctctttccatctacagtggtttgaatcctcgggcatccacgtagcagcactggtagtgggagagtgctgtcctactcccagccactggagtgccacccgcaccctgcatgagtggctgcagcagcatggcatccctggcttgcaaggtatggtggcaagcaggggcatatttgggcagagcacagcatgcctggatggaaagaatcaaggtttctgtaatctgctgggacctgactctaagattgtgatagttggaaggtttagattggagttgggctgggagaaagaattgaactatcactcagaaagaaaatttccaacacaggaaggaactcccaccttccataatcatcagcttagggctaatcttatttcatcaccaccactggattattttgatgcaaatctcagacatcatatcatttcatctacaaatagttcaatatctatgcaaaaggaatctttaaaaaacatgatcataataacgtcatacactaaaaaaattaataattccctaatacaagtgtccaggcaatgtttaaaatttcccaatttttttttttttttttttttttttttctgttcatttgaatcttgctctaaacagggttcacacattgcatttggttgataagtctcttaatctgtggaccttgtaacctatttgaaaacaggtcatttttcctgtatctagtatcccatagtctgcacttacttggttacactcctgtagtgttacttagcgtattctttttttccctttatattattttctataaatggatagatttagagttgttcaattcagatgtgatatttttggcaggaatacttcatggtagtatacttctgtcacaatggcccaggattttgatgcacatagaacagctgtgtgtgactggggctctggaatggaagtgcttctggaagtctaacctcacagatgactgagttgtaggaatgtgatccctaagactgtgctattttgacaggagtagacactcgggagctgaccaagaagttgcgggaacaggggtctctgctggggaagctggtccagaatggaacagaaccttcatccctgccattcttggaccccaatgcccgccccctggtaccagaggtctccattaaggtacagaggtagagtgggagagtgttgcaagctctagcacagtagttatattctgcccacaattggggggtgaacacaggagagaatcaaaggaggctttgaaggtaggagttggtgcaggcatatcttatacccactgagcacagctgccaactgttgccctttattcgtctatttctcagactccacgggtattcaatacagggggtgcccctcggatccttgctttggactgtggcctcaagtataatcagatccgatgcctctgccagcgtggggctgaggtcactgtggtaccctgggaccatgcactagacagccaaggtgagtagctggggcctgttcagggcctcagacaagcagcttgggtggaagatctatcccttggtccaattgctaaaagtcagtaggagttgcagtgaagaagatagacattgggacttaacactctcatgggctgggggggctgcaggtgtgtctcctgtaattgaaatactgattttgatgtcatcttttctgcccactccagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgaggtgggacttgtggggagcagaaggggcccatacttgtggcatgaggggtggggtgtctcaggaatgagaagagagttggtgtttattcgtgttgaaataggagcgggggggttgcaggtgaggtggctcccacctgtaatcccagcactttgggaggccaaggtgggcggatcactggaggtcaggagttcgagaccagcctggccaacatggtgaaactctgtctctactaaaaatacaaaagttggccagccatggtggcgtgcgcctgtaatcccagctactccagaggctgaggcaggagaatcgcttgaacctgggaggtggaggttgcagtgagcggagatcgtgccattgccctccagcccgggaaacagagggagactccgtctcaaaaaaaaaaaaaaaacaaaaaggaaacaggagtgaggctactgagaacaggagatcggtgagagctggggtaggttcagtagtgaagagagggtgagcagggcctgtgactcggcatgcttctacctccagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcaggtgagcctggttgactgggtctgtgaaaatttgaagccctgtgggccttgatgatggaaaagtaaagcacggcagtggatccgagtcccctgtcccactacccacctcgaggctgccagtgtcatgccagggaccatgatggttttcatgatgcaatctcttcaatagtgtccagtttcacccagagcaccaagctggcccttcagatatggaactgcttttcgatatctttctggaaactgtgaaagaggccacagctgggaaccctgggggccagacaggtaagatcctgagtagaactgggttgtggacctaagaacagggttggctccaggatgggcataaggtggacatgccctgggcaactcctagatgtctaggaggttaagggtattggggatgggtggcaaccaacccaagataccgtttaagcttctgttgaaaggaactccagggtcctgggttctggtcctccctctgctcctcctgaggtgcataatttgctctggactcttctgaaagcgagggagctaatccagttgacctcttgggtccagctcagctctaacattctacgaccttctttgcttccacagttagagagcggctgactgagcgcctctgtccccctgggattcccactcccggctctggacttccaccaccacgaaaggttctgatcctgggctcagggggcctctccattggccaagctggagaatttgactactcgggctctcaggtgaggcatgttcctccccacccttctgggcgtgtgaccctcaagaatggaaagggtcttaaggagaagggctaaggttgcagggaggaaatgaaccagatttggggaatgtagagaaagatgtagtaagaaatagaagtcaattattaggggccaagagtacagggagggaaagaagaggagaatgctactctaaggctgtttgcaattttgcttcttcagcagaggctgagatgccattcttgtccttttaggcaattaaggccctgaaggaggaaaacatccagacgttgctgatcaaccccaatattgccacagtgcagacctcccaggggctggccgacaaggtctattttcttcccataacacctcattatgtaacccaggtatgactggggcaaggctggaatgaaaagaggactgggcaggggggcccagtggtcactgtgggttattaaactttgattgcctctctacccacaaggttctgatgcctgtaactcccctctccatcctcaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggttggaggggtgtttgggtaaaggaagaatggtggtgttttttttggtagtgttattttcttttttttttttttttttttgagacggagtttcgctcttgttgcgcaggctggagtacagtggcgtgatctcggctcatcataacctccacctcccagattcaagcgactctcctgcctcagcttcctgagtagctgggattactggcatgcgccaccatgcccagctaattttgtatttttagtagagacggggtttctccatgttggtcaggctgatctcgaactcctgacctcaggtgatccacccccccgaccctcggcctcccaaattgctggggttacaggcgtgagccactatgcccagccatgttattttctttatatctttttttatgtgggacaggcacaccttggacagtaggaaataacctgtttgttcatctcttccactcattgcaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgagtgaatgggggaagggtgggcgtcgtgtcaggcaggatgagcttttggaagagcagaggcccaggccaaggtctttgagagttgtatgtccctcagacccaggttaggtgcagccccagaggtaacaggaccctggggtgcagccttctgcctctcctgactctgcttggcagtgacctccatggcaccccccttcacaggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcaggtaagctctaggccctggaactgatagtctagttgttaccccctcttcttgtataatttttggcccttgaggttgaggtcttttgggcttacagtccctggagtacaagctggaatcttctttactaggttacttttctctcctttctgagacctctcctagacagggtcttctaggccagtgactttattctccttctttgcagtattacatcattgaagtgaatgccaggctctctcgcagctctgccctggccagtaaggccacaggttatccactggcttatgtggcagccaagctagcattgggcatccctttgcctgagctcaggtacgaggatgagggagatatcacagtggggaagtgggtcgggggctgaggaaaatattgatgggacagggaatatgaaaaggacattggcctggatttgtgggaatggaaagagctatccggaagctcaccctttatgcttccttcactgtccttctggcatcccacctgctggaccccaggaactctgtgacagggggtacagcagcctttgaacccagcgtggattattgtgtggtgaagattcctcgatgggaccttagcaagttcctgcgagtcagcacaaagattgggagctgcatgaagagcgttggtgagactcatgccctgggcacccccatggggccccaccatgaccaagaatcttaaatgtcaagagttccctggcatggccttttacgtcctatgggagcaggtgcttgagacatttcaaactaagattatagtccttgtcaggagttggggaggcatctggaaatctgtgttggaatacagaatctctgggataggtgcaagccatcagactatctcatctcatttttgcagtatctcctcctctggcactttgtgctttggtcactaaatgacctttttttttagtatgatgtttacatcagagcagggcatcataaacctttttggtaacaaggaaatttattagtgaatgatgaatggccgtaacgttacccagcagtggcagagcatgttagaattgagttagtatgtttctttgtggtatccctttagttgccgaagaccgtcctctaacacatttcaaccaaaacaaaaatatacgtgtaccagacacagcgccaccagcctgatggataagagcattttgtggtgctccagatttccatttagagcagtagtggcctttaaacaagtaagtctaagctcagatattatttcagaatttttagaaattctgcaagactgccaattttttccttctggagatgaatctctgttatatgaaaattagaataaacatgggaatgaagccataattaaattgtggcaaaaagaagtggattgaaaataggccaatgaaagattggttcctagatgagacatttaattgttttacatctgttcaagtattcttggaatgtggtcttctttggtaactttttgtaacttttattatacaagtaagaaacatgaatcatggaaaacgaggaaagatagtttaaccaaagaacagtagtcacctgtaatcttgccttacagagattgattaattcgaccgtgtatctgcgactgcataattcagccgtgtatctacgactgcatacatttctaggcatatgtgtatgcatgtattaggcttctccttttttaacaaatctcaaaataaaaagtcttacaaccacagttacaaagaaattgaacaaaatcagtcacactactgttaacatcgtagtgtttttaaaacttttttaaagaaatgtaaatgttaggattgtaaatagaaaaatacacttggtaagaaatacttaagcccctagagtaaatagtcagaggagatgaacaacactttacagaagaagaaatcaataagcaaacctagagaaaagacggttcctctcattagtaaatagaaatctagttaaatgagactctgtttatgcccacttcttagaaggttgcttaaactttgtattatgaagcacagacttctataaagttattcgtactcatcaagggctataaaatttgtgttacctattgcctctacatatctggaaatttatcctaaggagattatccaaaacagaaaacatcatatccagtccaggcacggtggttgtaattaatcccagcactttggaaagctcaggtgggaggatcgcttgagcccacgagttcaaggttgcagtgagctgtgattgtaccactgcattccagtctgggtgccaggctaagaccctgtcttttttgtttgtttgtttgtttgagacggattttcattcttgttgcccaggctggagtgcaatggtgtgatctcggctcaccacaatctctgcctcctgggttcaagtgattctcctgtctcagcctccagagtaactgggattacaggcatgtgccatcacgcctggctaattttgtattttaatagagacagggtttctccctgttggtcaggctggtcttgaacgcccgtgctcaggtgatccacccacctttggcctcccaaagtgctgggattacaggccactgtgcctggccgagaccctgtctcttttttcttttcttttttttttttctttttttttttttttgaggcagagtcttcctctgtcgccaggctggagtgcagtggtgctatctcggctcactgcaacctctgcctcccaggttcaagcgattcacctgcctcagcctcctgagtagctgggactacaggcgcgcacaaccacgcccagctaatttttgtatttttagtagagacgggggtttcatcatactgcttaggatggtctcgatctcttaacctcgtgatccgcctgcctcggcctcccaaagtgctgggattacaggcatgagtcaccatgcccggccgaccctgtctcgttaaaaaagaaagaaaacatcacagcctaacttataattatgaaaacttttttttttaatacggagttttattctgtcacccagggtggagtgcaatggtgtgacttagctcactgcagcttggatcttctaggcttaagtaatctcccaccccatccttctgaggagtgagactacaggtgtacaccaccacaccttgctaatttttttttttaattattatttgtagagagggaggtctcactatgttgtgccggctggtctcaatctgccttaggtgatccttctgcctcagccttccaaagtgttggattacaggtgagagccaccaggactgcctaattgtaaacacttaaaagcgaaatgggccgggcgcggtggctcatgcctgtaatcccagcacattgggagggtgaggtgggcatatcatgaggtcaggagtttgagactagcctggccaatatggtgaaaccccatctctagaaaatatacaaaaattagctaggcatggtggcacgcacctgtagtcccagctactcaggaggctgaggcaggagaatcgcttgacctcaggaagcagaggttgcagtgagctgagattgcaccactgactccagcctgggcaacacagtgagactacgtctcagaaaaaaaaaaaaaaaaaaagctaaatgtccttcagttagtagttaaattatggcagatcatacaagaattaagttagttggttgggcgcagtggcacacgcctgtaatcccagcactttgggaggccgaggcaggtggatcacctgaggttgggagttcgagaccagcctggccaacatggtgaaaccccgtctctactaaaaatacaaaaattacccaggcatggtggcaggtgcctgtaatcccagctacttgggaggctgaggcaggagaatcacttgaacccaggaggcacaggttacactgagctgagatcatgccattgcagtccagcgtgggtgatgagagaaactccgtctcaagaaagaattaagttggtgttgatgaggccatgtggcaatgtgggaaaatgtatgatgaggaaaaaacacaggatggaaattatatgtatgctgtgatgatatgtaaaacatacctatgaagggcccggcacggtggctcacgcctgtaaccccagcactttgggaggccgaggcgggtggatcacggggtcaggagtttgagaccagcttggccaacatggtgaaatcccgtctctaattagccagacatggtgacacgcacctgtaatcacagctactcaggaggctgaggcaggagaatctcttgaacccaggaagcagaggttgcagtgagtcgagaccgtgccattgcattccagcctgggcaacaagagcgaaagtccatctaaaaaaaaaaaacctatgaacctatgaagaaaagtccagaaagagaaactctaaaatgattgttgtaaatgtgatttgctctgcatggatgagtagtaaggatcatcttcctattatctacacttttttaaaaagttttaaagaattccagttggtgttatgattatgtgaataaatcaaacccaataactggacagccatcagtggtttgggccactgtgataaacttccagtatccagtgtatggggatatattccagtatccccatgcccgttttaggcatattgattccatattcatcaataagcacaaagcctgagcttatccatgaaaatagcagggaaaagagctataagttaagatttctttttgtttgtttgtttgttttgttttgtttgagacggagtctcgctttgttccccgggctggagtgcaatggtgtgatcgctgctcactgcaagctccacctcccgggttcacgccattttcctgcctcagcctctggagtagctggggctacaggcgcccgccaccactcccggctaatttttttgtatttttagtagagacggggtttcaccatgttagccaggatggtctcgatctcctgacctcgtgatccttccgcctcagcctcccaaagtgctgggattacaggcgtgagccactgcgcccggccattaagatttcttagttgtgaaacaccatgaatcccaccatcatgtgacttgccttgagaatctcccagagtcttgactataaaccataagcattatgggcagtgccttcttcccaccccttccacctccacaccttcattccttccattctgttcttccaggtgaagtcatgggcattgggcgttcatttgaggaggccttccagaaggccctgcgcatggtggatgagaactgtgtgggctttgatcacacagtgaaaccagtcagcgatatggtaagtagctcccctcccctggcaatacccctaaaatagaccctgcttctcatcgcccccagaccatgagcttgttaccagtaacactagcagcagtcatcattggacatttgctttgtttccactttgctgagaattttgagatgtctcattagcacgcaagggtgtattactagacttgtttttacagatgaggaaactgagacataggttatagaaattactcaaagccacatagccaatgagaggtagacccaggattggtatccaggtttttgcagttacacagcctgtgctctggtgtacagtttccccttcctgagacaagagcagctacttacgctcaggcttttagatgggctggcagtagcttccgtctgtctaccccctttctatcaggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgaggtcagaggtggcaatgagagcttccggctgggaaatgtggggcagaacctttgtatcagtgagggacccttgggagggaggaaggagagtgtgggagagctttagaggcttctgaccttggttccaaggatatttcctctcatctgtgccctggggtctcaaccctctatcagtctgtaccctactctctgggcctgtgtttcagaccctttttctattttagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaaggtcagagagttcattttctttccactttccttgctattctgttcatctctagcaattgcttggcactaatcctggcatttcctattaattgccgtcccttactttggtcatagagctttggggtgggggtccttttaggccatctctcatgccccacacggtatatgaatctcttccccaacactttgtacctccttccctcccaaggcaggggtcctgtacagctctttcagaggaagctgtgctggcagtctctgaagtaggggctttggcttagtttctccacgattttctccacgattttcctcccacctgactgctaagtacccttcccctccctcttgcagatgggatataagaccatcatggtgaactataacccagagacagtcagcaccgactatgacatgtgtgatcgactctactttgatgagatctcttttgaggtgagggagatggaggcttcctggtagcttgagtggccagggtcgagtagaacagctggctgacctaagattctttgaaacttggtggcggctgagggaagcagtgagcaggaaggctcagattcctgccctcttttgctgccaccacttgtttctccccctgcaacgtaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgaggtgggctgggacctggtgggttacccggaggctggatgatgcttgggggaaagtgtgaacaactcagctaagctccctgcctcctgtagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggtgggaggctgcagacagtgaagtctctgagggcatgctgccagccctggaggagacttccttctctggtccagcagaatcataggcaccagggctgggaacagtgggctatgtggggctcgttaaaggaagagacaatcctagagtaagtgagagaagaaagtggccctatgtcccactgtctgtgtccccccgctaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggtaataaggctaaaggaaagaactaaagggccacagctcttgcatgttctgtgctggccacagtgccatgaagccctgcactgtctcctgccttcatccaagtaggcagggaagctggagggaaagggctgtagctagagctcatggtgttggggcttatgacagtcagtgaccctgaaccctgctcagtctgatcccccagagctgaggacggagaggaagagtctaggcctatagatagtgtcagcaaggccaacctgcagaaggcctgaccagtcttctctgccccaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtaaggaatatcgaaacccttggggttagcagaaaaatagcgggagagagttcactcaccacacagagttgtcagtatgtaaaccaggcactgactgcaaggcattgccggatcgtgggggtaatgaggtggtcattgtcccttaagagcttactttatggtaatgggagggaagagaagttggatccccaaaaaagctttggtatagaacagtccgtggtaaaactacatattcgacctgtaaacagaatgctgcaggagttcaagagacaggaggtgctgcttccaaaaggggtgatctgggaaggcttgagcgaaggggtgctatttgaattgagttttgaaggatggttaaggttttttatttgcaagggcacatcctaagcagaagctgagggatgaccccaagtacgtttggaaagcaggagggcacacagagagggcaggctgaccctgccattcagatgggatcaagcacagggtactgtgtccgtctctgctggtgagggaggaggtcctctcacaccttggccctctctcttccctcccgcccctttaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataaggtatcagaatccaggagggcttcccgagggccgtggctccctgggccagggctgaccttgaaatggaagacaggaagaaaacaatttcatccttctgtttggtttcagaacaaaagcgagctgctcccaactgtgcggctactggagagcctgggctacagcctctatgccagtctcggcacagctgacttctacactgagcatggcgtcaaggtgcaggaactctggcaacctaccccactgctgcccttccccaagggggtgaaaatactgcaccaaagaattatctgggctgggcacggtggcatatacctgtagtcccagatactcaggaggctaaggcaggagaatctcttgagcccaggaggtagaggctgcagtgagctgcgagtgtgcagtgagtgcaccactgcactccagcttgggaaacagtgagatgctgtctcaaaaaaaaaaaaaacaaagaattatctcctattcccctgcttttattattaccattatactagtaagctatattccatgcagaaagcagaatacacaggaagcaaagagaaaagtctcttaaaatctctgtaccactgttctgatatttttccttccaggattttctctgtgtacatgtgtgtgagctcatactgcacctagtccttggtaacccatcttacttagtgtagatatctttcctgccaagaaatacactttgccagtatcaaatagaggcagccctcagtgcccaccctatgggtcctcagtctcctcatcatgggctcctgggccagctcctctcccttaaggctagccttcctgaccgctgccagacagcttggccctgaccttgactccgggttggcaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggtaactgagacccatgtgctgggagggagactgccagtgttgatgggaagaagaaagagggaggagtgagtatggaacagccatgctagtaataaagctttgtggctacagagggagagatggtgggtatagagtgtgcagagcctggtttatgggaaaaccacatctctccctacaactcccaggatcacccttcccttaaagctgactgctttccacttgcaggccctaggccagatcgggccagcccctcctttgaaggtgcatgttgactgtatgacctcccaaaagcttgtgcgactgccgggtaagtctttggggagaacttggcttctgaacactggcagcccctggcatagagacctgcagtgtggtgaaggatggctggggggcccactctttgtcctggactgcacagactgtgaagaccccagaatgtttctcactctttcattccttaatccacagtgtccacagtggccttgtctgaggaattttttttttttttttttttttgagacagagtcttactccatcgcccaggttggagtgcagtggtgtgtgatatcggctcactgcaacctccgcctcccaggttcaagcgattttcctgcctcagcctcccaagtagctgggattacaggtgtgtgctaccacaccaggctaatttttgtgtttttagtagagacggggtttcaccatgttggtcaggttggtctcgaactcctgatctcaggtgatctgcccacctcggcctcccaaagtgctaggattacaggcgtgagccaccatgtccagctcacccttcctatttctgaatcttcctgtaatcttgctgcttccattttctcccaggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaaggtgagccactgcactcttcctggtattggagacccatatgcccctaccagccacccttgcttccctgagcccttttccttctgccccgccctatgggcccaggccactggtgccaggctagcctgtgtgggcatgggtgccagtgagccttacctctgtgtatcctctccagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggaggtagggagtgtgcatgtggcaggaggccaccacccagtgtctcctggcttgtgggcccctgcctaagtgggctggtagcagtgaggattcaggggagctcctggggactctgggctctgatgagcacagtcagagattctgcacactccttcatcagttctttctgctcccagcatttcgagacatggccctcccacctccccattgtggctcacgcagagcagcaaaccgtggctgctgtcctcatggtggctcagctcactcagcgctcagtgcacatatgtcacgtggcacggaaggaggaggtaagagtacacctgagatcctgctgtccctgttgctttcccagtaacaccaaaggtcagggtagtccttaggggcaggagacagcaggaggagagtctggagacagcaggaggagggtctcgagccagcacccttgcaggtctacatcatcattttttgagcagggatgttggccattgggactttgtgtagggcaaggcatatgggtggtgcctcttctggatcttcccattgttccccagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatggtgagagaatccagcatgtacctcctctgcccagtggggcttgtgggacagccctagcaagaaaatgggaagcaggccaggcctcaggactctactaggacagggtcttgatccgtatgggaccctagcctctagggtacctggtctgtgataggtgcctgataaatacttgttgaaagaatgaatgagccagtgagtagaactgcaagtgaaagaatacatgggtaaaagtgtgggctccagaagatggcagcagtcctgttgcccttgtttctagttcccagaaaaaatgagcattgggagtggtagtgagcataaggaggttgttggaagtgcagtcctggggtgtgagtgacttcctagacatggaggtgattggtcctgagggtaatggctttctttctcccagctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtgtggggatgaggcccagagcaggaggggggctctccagccctaggatatgttctctggggatcctttccctagcataacccatgtcctctgggcaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggtacgcaagtagcccctgcctgatctcagtagtgccctcttctgcaccacgttcatttcttcccttcccagcacatctacactgtcccactatgtgcaccactgccctggaccaggggttgggggcacagctcccccaaggtgctttttgtccttgctgacatctacccctttaggacctgagttctctctgctccctcctgagtgccctgccttctgcctgcaggttctggtacccccgggctatggacaggatgtacggaagtggccacagggggctgttcctcagctcccaccctcagcccctgccactagtgagatgaccacggtatccacactactgggctagggggctgggaggtgttagtctcagggcaggatgaacagcttgaacattttcattggtggttcaggaacaattggggttttcttgagggactgaatttgaagtggggttgggtcaattatttttttaaaatgctgggccaggccagatgtggtggctcacacttgtaatcccagcactttgggaggccaaggcaggcggatcatctgaggtcaggagtttaagaccagcctagccaacatggtgaaaccccatctctactaaaaataaaaaaattagccaggcgtggtggtgcacatctgtaatcccagctacttgggaggctgaggcaggagaattgcttgaacccagaaggtcacgccactgcactccagcctgagcgacagaacgagactccgtctcaaaagaaaaaaaaaaaaacaactctgggccaacgttatccctccagacacctgaaagaccccgccgtggcatcccagggcttcctgatggccgcttccatctgccgccccgaatccatcgagcctccgacccaggtttgccaggtaagagtggggttcctgtgactcagagactgtgtagggacaggatccacttcttcccagtgcctcgcctttctctacttacatgtcctcctctccatccctttatcctcgtctgatctgccgtgccatcctttgcctaaacaagtctccccggtgtgagtagacatctcacagcttctcacatgcccttttttgttgtgggcagctgtgttcctccgcccaggagctgggatcccacggggcagcagagcgtggggtaaatccaggttgttggttggtgtgagtctggccgttcctcttgcctaggatgcctttgccaactgggagagccccgggagggcaccactgctcccatacaacacagccccatgggaagccacctgtctgtccccagagctgctgcagtcccctgccctcccctaacctgctatattactgtgttgtgaattggtttaacatatacactgtgattcagagttcctgggaatatggggtttctttccaaacctcagccataaatgtatatctgtcctcttgtcctgtttgcagctgaggagccaaaggagaagtcctctcggaaggtagccgagccaggtgagactccaccctgacacacactcacctcggggacctctgatctggccttggtaggaggaaccctctgaccagccttttctgccccatccctcactgcagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcaggtgcctggggcagggaggatgggaccacccagagctttgaggatttggaaagctggggctaggacctttctagctaacttgggctctttcttagatgtctcacctgttcaatgtggcacacacactgcgtatgatggtgcagaaggagcggagcctcgacatcctgaaggtcaggatcagggccgggggtagggtccaggccatcgcctgcccttgggccgcatcagcgcagggccgcgcagtggtcagagtgggtcttcctccccctgccatcccgtccccttatgctagtccatccctctgctgctgtagatcttcccccacgttttccctccccaaagcaggatttagctggctggggaggccctgagcatgagaccatcgccccactagtggggtcttctggtctgggctgctgcaatcatgggagagagctagggtgtgtcctcctttcccagctcgttcagacacttaatgatgggtggttttctggaggcagagcctttagctcagagtgacaccagtggtggaaacgtcaaggctctgacaggtcacaggggaggtttgggtgcagaagggtcctcacagcacccctcaagtgtcagttggggtggtggtgcctagctggggtttccccagggtggacacgcatacgtacaccttccatcttgctctttccctaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggaggtgaggccagcctgggtactgagatggggttaagaaggctggacccaggggcatgagaacccttctgcccacgttttctgtgttttgggccagatgagtgaggggaccccagaagagggggactggcagttggggggcctctgagctgcaaaagacaggattttccccttttttccagctggccgccaagcactgccggaggccagtgatcaatgctggggatggggtcggagagcaccccacccaggccctgctggacatcttcaccatccgtgaggagctgggaactgtcaatggcatgacggtgagggtggtggcagggtttggatccctgccaggggacgatctagagagggaggcaggaagtggttaccccggtacaggacagctgcatcaaggaggccttcattctgctccagaggcttttaaaagcttggaaatgatgtcggggggcactcagtctgggatccctgtggtgactggattcctctcctagatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggtgagaccctcacagccctgcctggaagccatggagatgtgggttgggcagtcagagcccagcgctgcatccaccatggctctcctcaccctccaggaggaattcgagagcattgaggaggcgctgcctgacactgatgtgctctacatgactcgaatccagaaggaacgatttggctctacccaggagtacgaagctgtgagtgctgggcttgaggaagaagccagggctgctgccgtagggcatcagatatgaggacagaaaggctgggctgagggctgggtcagagctgttaaacttcacatctgtcaattgccatagctgcatgtgggtgtggaggggaccccagtggagcccagacttgtgtcctctgtagccactcctaccccaaggcactaatggggaccccatctgctttgcagtgctttggtcagttcatcctcactccccacatcatgacccgggccaagaagaagatggtggtgatgcacccgatgccccgtgtcaacgagataaggtggtgcagcatcagagtcagagactgcctcggggctggtggacgggaggagacttagtcctggacaagccatccatgggctgcacgataacacttcctttttttttttttttttttttgcagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 2371 - DNA, 13681 bp, Homo sapiens
  source 1..13681: mol_type = genomic DNA
acaggctccgggaccgcgctcgggggcgggtctatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcgggtaagagcctcgatttcccctcagtctcccgcccatcaccttgaatcttcagggtcattcttccctctcccacctccactcctctgacctttttgaccaagccttgctctttgatttcctctctgtcccgccccttcggtgatatcccaagttctcatccctgaaccccaggatgttcctagtcgctcccctcaattttcccggggcctcgccgtgagattttccccaccctgcctgcagagctctcactccctcttcccagttacgttgaacagccccttttttccttagccactcctcgcctttcttgaagggcgcacgttgtatccccagactgtcatgtctactgctccccttaggaagatggctttccttcttaaggttccaagtgcttttccttacagtgccttctctagcgtctaccttcttttgccttttgctgtgtaactcctgtccgcccacatcagcctgtctttactgaactgcccgctagttcatcctacgtgtatcagggactcttgtgctcatatcctagtgtttgtgttcagtgccgtcaacactgtcacctacgggccggctagaaaaggtgggaaaagtgagagtgagcattcttcagagacccagcaagtgcgaagtgcacacctgagagtttcctctcctcatgaggggatattgttgtgattgatgtctggagctgcatttctaaggagagcgcctccttcctcccccaaacacatgtccaatgattttctttaaaaaaaatttatttcacgtgagtataattgagcaattagcgcgccctagtgttatctaagtttccagtgtttcctttagtaattggcctttagtcactggtcgcaagctccttatatctttgtgacttttgttctgtaaggctttaggtgtatagctctgaacttttaggcagttcaaatgagaggtaagaaaaccatttcaaattcttctagaacaatagaagaaacatttttctatcgggctatttattcttaaagcattatttatgatcttacctgaggtactttctatattttgttcttttgctttgaaaattttatgtctttaaaggttgttttattttttgagacagggtctccctctgtaggccaggctggagtgcagtggcatgatcatagcttactgcagcctcaaactcctgggcttaagcaatcctgctacctcagcctccggagtagctaggaccacaggtgtacaccaccatgcctggctaatttaaaaaaaaattgtgtgtgtggagatgggggggtctcactatgtttcctaagctggtctggaacttctgggctcaagtgatccaccagccttggcttccaaaagtgctgggcttacaggattacaggtgtgagccattgtgcctggccttttttttaaaacaaaaacaaaaacaaaaccccagagtagtgtcttaaaactgctgaagtgcctactaatggctgcctgactacataaacagtagctttgggatatgccacaccctatgctcatagggcactggattcagaaatctaattttaaaatatagattttaaaaggctttactgattttatatttttaaccaaataagctaaggcaggcaatgcaatcatacatctgggatatattatccataaaaagttggtcttttcagcttgctccatctctgaatatctttcccagtttgtctactaatcttatctcctacccacaaagtttgggttatttcctctgcagaatattcattttgggtgatacattttgagggtgtagaggaagaatccagcttttttcttttttttgttttgagatggagtctcactctgtcgccaggcagatgcagatggagtgtagtggcgcagtgtctgcaacctcctccccccgggtttcaagtgattctcctgcctcagccagagtagctgggactataggcagctgggactacagacacacgccaccacacccagctaatttttgtatttttagtagagacggggtttcaccatgttggctaggatggtctcaatctcttgacctcatgatccgcccgcctcagcctcccaaagtgttgggattacaggcgtgagccacggcacctggccgaaaccagcttttctttaatgcagaatcggtatttatttattttgatgcagaggctgctgagttctagctgcaacagcatattttaaaacataaacatgtaaggtgtttgccagtatggaataaatacataaggcttttacatttcttttctcagaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttggtaagaaaagatctgtaaattattaactaacttaatggaaaatgcaaaatgttaataattatgagtgcttttgatcatagaagtcattgccagtattaatatctaccagatccatgtggctgtttgaagatatattattaactttgctattcatctcatagaatgaagtgttctggttaaatacagagcctaataattactgttggccctccatatcagttggttctgcaccctatgtggattcaaccaattgtggattgaaaatatttggatttagccgggcgtggtggtgcacgcctgtaatcccagttacttgggaggctgaggcaggagaatcgcttgaacccgggaggtggaggttgcagtgagccaggataacggcactgcactccagcctgggtgacagagtgagaccccgtctcaaaaatatatgtatgtgtatatatttgggggaaaaataacaatacaacaataacaaatagtaaataatacaaataaaaacagtataacaactatttacattgcattaggcataaaaaatctagaaatgatttaaagtatatgggaggaagtgagtaggttatatttactgtgccgttttacataagggacttgagcatctatggattttggtatcaggaggaacctggtaccagtcctctgctgatactgagggatgactgtactaaaacccatttttcattctacggacctttctcattgttttgcatacattaattcatctaatcctcattcttatgaacttggtattatgtgaatccattgggaaatgaagactcagagaggttaaaccatttgcccaaggtcacacagctactaagcggtgctaggattaaaccctggcagtttcagtccttaaccaaagggttaagtgctttacatatatatactgtatattatcaattttcaaataatttgaaatagtaaaatgcagttcctctggtcctgaatatgaggtaatcttcctatggttcagaagacatttcagcatttcctaatatatcataatgagtccattttggttgtaccatgatgtagtcattttgttttatagtatattaaagaatgcagaaaagcatagctcatagttcagtgtcttgctctgaggtttttccattcagtagacattttaagtatatgtaccaggcacataaatatccagataattaaagtttatatcattaagcaaaacagtttttgtaaatctttttttttttgaggtggagtttctttcgccaggctggagtgcagtgatgtgatcttggctcactgcaacctccacctcctgggttcaagcgattctcctgccttagcctcccgagtagctgggactacaggcatgtgccaacacgcacggctaattttttgtatttttagtagagatggggtttcaccgtgttagccaggatggtctccatctcctgacctcatgatccacccaactctgcctcccaaagtgctgggattacaggcatgagccgccgcacccagccaagcatttagttttgttgttgttgttgttttagagataggatcttgctatggtgtccaggctggactagaacttctgggctcaagcagtcctcctgcctcagccttctgcatagctggaagaatgccacgtattttgagtgctgggccttttctgtatgcttcctggatatcaattaattccctctgggtgaccgagatgttaccgcatctgtgttactgtgttaaacatctgtcaccatttaatactttaaataatttaaaagataagtttttatgagagaagacagttttggggacgctaaaagaatatgaaagaattgtatgacttgagaaacatattttatgttaggaaatcaaatattttattttcttcacccttctgcagaaaaaagattacttttaaccattaaaattactattttatgggaggctgaggcaggagaattgcttggactggggaggcaggggttgcagtgagctgagattgagccactgcactccagcctgggtgacagagcgagactccatcttaaaaaaaaaaagcaattgccaggcgcggtgtctcatacctgtaatcccagcatgttgggaggccgaggtgggtggatcacgaggtcaggagttctagaccatactggccaacatggtgaaaccctgtctctactaaaaatacaaaaattagccaggtgtggtggcgggcgcctgtaatcccatctactcagaaggctgaggcacgagcatcgcttgaatctgggaggtggatgttgccatgaaccaagatcgtgccactgcactcagcctgggtgacagaggaagactccgtctcaaaaaataataataacaacattttcttacagcttttgcttggaattttctagctgctgtttgatttattgtgatttgaatgattatgttggaaatatttaattttatcttctatcttcacagtccatatttgctccatttcttactttacaacttgcgtacatgggattatacaaatattttcccaaggtaaattaattttttttctaaatttcgatgatgtgtttggattgatttatgactagctaattgaaggaacttaaaaatgttagtcctgcttacggtctgaatcagtgctactcaaagtgtggtttgcccacttatctccaaactatgtgtttgtgtttgttatacattaagttcaaaaaatgagtaattggccgggcgcagtggctcacgcctgtaatccccacactctaagaggctgaggtgggtggatcacctgaggtcaggagttcaagaccagcctggccaacatggtgcaaccccatctctgctaaaaatacaaaaattagccaggtatggtgacgcacacctgtaattccagctactcaggaggctgaggcaggagagttgctccaacccaggaggcagaggttgcagtgagccaagattgcgccactgcactgctccagtctgggtgacagagtgagactctgtctccaaaaaaaaaaaaaaaaaaagagtaattagaaacttttatagcaatttgacattgccataacattgttattctgttttacaaaaatactgtggattgaggtccttcatgaaaaagtgtgaatagtacttgtttaagcaaagtattaaatttaattagtaaatttagtaattcattttgtctataataaaggaaattaattaaaaaatggatttgattatctcattgtacttcatattggacacttaatagcagtgcactttatcttcagtgttgagggcctgatatttgcaataaatatttggccaatattacagaacagaatgatgttgagagtcaatgtttacctggcctacttgactacagatatatacagttttatgaggcttggcttgcctgacatagacgatagcctaactagtgtgatcgaattttgtgggagctttttgctgaaaaaattgctacttggctgtctgcgtgttatatttaatgggctgacagacctgtgtatgattttaatggatttgaagcatttgtatttttgaagggtcaaataggtcaaatataagaagtaaaagagtaaataacattgtaattttaattaagcatttgtttagaaattcacctttgaggcggggcgcggtggctcacgcctgtaatcccagcacttagggaggctgaggcaggtggatcacgaggtcaagagatcgagagcatcctggctgacagggtgaaatcccatctctactaaaaatacaaaagttagccgggcgtggtggcaggcacctgtagtcccagctactcgggaggctgaggcaggagaatggcgtgaacctgggaggcggagcttgcagtgagccgagattgcgccactgtactccagcagcctgggcgacagagcgagactcctcaaaaaaaaaaaaaaaagaaagaaattcacctttgaggctgggcgccgtggctcacgccctaatcccagcactttcggaggctgaggggggtggatcacctgaggtcaggagctcgagactggcctggccaacatggcgaaaccccatctctactaaaaatataaaaattacccaggcatggttgcgggtgcctgtaatcccagctacttgggaggctgaggcagggagaatcacttgaaactgggaggtggaggttgcagtgagcccagactgtgccattgcactccagcctgggcaacagagcgagactgtctcaaaaaaaaaaaaagaaaatcacctttgaaacattgattgtagttttgcagtagcaaagtttggaacctaaatgtccactgagtgactacattaaaaaaaaaaaattggccaggcacggtggctcatgcctgtaatcccagcactttgggaggccgaggcgggcggatcagctgaggtcgggatttcgagaccagcctgaccaacatggagaaaccccgtctctactacaaattcaaaattagccaggcatggtggcgcatgcctgtaatcccagctactcaggaggctgaggcaggggaatcacttgaacccaggaggtggaggttgtggtgagccgagatcgcaccattgcacttcagcctgggcaacaaagcaaaactccatctcaaaaaaaaaaaaaaaaaaaaattataacgtatctattcagaatgaagatgctctcaatgtactgacaatggtaagctctccaagaaatattaagagaaaaaaaaacaaaattcagaatagaatctatagaatctatactaatttctttttgaaaagaaaaaataatgtattatttgattttgcttatatatgcataaacaaactgaaagactatacatgaaattattaacaatacttatgtgtgtgatagagatgtatatatgggtactatgtaaatggaagagagaaaagggagactttatatattctcccaacaaaacagcattttgttatagcagggttttttttgcttgtttgtttttgagacagagtatcactctgtcgcccaggctgaagtgcagtggcacgatctcagctcactgcagcctccgcctcctgtgttcattctcctgcctcagcctgccaagtagctgtgactacaggtgtgagtgaccacacccacttaatttttgtatttttagtagagacgaggtgtcaccgtgttggtcagtctggtctggaactcccagcctcaggtgatctgcccacctgggccttccaaagtgctgggattacaggtgtgagccactgcacctggcctgttatagcagtttttaaacacaaaagttggccaggcgtggtgcctcacgcctgtaatcccagcactttggaaggccatggtgggcagatcacctgaggctgggagttcttgaccaacctggccaacatggtgaaacgctatgtctgctgaaaatacaaaaattagcttggcatggtgggtacagacctgtaatcccagctactcagtgtctgaggcaggagaattgctgacccggtggcagaggtttacagtgagccaagacagcgccactgcactccagcctgggcgacagagcaagactccatctcaaaaataaataaacacaaaagttgaaagaattgtgccgtgaacacccatttatataataccaacgacctagattctacaattaacatcttattatattatgtatctatcaggttttcttttatttttcaaacccaagataatctctgtaaagtttttccatcaaatttttcttgatgcatttcaaagtatgttgtaggtgtacacatcggtatacctcacccctcttacataacactgacttacaatttactgttttaaggttctttaggtaattttttttttttgagacgaggcttgctctgtcacccaggctggagtgccatctcggctcactgcaagctccgccttccgggttcacaccattctcctacctcagcttcccaagtagctgggactacaggcgcccgccatcacggccggctaatttttttttgtatttttagtagagacggggtttcaccgtgttagccaggatggtctcgatctcctgacctcatgatccgcctgcctcggccccccaaagtgctgggattacaggcatgagccaccatgctcggcatttttttttttttttgagacggagtctcgctctgtcaccaggcaggagtgcagtggcacaatcttggctcactgcaacctccacctcccaggttcaagcgattcttccacctcagcctcccgaatagcggggactacaggcacacgccaccaagcccagctaatttttgtaattttagtagagacggggtttcaccatgctgaccaggatggtctctttctttttttttttttttgagatggagtcttgctctttcgccaggctggagtgcagtggcgagatctcagctcaccacaacctccgcctcccaggttcaagcgattcccctgcctcagcctcccaagtagctgggattacaggcatgtgccaccacacctggctaattttttttgtatttcagtagagacggggtttcaccatgttggccaagacagccttgatctcctgacctgattatctgcccacctcggcctcctaaagtgctagaattagctggtctctggtctctatctcttgaccttgtgattcgcccacctccgcttcccaaagtgctgggattacaggtgtgagccaccgcacctggcttttaggtaaaattttaaggtaaaattagttctgaggccgggtgcagtggttcacacctgtaatcccagcactttgggaggccgagatgggcggatcacctgaagtcaggagttcaagaccagtgtggccaacatggtgaaaccccatctctacaaaaatttgccgggcatgatggtgggtacctataatcccagctaccggggaggctgaggtgggagaatcgcttgaacccagaaggcggaggttgcagtgggccgagatcctgccattgcactccagcctggtcgacagagcaagactacgtctcaaacaaaaaaaattagttctaatatgaagagtagggtaccagcgtaattaattgattgcttgaaatgcttgtcttaattgtaccatttaatacgtttgttatcctatgaaacccatacctctttcaaggtttataacttcactgtcaccccaggagtttctttcatgctcctttccaggcagtcccagtccctataccccaaagaactttttcccacgatagattagttgtgtctggcatagtaatccatgtaagtgggatcattcttgattttacttttttgtgcaagccttctttattccgcatgatatttttgagatttatccatgttgttggataaatcagtagttaattcctttttttttcttggctcagtaatactacattgtatgactatatccatttatctagtctcctatagatggacatcctggttgttttcagttttggggttattatgactaaaactaagagctttcttgtatgaggctttttgtgagcataagctttcatttcttttaggtaactatagggttttttttttttttcagatggagctttgctctgtcacccaggctggagtgcagtggcacgatctcggctcactgcagcctctgcctcccagattcaagcaattctcctgcctcaggctcccaagtagcttggattacaggcatgtgccaccacgcctggctaatttttttgtatttttagtagagacgaggtttcaccatattggccaggctggtctcgaactcctgaccttgtgatccacccacctcgacctcccaaagtgctgggattacaggcatgagccgctgcacccggccaactataggtttttatatttaaaaatattttaaaccgtatgattggattttgtgataataaagaaaaattcagcttttaatctcttaaaaaaatgagactagaaaattaataagtaaatgttctctcttccaccagaagtatactgaattgttcagtgataccctattggatgtgtaatcaagtgtggattcctttgcataacaattagggccctacattcctataagtctgtgacaaattactcattgttctccaagcattcttctgcctctaacttgtcctgagacttaacgcttcaaaaaactttcacttctgccagtctaaatcctgctcttctttgaaggtctgtttttagttgttgtttttggagacgggggtctcactttgtcatgtgggctggagtgcggtggtgcagtctcagttcagtgcagcctcaacctcttaagagatcctcccacctcagcctcctgagtagatgggactacaggctcatgctcagctaatttttgtatttgttgtagagacagagtctccctatgttgcccagagtggtcttaaactcctaggctcaagccatcacccagcctcggcatcccaaagtgctgggattagaggcatgagccactgcacttggcctgaaggcctgtttttaattttacttcctctgaagtcctccttgtgctttatttacataaaacactggagtaatttatatctcctgtgagctcctatgtcacacattatccatgtcagtcatttagcagttatttatgtcctgtctagtaatatttttcttgtttttatattgtactgttgtatatatcataaattgttatttatgtcatacttccaagataacactttttaaaaacttctaataacaagactgggccaggtgcagtggctcacacctgtaatcctgacactttgggaggctgaggcgggcagatcacgagatcaggagtttgagaccagcctgaccaacatggtgaaatcctgtctctactaaaaatacaaaaattagccgggcatggtggcaagcacctgtaatcccggctactcaggaggctgaggcaggagaatcgcttgaacccgggaggcagaggttgcagtgagccgagatcgtgccattgcactccaacctgggcaacagagcgagactccatctcaaaaaaaaaaaaagcaagactgatgtctgctattgcctagcagattgatgagttacatattatatgctcagtaaatgttggtatcttactgattgttttgaaacatcattaacagtttttaaatcatttcggttaaaaacagcagtactgatcatgtttgtatagagcttaatgtagcctgctgaaactttgaagattaatttgagtctttctctacacagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaatta

SEQ ID NO: 2372 - DNA, 24124 bp, Homo sapiens
  source 1..24124: mol_type = genomic DNA
gctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttggtgagtacttccggagacccggctcctgggacggcttctggcgctgctcctgcacacacgactctccaacgatcattttccatgttttatttttatcttttaatttttgagatggagtctcactctgtcacccaggctggagtgcaatgatgcaatctcagcttactgcaacctctgcctcccaggttcaagtgattgtcctgcctcagcttctcaagtagctgggactacaggcacccgtcaccatgactggctaatttttgtattttcaatagagacgggtttccaccatgttggtcaggctagtctcaaactcctgacctcaggtgatctgcccgccttggcctcccaaagtgctgggattacaggcatgagccactggccccggcccattttccatttttcagatgacaggtgttgatttgctctgattttcaagtatttttagcatacagatccctgcaagaggcatctgtctccagtggtccagcctctccttccaaatgaaaagaatcaagtcacaggaattcatgggtctgtaaggaatcgctcccatctgtgcccaggagattaacaaaggcggtggctgcagctctgtgagcagtggagaaaaattaggcacaacctgatatcctcccacaggagcgtaagtccactgtggttattcatatcattgaatccagtgcacagtttaaaggaccatgcatgtatcaagctgcatgtatcagtatgagaaacctcagaagccgtacagccttgcacagaacgatagtttctgtgaagttccagctaacactgaaggcactgttgatgtaaagctgctgtctgcacgaagtatcatgcaaagatgctatgtactgtttatacacacttccatttgtaggaaatgatttttaaaatatcatttttaggctggactgtaatcccagcactttcagaggctgaggtagacagatcacctgagcccagaagttcgagaccagcctgagcaacatacggagattccatctctacaaaaattaaaaaagaagccaggcatggtggcgcatgcctgcggtctcagctacttgagaggctgaggtgggaggattgcttgggtctgggagctcaaggctgcagtgagccacgatcacgctactgcgttccagcctgggcaacagagtgagaccctacctcaaaaaaaatcatttttaaatgattttagaatgtctggccagagagggagggaagagggactgaagagaacaaaaaggcgccatctgcctcgcatttccttaaaaagaaacctgaagtgcagaatgtcaagatggttgaatccgcatggtagatatgtggatatttgttatttgcaggattttttaatatgctgaaaacagtgcacagttttaaaacattttaaaattatttagatggattaatgggctaatggcctcatgttgatgccagagaggggctcaggcaggggcacagtggggtacacagctcatctctcgctgggatgggaggctgggcaggtgacggctgaggacctccaacagctcttagagtctgcactagccagcatgtcccctgaagagcaggtgttccgggctgtaacggcgacctgcttcgtgtattctgtccagacagacctgggcttgggacatcagccctggtggtggccccagatcagctgcagctcagccctttcggggacctgtccaccctctgtctgcctcgccatctttgtaagcccacaccccccgcagccgagccgtgctggccgttactaccctgaagtgtcttctgcgaggcacttgtgcccagtgtcactccccagcacatttccctcatgtggagtcctctgcgcagtcctctgtgtcactgtcctgggccgctgcaaacaagggaccacctgctgcgtagttgaaaacaatgggaacttttttttttgtttttttagacagagtcttgctctgttgcccaggctggagtgcagtggcacgatctcggctctagagaagccgacagtcttgcttctaatgaaaattacctttcataaagaacttataaagcagcatttccaaagtgcagcacccctactgttatttgtttgtttgtttgtttgtttgtgtgtttgtttaccgggacagggtctccctctgtcacccaggctggagtgcagtggcacaatctcagctcaccacaacctctgtatcccaggctcaagtgatcctcctgcctcagcctcctaagtagctgggattgcaggtgcataccaccatgcctgactaatttttgtatttttagtagagacagggtttcaccatatttgccaggctggtctcgaactcttaggcttgagcaatccttcccccttcgcctctcaaagtgctgggattataggcgtgagccaatacgcctagcctactaccattattttagatgaatttctaaaaaaaaaaaaaagtatttatttactttaattttttagaaaaagctgtaactgacacaacaaagtgtgatttagtgactttattgcttaggattggggtagagcaggtggggccgtggcactcaaccttacacagagggagaaaccagaatggcaaatggccactggaatgcttcctctgccgtaaacatctcaagactgtgggttctgactggcaaagagtgcgccttgctaattttacgatggagttgattttaaaacggtgtcaccctggctatcctggggtcctgcttacctgacaactccacccccatggccacccctcctagggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccggtgagcgcagctccctcttccccacctcttccagcttcccgtggcccacatggctccactgtctgcctctgtcttcagggggtctcttctcgtcctgtctcttataaaaacacttgctgttgcctttagggcccacctggataaccaggatgatctgatcttgaaatcattaacttatatctgcaaaggcccttttcccaaaaaaggtcatctggacaggttccaggtggatgtgtctttgaaggggaaccaccattcacaccactacagctgtctttggagtccattctgatggtctgactagtgtttattcattaaaaaatggggatggtaatggctttactgtatacggttgttaggagaagcaaatgagttactgtttataaaacactcactgcaaagctggggccatagaaaacaggcagtaggtggtagctgtcaacatgataatgttcatgcatgttggcgtacgaaccccaaacacaggagagattgatgcacgctggtcattctggctgagagagatgggctctgggccctgggcgtggaaggccccgaggctctctgggacctgtcacccgcagccccggggtgccactctgctttctgtgcgcagctccaaagctgacagcaccgtggtgggaccctgcgtctgcatcacccaccagcttgccagggaggtgcttgcaagcagggacccacctcctcaccccgtcccggtccccccgcactcgccagagcactggggttgcagtagttgctcgatacatgccagctttgcccttctcgagtctgactgaggtcatgggggtaaagggagcctgtgagagcagtgagggcgcgtcccacccagcagaacccagaaaaccgctttcacctcccgattcttacatgtgcggggggtttcccagccccaggcctctcccccgtggggaagccagccagggagcccagcccccttggtagctgggttctgcccagacagacggttctgcctcccaagggcacttgctggatttgctgaagactcgagggaagaacggggccatcgccttcctggagagcctgaagttccacaaccctgacgtctacaccctggtcaccgggctgcagcctgatgttgacttcagtaactttagcggtgagagctccgactttgacggtttggcaggcacttctaggaacctcaggctcctggtaaccccaggtgccccgcttacttgccgatttgccctactcccccttccctccaggctgcagttcctgtcccagccccagcactctgagggtgaggaaccccctcactgtattggggttggataggataaggagcccctgggccttgactctgaagggtcggtccttagttacccagtgccaaaaggagacccctgagcggtagggtggggagaatctgcttggagagacacaagcaaagggcaagggagtgtctcctggagtccgcctttaaccttgcggctttgctggaggggccagaacggcccagcctcagctcttaggaggcgacagagcggccccggccagagggtacagggccttggcagggccgcggagccttctgtgcactgctcaccattttccttcagggagtaattctaggcttccctggaggagctgttgaaagatttaggtattgaaaggagcaggagcaggactcacacgacccaaaacagtggagaatagaccattttccctgtgttccagcacggtgtgtgtttatgttctttagagttctagtacgcggattcgtattctttttttatctttttctcaggataacgttaaaatgagttagcactgagtgcatttcagctaccgaggagggtcattaagtctgaacagtggggtctcacggggaaggtcagagtgggtaaccctcgtgccaaaatcgggagtcacgctgtttattcaaccaaaagaccaagtctgcttgaggtccaggagcttttaaggagaccagcaggttaaagctgggggcctgctggggagtctgggcaaggctgtgggggcatgggagtcatgcctcggcccaccggcccatctgtgcacctgcacacctgcccacatgcccacccgcccacatgctcagctgcccacatgctcacccgcccacatgctcacccgcccacatgctcacctgcccacatgctcacctgcccacctgctcacctgctcacctacccacctgcccacctattacctccctacctgctcacttgctcacctgcccatctgcccacaggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggaggtagggggacaccctgcaccccggcgcgaccctgctgtcgtctgcccccaggcctttgtactagctggtccatctccctggaactcctttcccctcttccttgtctaacacttccctgccccgagagccttggctgagacccctctgggaagctgatccttcccctccccaggaggccacccaggcccctctgtgtagcctgcatggcgacgaggtgtgccttgtccagtagctgcccgtggcctggctggcttgtctgtgaactgcccatcctgctgacgcctgggcaggtctggacacactctgggctgcatatttgtagggccgcctacgtcccactgcccagctgcggcagtgacatgggatagtcggcctctgtcatcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcggggagggcaggagggttctcaagtgaggcctctgaaactcagtgtgtttcactcacttttctttggggaggatgatctgactgattggtaaggcttctcaaaatactgaggatgtgcactccttgtcattttggcatttgctttttacctttattattattactattatttttaattttttagaggcactatctcgctctgtcaccaaggctggagtgcagtggtacaatcctagctcactacagccttaaactcctgagctcaagtgatccccagcctcccgagtagctgggactacagattgtaccaccatacccagctaattaaaaaaaaattttttttgaaatggggggttctcattatgttgcccaggctggtctcggactcttgggctcaagcgatcctcccacctcggcctccaaagtgctgggattacaggtgtgagcccctgcgctggccagcgctttgcctttaatcatgacatttgttgtttgtttttaattttttacttcttatttagaaataattccaaatatatatttttaaatcacacaaataaaaatagtacaaataatacccacctacccttgctttatcatttgtacttttactctctcgtggccctttatgtctacttcctgaaaatcagcacctgcccctatatagccacagtgcagttctcaacttcagtctttttggtatggacgccctgtttttatccaatccgcctgtgttctggttttctcatctgtcccagtgactccttcacagcctttcccccagcccagggtcgggccctgtgttctgctgttcctctctttagccaccttcatttgggaacagcccacagcctttctttgtctattatgaggtggccctctttaaagcccccaccccttccctttgatgatagacgacctctcatttggggtttgtcttgtgtttcccacatgtatacagaaattatgttctttggccgggaccctgcacagggggtgctggcctgactcagggcatctcctcgagggctctcgaggtcctgtcgcccctcacaggggacgtcacaccgtccaccatttgtcaaggtgcaggccaattgctctactgcagaatggctctttcttttcttccctgcaactgataaatatctcgggtgtggggcgctgagaccagcaagcaccctgctcctggtggacatttcccaggatgtagctgtggtgactctggcgggagctggcccctaccctgggagctgtgaatgacgaccgtgccagtgctccaccttgctgctgcccacggcctctgccttcccttctcccttggctgactttggaccaggccagcccactttgctgctgcccacggcctctgccttcccttctcccgtggctgactctgttcttggcgcagttcatgggttcctactctgcaggggtctgacctctcactgtccttaatgattttggtctcaaatggacccagatgtgaccaatggaacccttcaaccagctccgtgtcctaaaacgggtcccttgtttttggagaaccaactgcttttctggcctcacaagatattccagggtcatcttgtacccggcctaccccaaatccaggctcagcccattctctgagggccccacttcctttttttatttttattttttggtttgtttttttgagacagagtctcactcgcttcccaagctggagtgcagtggcgccatctcagcccactgcaatctccatctcccgggttcaagcaattctcctgcctcagcctcccgagcagctgggattataggcgcgcaccaccacacctggctaatttttcgtatttttagtagagacggggttttgccatgttggccaggctggtctcaaactcctgacctcaggtgatccgcccacctcggtctcccaaagtgctgggattacaggcatgagccaccacgcccggcctcctgcctccttttagagaacaagatgtgggcgtaggtgtgtccatcactactagggtgtctttgcttctcagccctttcaggggacagagctaggaaacacacacacatgtatggacatatacatacacatatgcacacacatacttgtctgtgtacacacacatactcatatgcatggaagtatacatatagttcacgtgcatacttcagaaatcatgggttctcacccatacctctaattccaacccatgccctgcggctttttcttgccttctcctgttccgtacgtgtgtgctccttccccagggggaacgctgctcccagcgtcaccagcaccttcagacccgtgctcagtcctgcagcacatctcaaatcgtttcagaatcactctgcccataccactgccattaacagccccgctaagacgggtgccggacttgtttgtaattcacctccccccgccagccaatcttgctcaaggctgagggtttgtaatcaaacactgtgtttgtgagtcactgtatcttcgttctctctgtccttgtctgtctgtctctctcttcgttgtggttatggcgtctgttggaaatagaattcggttcatttgttctggttcactttcagtctcatgttttccggttcccttccagctctgacttgattttactttttgaatctgtggacggtgacatgcccagcccagctggaccattgcaggagctgggaacttgcgaattgacaatgtgctaaccgggtgtcgggaggggagagtccaggtggaaaggtccttcttggccacagcccaggggtgagcaccggcacccaccccgacgtgcagacttcccgggcttgcctcacggggaaagtcctgcctccccagggctgccacacccaggacgggaagagggcgggcccgtggctcgagctccaagtttctcttgggctgctgtccagaggaaggaggccagcaggacctggtgggatagtccctggaaggccagggccctgcacacagactgcaagtcaacacaggagctttgctgtctgaacagccccggtcccgcgttcccaggcacgtctacccctccgacctgactttcctctctcttacttcttactgatttccatgactccaaattccctttcttgatgtatttagcagaacatggacaagcagggaagccagggagcatgctggccatcactgccggctgctcagctgtagagatccaggagttggttatcaaggcctcttggtctattcctgggaccctaaccctggatggagttcaaccgcggtgcctcatctataagacagagctgaaaggcctctgtcctcccagccccagttgaatatttgggactattcattaggtgaaccctttcgtgggtttttcagtctcgaggcaggaagccccctgagtgctaaaagcatcattaggaggaagggtgagaaatgcccccagctcctgatcaggggagaagctgtttccatcgcccttcctgtcgcctccccaccgcacagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggtaggttccggtccccgcagcagagagcggcctcctgccttgggggcttggccctcaggctgtggggtttctgacaggtggtttagttaaggtgaggctaagaacaagagatgaaatttagtgactcatctcacccactttctctttacctccttccttcctgctgttccccagaccccaaaattggcagaattaaaagctgctggaacagaattaaaagctggaactgggcacagtggctcattcctgtaatcccagcacttgggaggccaagatgggcaagatagcttgagctcaggagttcaagaccagcctgggcaacatggcgagaccccatctctacaaaaaatacaaaaagtagccgggcatggtggtgcacacctgtggtcccagctattcgggaggctgaggtgggaggatcgcttgaccctgggagtttcaggctgcagggagctgagatcacgccactgcactccagcctggcgacagagggagaccctgtctcaaacaaacaaaaataaaagccgctggaggtgcatcacaatgcccgacttggtgggtttactgcagcgactgtgttctggagtggacttggccaattgtaaagcatgggattcgcgttaaggatgggggaaagaaacctttctgcctggaaagactccgccctctgggcctcaggtgcactggagagaggggggctctgaagtggagcagtgagtgagcaacgacccttggcgtctcctcctcggcccctctcagtagattggtatttattgagatattccttccataagcattcactgggcccagggcactggccatcttgcagcccggattgtgtctctgtttataagctccttcctgggaagtgagtgtcagaggggaatgacctgtctgctggtttctccctcgctgtgaaactgccggtagatctgttgaaggagaaggctgacctggtaaagggaggaactggtgtcctcagaggttgccagcttcctgtgttccttctccttggccatgaatctgcacttttcccaggcatgatgggtggcttttccgtggcttctctcctgcccggtgtagagtggcaagactgcatccgtccacacacctgaccgtgcagttgccgccatcttctcgggattctgcttgcctagggcaggcctctggggaagccagcaccccaggctgacctctctctgccccaggcggagaaggacattctggagcagagcctggacgaggcgcgggggagccgacaggagctggtggagcgcatccactcgctgcgggagcgggccgtggctgccgagaggcagcgagagcaggtgccgtgtgagcccttcctcccttgtgactctcctggggcttgtctcaggggtgcggacaggtctgtggggaagccagattccttcatccacgccgagctcacataattttgctgaacgaatctgtcggcctgttcatctgtccctttgtcagcgccaccctaagcaccgactcgcaccccacagctaagaccatggtcaggcagatgcgtgattcaaacgcaggggatttcagggcccaggccccggggagagccagggacttaggtgaggagggaacggggaggaaaggagacggtagaagagaagaggacagggagggaaaattgtttttctgggacattaaaaacgcaaaacacaactatgcatgcaacatcccctcattgttttaattcagacgtaatcagcctaagcaactttctagatgcacctcgaaatctagcacttaagagacgagcgaggccgggcgcggtggcccacgcatgtagtcagcactttggaaggccgaggcaggcggatcacttgaggtcaggagttccagaccagcctggccaatatagtgaaaccctgtctctactaaaaatacaaaaattagctgggcctggtggtgtgtgcctgtaatcccagctactagggagactgaggcacgagaatcgcttgaacccgggaagcagaggttgcagcgagccgagattgcgccattgcactccagccttggcatcgcagcgagtctctgtctcaaaaaaaaaaaaaaaaagagagagagagacgagtgagaattgaccttatttcatccctagaactgtctccctccctccacccctgggttccccgacccccttctaaggccagaccctcagagctgctgagcttcacggtccatgtgtcccactctgtccagtactgggaagagaaggaacagaccctgctgcagttccagaagagtaagatggcctgccaactctacagggagaaggtgaatgcgctgcaggcccaggtgtgcgagctgcagaaggagcgagaccaggtacctgagaggccgggcccaccccgccaccccatgcttgcttccccaggtgagggctggttccggggacagtctcgtggctccctgcccttgatggcagctggtcccagatttcagggtctctttcctcggtccacacgaagtttcttcactcctccaggcctgttgtccacatgctgtctctatcatccttcttgctcttattcctggtacatgacactgagaaagtacaccccaaatactgggttttatcaacactgcacatgtgaacacgaattgaaatgaatcttaagtttgcacagctcagcgtgggccatttagtggatgtcagatgagcgcaggctagaaacagggctctccttctctagctgaggctccccggtggtgatggcgcggcctccttactcccgtcgtggcccacaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtggtgagtgttcccggctgacccgagctggaggccaggcaggggctgcggtgacagtgggacagagctgggctccagggtggcccatggaggcactgggaggacaggcagggtcccaggctgggccacacgcggcacctgcagagacggcccagtgtcactgtgatgagcgacacactggctcccacgcgtggatggtgccgtgaaacctcgaaggtgcccagtagacaagtagagtctgcctccatatcatcgaatggggagcttagcggaaggttctggaacctgtggagtgtggtgatggatgtggcaggtggcgtttgaagctgtccacaggcagccatttgcagtgtagatgctgtgttcctgaaatgcttaaaagcccagcgtccaagagtggaaagacagacctacatgtaacggagggagcgtgttcccagaaagccagaattcttagaaagcctctcattctgggctggcaggcagctccagctccaggcccccggggaggcaaaggagctcctccctccgcatgcggaacccacccggcccttccttccttaccccctgcatggcaagcatcccacaccgacggtggaaacacacgtgtgcacgcagagaaaaaccctcccggggcaggcaccaacacgcaggctgtgctcattctgggtgtgagatgacgggtggattttattttcttctctaactggttctacttgccttcctccaattttctgtgtgtgtatgtatgtgtgtgtattatacattattcgtaaaactagtaaatcacacatattctaaaagaaatgaaatgctgtgtgtccagctggtttctttcagtctctttgattggcagcgcctgtgatcctgtgatgggctcggaggacagggacacaattgttttccctggaagctgacgagaggaaactgctggggagggtgaaatgggtggtgctgacctggtagaaactccacgggcctcaaagcggaacctttcccgaattaaccagcctgtctggcctgtctttggcagctcaagcaggaagccaggaccagggagccctgtccacgggagaagcagcggctggtgcggatgcatgccatctgccccagagacgacagcgactgcagcctcgtcagctccacagaggtacggccgctcctcccgcctccctcactgccttgaccctctgggccagcccaggggcctctctgtcaggacgaaagtgagcctccttccaccctgtccccacagggaagaggttggtacgattgtgagagttttattttattttattttttgagacagagtctcctctgtcacccaggctggagtgcagtgatgtgatttcggctcactgcaacctccacctcccaggttcaagcgattctcttgcctcagccacccaagtagctgcattacagacacctgccaccatgcccagctaatttttgtgtttttagtagagagggtttcaacatgttggccaggctggtcttgaactcctgacctcaaatgatctgccagcctcagcctcccaaagtgctgggattacaggcatgagccaccgcacctggccctattgcgagagttttaaacatcagaggttgattctgtcacagtcctggagcccagacatccaaagtcaaagtgctgacagggtacccgtctggaaatcctattcccaaagaaggtcacattcacagcttgcagggtggacatgagtttccaggggaaccgattcaacctggcacagacagtccccagacatgagtttccaggggattcaacctggcacagacagtccccagacatgagtttccaggggacccaattcgacctggcacagacagtccccagacatgagtttccaggggacccgattcgacctggcacagacagtccccagacatgagtttccaggggacccgattcaacctggcacacatggtccctgggatgccggcctcactgtggtttctggagcctcaggaccctggcatctgtcctcaccctttggcaaagtaaagaggtggtcccaccatagtgggcatgtggcatgaggatgctgggggtcaaagccccagtgccacaggatgccgggagccgggagggagggagggtgagaggcgggcgaggctgacatccctttgccatgccttggggtggacctggtgtttccttcctggaccatcccatcagtggcccaagagcagcaggcccaggctcacctgccccctggccactcagagagctgggggaggccgggatcttccccagaacactgagtgcacacacggggaagatttcacagtcggtgctgggcctccctgggccaggacagtccaaaccttcaactgaatcgactctcgcatctgccttaacgccctctgtgcccccattccccacaggacagaggccagccgtgtttcccttccccaggggtggattgggtcagggagggaagggacctcaggtgctcagaactggctcgccagaacacaccatcctcattcaccagcctcgtgggcaactgaccgatcagctgccctccagccactctcctcctgccccggctttctaatctggctgctctagggggactgcctcctacttcatgggctctctgcgtgccactgctctgttgctctctctgtctggaatgtgccccctgcccccaacacacacacactccacctcactcctctgtccatgccacttcctccagagagtccgccctggcctccctgccctgcccatgtcgcccacagccctggaatgcctcactccacctcactggtccacgggtgcccgttggttcccccaccccaaggacagtccctgtcctcagatgtacatctgacactgtcaaaggacctggcacatagtagctactccaggaatacttattagtgaaagaaggggcgggattcagacctaccccacacatctggtggcctcagcgcctcgcacgtcacatttgtcagtgtgcactctgagtgcggcctcccctccctagtcactaactcaacctctctgggcctcagttgctttgtgcattagttcgttctcatgctggtgatacccacatacctgagactgggtaatttacaaagaaagaagtttaattgactcacagttcacagttcagcatggctggggaggcctcaggaaacttacaatcatggcagaaggcacctcttcgcagagcggcaggagagagaatgagtgctcagcaaagggggaagccctttataaaaccatcagatcttgtgagaactcagtcactctcacgagaacagcatgggggaaacggaccccatgattcagttatctccacctggtcccacctttgacatgtggggattattacaattcaaggcgagatttgagtgggaacacacggccaaactatatcactttacatgtaaaatgggacagcagtgccaccttacagatttatcgtgagaactaagccaagcagctaatagagcctgacatacagcatgtgtcagtgctgtgtgctaattgcatgtgaccccagtgtctggcatacagcaggtgctcagcgcatgtgaccccatgtgtgtccttctttcccctcctgcctcctctccagtcagttctcactgtggctctctctacaccgtgggggagcaagggaggagtctcagggtgtcctcgtgcgtgccccactgacttctgccctccctcctccagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcaggtagagcactggggtccttcctggcactggggtggcactggggtccttcctggcaactcaccagagacaccaacctagacctcagggcatctgggtattgcaggcagcagctcctgccctcgaagccccagagctggcaggtgctgggggccagtgcttggggcgtggggactcagagggagcaggtgatgcagtttgagcctgctgctgcttatgctttgcagcagctgcctggagatcccggagggagacccgggagccctgccgggagctaaggcaggcgacccacacctggattatgagctcctagacacggcaggtgagcacgcccaaccctgaacctccacagcagtccacctcccctgggcagagcagggagctgatgagaaagccggggcctctctccagggaaagggcagatagaagcagagctcaacttctgccctgggccttgaccttggcctcgaccttgcactttgggaaagtcccgcctgccagccagcgtaagccaaaggccggctgcgctctgtctgctggtgtccttgtgtttttccctagagccaggggagttgtgtctgatccacgccctgctcagcacccagccccctgctctgatctgtaacgcttgggcttcccagtggtttcagaaggcagcaggcagggtggcttagtggtgccaggctgaggcgaggcacagcgtgacatctacctgcggggagcatctctcctctcaggcgctggccctgaggcctcgcgcttctcctgtagctcatttctgtttgtgattggaccggccctctctgcttcccaagtccatgggcccgtcatgggtgggtgccttaatcctttccacctcggcgcgaccggctcccagccttgggccttgcacacagtaggtgctttgctccccatttggaattcaccccatggccaccagggggcgcaagtgccctgcgctgcccctgtgccttctgtgggtcgcagaatcagaaatcttcatctttggggactcatacacgtttttatttataatcgtgataaatcgagagagaccacccaaggcatatctaaattagatgtgagatgagaagaggggcttattcctctttatttttcctctgtgaggattctgcgtaatgccctggttgcatatacttttagtggaattgacctcaaatacatccagagtacacagctcatttcattggctttgaatgtgatcccaatgggtttttgcctgtgagccaggcctagggaactctcaggtctctgctggccctggctctgctgtgtggttcacagagtgagacttgcagccgtcgaccctggcaggctgctccctggttcgggggctcacaggctgtacagtaaaatgctagagcttgggagaccctggggagcctctagtcctaggattgacaactcagagacctgccaccaccagctgggaagcagaggagtctggggtaaggagcaggcagctgctggccagtgccagtgattgcggccacacagaaatgcaggcctgtgtggaaatgcaggccagtgtggaaatgcaggccagtgtggaaatgccgtgtagtacagtagtgcaggtctgggtagaaatgcaggtccatgtttgggaggtcaaggtgggcggatcatgagctcaagagatcgagaccatcttggccaacatggtgaaacctcgtctctactaaaaatacaaaagtcagctgggcatggtggcacacacctgtagtcccagttagtcaggaggctgaggcaggagaatcacttgaacctgggaggtggaggttgcagtgagccaagatcgcaccactgcactccagcctggcgacagagcgagactcagtctcaacaacaataacaacaacaacaaaagaaatacagatccatgtagaaaggcaggccagggccgggtgtggtggctcatgcctgtaatcccagcactttgggaggccaaagtgggtggatcatgaggtcaggagttcgagaccagcctggtcaacatggtgaactcccgtatctactaaaaatacaaaaattatctgggcgtggtggcacatgcctctagtcccagctactcaggaggctgaggcagaagaattgcttgaacccgggaggcggaggttgcagtgagctgagatcacggcactgtactccagcctgggcgacagagtgagactctgtctcaaaaaaaaaaaaaagaaagaaagaaagaaagaaagacaggccagtgcagtgcaggcccacgcagacatggaggtcaatgcagtaatgcaggccagtcctgaaatgcaggtccatgcagaaatacaggtcagtgcggaaatgcagccccagggttacagcagatattttttcaagtgaagccagaaatccagattttaggtgaaacctccctgtctttcaaatgttggcaactcattcaaatatcacaaaatagcatgtggtggtcagaccctcccagttgcagctcctcactagttacagtgattttaggaaagatgaaatcaaggtcccaagcattgaggaaggggtggaggaagagaaagttcagcctcagcacaaaggatggaacaggcagtggggcctgaggctgagggagaaggggctgaggttacaggaggttacaggacgccccatcagcagtggggtgaccaagatctgtgaagaaggggctgaggttacaggaggttacaggacgccccatcagcagtggggtgaccaagatctgtgagctcttggcttcctcccagaccttccgcagctggaaagcagcctgcagccagtctcccctggaaggcttgatgtctcggagaggtaagcagcaggtgggaatcctccgaggctggctggggaaccagggccagggagtggcagagcagagggtgagtgtcctattaccaatgggaggcaacagcctttccaagcacatggggccatggagggggaggagaattccagaacactggggccagagggaagcaatggggaggtggccttgccggctctcctgctctgggcagtgcacaagccggtcgtctcccggcctgcagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggtgagccgtgcgaggcccctcctgtcccccgggctcctcatggggacagtggcagcgggtggggtgacccaggcagacttcacctcccccagacgatgcagatccactctgggctgggcctctgctctttcctgggctgacgtaaagcgttctgctcatttatagatgagagtcgtgccgtgcagaacccagcatgtcacccgtggtgctgctgccatgcggcgcttctgaccaggggtctttgcatgaggccccttgacagggctgctctgggtggtcactttgggtgtgtacagtaaaatacacgtgacataaaattcactattttaaccactggggcatttcttttctttctttttttttgtttgttgttttgaaacagggtctcactctgtcacccaggctagagtgctgcggtgcgatcacagctcactgcagcctcgacctccccaggctcgattgatcctcccacctcagcctcttaagtagctgggaccagaccacaagcatgcgctaccgtgcccggctaatttggggacattttctaaaacttttttttgttgttgttacgaaacgcacaaaactgctgagaagataaatggacacaaatatacaacctggccaggtgtggtggctcacgcctgtaatcccagcagaaggctgaggcaggcagatcacttgaggtcagaagttcaagaccagcctggccaacacggcgaaaccccgtctctactaaaaatgcaaaaattagccaggtgtggtggtgggcgcctgcatggtcagggggtgactttgatgtggcctaaaagcagaattattaaactttaggaaaaaaaaaaacttctgggcacagtggtacatgcctgtagtcctagctactcagatgcctgagcccaggagattgaggctgcaatgagctaagattgcaccactgcactcgagcctgggtgacagagcaaagccttgtctcaaaaaaaaaaaaaaaaaaaagaaaagaaaaaaaaaggccaggcacggtggcttatgcctgtaatcccagcactttgggaggctggagcaggcagatcacctgaggttaggagtttgagaccagcctggacaacatggtgaaaccccgtttctactaaaaatacaaaaaaaaaaaaaaaatagctggtatctataatcccagctactcaggaggctgaggcaggagaatcacttgaacctgggaggcggaggttgcagtgagctgagatggtgccactgcactccagcctgggtgacagagtgagactcggtctcaaaaaagaaaaaaagaaaagaaaaaggaaagcacagtgctttcttaatatgaaaaaaattttaaaccaagaaatgtgcaagatgggcttcacctcattccagaggctcaccctgcggcctccaggaggggactggggatgggggctctggggtgggaaggtgagcacagaggcggggagaggatgcgtctgaacccctcaggcaggagtgttccatgcacccctcactgcccccttggaacaggctgtccaaatgctgagctcccctagggctccaatgatagcacatggagcacctaattcaagcgtccttcacgtcctccacatgacccgggaagcctttctttacatgtcatttttttttttttttttttttttttgagacagagtcttgctctgtcgcccaggctggagtgcagtggctcgatcttggcccactgcaacctccaccccctgggttcaagcgattctcttgcctcagcctcccatgtagctgggattacaggtgcccgccaccacacccggctaacttttgtatttttagtagagacagggcttcaccatgttggccaggctgatctcgaactcctgacctcaagtgatccacccacctcagcctcctaaagtgctgggattacaggcatcagccaccatgcccagcccttctttacatttctagttgtcctcttaagcagcagtccccaacctttttggcaccagagaccggcttcatggaagacaacttttccacagaccgggttgtgggggatggttttgggatgattcaagcacgttacattgattgtacactttatttctattattattacactgtaatatgtaatgaaagaatcatacactgaaccataattcagaatcagtgggagccctgagcttgttttcctgcaactagacggtcccatctgggggtgatgggagacggtaacagatcatcaggaattagattctcataaggagcgtgaaacctagatccctcacttgcacagttcacgatagggctcatgctcctctgagaatctactgctgtgctgagctgacaggaggtggagctgaggccgtaatgctcacttgcccaccacgcccctcctgctgtgtgacccgggtcctgatggaccatggaccagtaccagtatgtggcccaggggttggggaaccctgctcttaaggttcccaattatcagctctgaggtagttcaagcaacagagccccttgacgatgttcagggagatagtcccgatatcctaagggggccaattagattctaatggtgttaaaacacatcttaatttttattgtaaaaatatctactctcctaagcttagaacaatattgagaagaaatgaagtggatggtggaagccctggggggtgggccttcacagtggggaaggctgtgggtggagagccagggcatcgggtaggtgaaggccagggatgccactcagcatcctgtagggcccggtatagcccgcagcagcacagaatgatcccaaggctaagaaacctctatctagaatgctcttgaatgttctagaaccgaggttctttcttttcttttcttttctttttcaagacaggaaagtgcttatcacaaagaacccccgatctcgactggggaagggttggcagttgactctctggccagcactatgtgtagcacgcatcactagaggtgtgaaggccccacagaggctctggtgtgtggctttgttttgaccaaggcgtgcaggcagtggtcctacggcagggctggcccgcgcctcgcctcagtgccctcagcgccttctgtcttctggctggattcagagtcccgggggaaagagactgaccttctcgacttgccctcaggttgattacgaagcctcagagcccttgttcaaggcagtcctggaggacacgaccctggaggaggccgtggggcttctcaggagggtggacggcttctgctgcctgtctgtgaaggtcaacacggacggtacacataccactcctctcgtgtgcacagctgcctggccagactccatgacccttaagtccctggtggttcttctgcacgcccagcagccagggacccccagagccaagagaggatcagccaggctgtgccccaggtccccaggaggcccccaagccagctggaaacctcccacccactgactccagtgccagagcagcttctgagactgggagggtccttccttctctcctactttaattttctgcaaccttcctcgcagaggctcgtatctgtggctcatctgtggctcatgtccccttttatcaggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccaggtgagcagctgcctcgagctcggtgcgtccccagagaggcccacagggaaatggcacccagcctgcctcggcttcctcctcctgcccagcaatagagggtgggcgtggtgagacccccctaaggagggaagcctgccaagatcactgctgaagatgttgtttctttgtgatggatgctttatatattgcaaatgaaatgttcattctagaa

SEQ ID NO: 2373 - DNA, 30824 bp, Homo sapiens
  source 1..30824: mol_type = genomic DNA
gctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttggtgagtacttccggagacccggctcctgggacggcttctggcgctgctcctgcacacacgactctccaacgatcattttccatgttttatttttatcttttaatttttgagatggagtctcactctgtcacccaggctggagtgcaatgatgcaatctcagcttactgcaacctctgcctcccaggttcaagtgattgtcctgcctcagcttctcaagtagctgggactacaggcacccgtcaccatgactggctaatttttgtattttcaatagagacgggtttccaccatgttggtcaggctagtctcaaactcctgacctcaggtgatctgcccgccttggcctcccaaagtgctgggattacaggcatgagccactggccccggcccattttccatttttcagatgacaggtgttgatttgctctgattttcaagtatttttagcatacagatccctgcaagaggcatctgtctccagtggtccagcctctccttccaaatgaaaagaatcaagtcacaggaattcatgggtctgtaaggaatcgctcccatctgtgcccaggagattaacaaaggcggtggctgcagctctgtgagcagtggagaaaaattaggcacaacctgatatcctcccacaggagcgtaagtccactgtggttattcatatcattgaatccagtgcacagtttaaaggaccatgcatgtatcaagctgcatgtatcagtatgagaaacctcagaagccgtacagccttgcacagaacgatagtttctgtgaagttccagctaacactgaaggcactgttgatgtaaagctgctgtctgcacgaagtatcatgcaaagatgctatgtactgtttatacacacttccatttgtaggaaatgatttttaaaatatcatttttaggctggactgtaatcccagcactttcagaggctgaggtagacagatcacctgagcccagaagttcgagaccagcctgagcaacatacggagattccatctctacaaaaattaaaaaagaagccaggcatggtggcgcatgcctgcggtctcagctacttgagaggctgaggtgggaggattgcttgggtctgggagctcaaggctgcagtgagccacgatcacgctactgcgttccagcctgggcaacagagtgagaccctacctcaaaaaaaatcatttttaaatgattttagaatgtctggccagagagggagggaagagggactgaagagaacaaaaaggcgccatctgcctcgcatttccttaaaaagaaacctgaagtgcagaatgtcaagatggttgaatccgcatggtagatatgtggatatttgttatttgcaggattttttaatatgctgaaaacagtgcacagttttaaaacattttaaaattatttagatggattaatgggctaatggcctcatgttgatgccagagaggggctcaggcaggggcacagtggggtacacagctcatctctcgctgggatgggaggctgggcaggtgacggctgaggacctccaacagctcttagagtctgcactagccagcatgtcccctgaagagcaggtgttccgggctgtaacggcgacctgcttcgtgtattctgtccagacagacctgggcttgggacatcagccctggtggtggccccagatcagctgcagctcagccctttcggggacctgtccaccctctgtctgcctcgccatctttgtaagcccacaccccccgcagccgagccgtgctggccgttactaccctgaagtgtcttctgcgaggcacttgtgcccagtgtcactccccagcacatttccctcatgtggagtcctctgcgcagtcctctgtgtcactgtcctgggccgctgcaaacaagggaccacctgctgcgtagttgaaaacaatgggaacttttttttttgtttttttagacagagtcttgctctgttgcccaggctggagtgcagtggcacgatctcggctctagagaagccgacagtcttgcttctaatgaaaattacctttcataaagaacttataaagcagcatttccaaagtgcagcacccctactgttatttgtttgtttgtttgtttgtttgtgtgtttgtttaccgggacagggtctccctctgtcacccaggctggagtgcagtggcacaatctcagctcaccacaacctctgtatcccaggctcaagtgatcctcctgcctcagcctcctaagtagctgggattgcaggtgcataccaccatgcctgactaatttttgtatttttagtagagacagggtttcaccatatttgccaggctggtctcgaactcttaggcttgagcaatccttcccccttcgcctctcaaagtgctgggattataggcgtgagccaatacgcctagcctactaccattattttagatgaatttctaaaaaaaaaaaaaagtatttatttactttaattttttagaaaaagctgtaactgacacaacaaagtgtgatttagtgactttattgcttaggattggggtagagcaggtggggccgtggcactcaaccttacacagagggagaaaccagaatggcaaatggccactggaatgcttcctctgccgtaaacatctcaagactgtgggttctgactggcaaagagtgcgccttgctaattttacgatggagttgattttaaaacggtgtcaccctggctatcctggggtcctgcttacctgacaactccacccccatggccacccctcctagggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccggtgagcgcagctccctcttccccacctcttccagcttcccgtggcccacatggctccactgtctgcctctgtcttcagggggtctcttctcgtcctgtctcttataaaaacacttgctgttgcctttagggcccacctggataaccaggatgatctgatcttgaaatcattaacttatatctgcaaaggcccttttcccaaaaaaggtcatctggacaggttccaggtggatgtgtctttgaaggggaaccaccattcacaccactacagctgtctttggagtccattctgatggtctgactagtgtttattcattaaaaaatggggatggtaatggctttactgtatacggttgttaggagaagcaaatgagttactgtttataaaacactcactgcaaagctggggccatagaaaacaggcagtaggtggtagctgtcaacatgataatgttcatgcatgttggcgtacgaaccccaaacacaggagagattgatgcacgctggtcattctggctgagagagatgggctctgggccctgggcgtggaaggccccgaggctctctgggacctgtcacccgcagccccggggtgccactctgctttctgtgcgcagctccaaagctgacagcaccgtggtgggaccctgcgtctgcatcacccaccagcttgccagggaggtgcttgcaagcagggacccacctcctcaccccgtcccggtccccccgcactcgccagagcactggggttgcagtagttgctcgatacatgccagctttgcccttctcgagtctgactgaggtcatgggggtaaagggagcctgtgagagcagtgagggcgcgtcccacccagcagaacccagaaaaccgctttcacctcccgattcttacatgtgcggggggtttcccagccccaggcctctcccccgtggggaagccagccagggagcccagcccccttggtagctgggttctgcccagacagacggttctgcctcccaagggcacttgctggatttgctgaagactcgagggaagaacggggccatcgccttcctggagagcctgaagttccacaaccctgacgtctacaccctggtcaccgggctgcagcctgatgttgacttcagtaactttagcggtgagagctccgactttgacggtttggcaggcacttctaggaacctcaggctcctggtaaccccaggtgccccgcttacttgccgatttgccctactcccccttccctccaggctgcagttcctgtcccagccccagcactctgagggtgaggaaccccctcactgtattggggttggataggataaggagcccctgggccttgactctgaagggtcggtccttagttacccagtgccaaaaggagacccctgagcggtagggtggggagaatctgcttggagagacacaagcaaagggcaagggagtgtctcctggagtccgcctttaaccttgcggctttgctggaggggccagaacggcccagcctcagctcttaggaggcgacagagcggccccggccagagggtacagggccttggcagggccgcggagccttctgtgcactgctcaccattttccttcagggagtaattctaggcttccctggaggagctgttgaaagatttaggtattgaaaggagcaggagcaggactcacacgacccaaaacagtggagaatagaccattttccctgtgttccagcacggtgtgtgtttatgttctttagagttctagtacgcggattcgtattctttttttatctttttctcaggataacgttaaaatgagttagcactgagtgcatttcagctaccgaggagggtcattaagtctgaacagtggggtctcacggggaaggtcagagtgggtaaccctcgtgccaaaatcgggagtcacgctgtttattcaaccaaaagaccaagtctgcttgaggtccaggagcttttaaggagaccagcaggttaaagctgggggcctgctggggagtctgggcaaggctgtgggggcatgggagtcatgcctcggcccaccggcccatctgtgcacctgcacacctgcccacatgcccacccgcccacatgctcagctgcccacatgctcacccgcccacatgctcacccgcccacatgctcacctgcccacatgctcacctgcccacctgctcacctgctcacctacccacctgcccacctattacctccctacctgctcacttgctcacctgcccatctgcccacaggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggaggtagggggacaccctgcaccccggcgcgaccctgctgtcgtctgcccccaggcctttgtactagctggtccatctccctggaactcctttcccctcttccttgtctaacacttccctgccccgagagccttggctgagacccctctgggaagctgatccttcccctccccaggaggccacccaggcccctctgtgtagcctgcatggcgacgaggtgtgccttgtccagtagctgcccgtggcctggctggcttgtctgtgaactgcccatcctgctgacgcctgggcaggtctggacacactctgggctgcatatttgtagggccgcctacgtcccactgcccagctgcggcagtgacatgggatagtcggcctctgtcatcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcggggagggcaggagggttctcaagtgaggcctctgaaactcagtgtgtttcactcacttttctttggggaggatgatctgactgattggtaaggcttctcaaaatactgaggatgtgcactccttgtcattttggcatttgctttttacctttattattattactattatttttaattttttagaggcactatctcgctctgtcaccaaggctggagtgcagtggtacaatcctagctcactacagccttaaactcctgagctcaagtgatccccagcctcccgagtagctgggactacagattgtaccaccatacccagctaattaaaaaaaaattttttttgaaatggggggttctcattatgttgcccaggctggtctcggactcttgggctcaagcgatcctcccacctcggcctccaaagtgctgggattacaggtgtgagcccctgcgctggccagcgctttgcctttaatcatgacatttgttgtttgtttttaattttttacttcttatttagaaataattccaaatatatatttttaaatcacacaaataaaaatagtacaaataatacccacctacccttgctttatcatttgtacttttactctctcgtggccctttatgtctacttcctgaaaatcagcacctgcccctatatagccacagtgcagttctcaacttcagtctttttggtatggacgccctgtttttatccaatccgcctgtgttctggttttctcatctgtcccagtgactccttcacagcctttcccccagcccagggtcgggccctgtgttctgctgttcctctctttagccaccttcatttgggaacagcccacagcctttctttgtctattatgaggtggccctctttaaagcccccaccccttccctttgatgatagacgacctctcatttggggtttgtcttgtgtttcccacatgtatacagaaattatgttctttggccgggaccctgcacagggggtgctggcctgactcagggcatctcctcgagggctctcgaggtcctgtcgcccctcacaggggacgtcacaccgtccaccatttgtcaaggtgcaggccaattgctctactgcagaatggctctttcttttcttccctgcaactgataaatatctcgggtgtggggcgctgagaccagcaagcaccctgctcctggtggacatttcccaggatgtagctgtggtgactctggcgggagctggcccctaccctgggagctgtgaatgacgaccgtgccagtgctccaccttgctgctgcccacggcctctgccttcccttctcccttggctgactttggaccaggccagcccactttgctgctgcccacggcctctgccttcccttctcccgtggctgactctgttcttggcgcagttcatgggttcctactctgcaggggtctgacctctcactgtccttaatgattttggtctcaaatggacccagatgtgaccaatggaacccttcaaccagctccgtgtcctaaaacgggtcccttgtttttggagaaccaactgcttttctggcctcacaagatattccagggtcatcttgtacccggcctaccccaaatccaggctcagcccattctctgagggccccacttcctttttttatttttattttttggtttgtttttttgagacagagtctcactcgcttcccaagctggagtgcagtggcgccatctcagcccactgcaatctccatctcccgggttcaagcaattctcctgcctcagcctcccgagcagctgggattataggcgcgcaccaccacacctggctaatttttcgtatttttagtagagacggggttttgccatgttggccaggctggtctcaaactcctgacctcaggtgatccgcccacctcggtctcccaaagtgctgggattacaggcatgagccaccacgcccggcctcctgcctccttttagagaacaagatgtgggcgtaggtgtgtccatcactactagggtgtctttgcttctcagccctttcaggggacagagctaggaaacacacacacatgtatggacatatacatacacatatgcacacacatacttgtctgtgtacacacacatactcatatgcatggaagtatacatatagttcacgtgcatacttcagaaatcatgggttctcacccatacctctaattccaacccatgccctgcggctttttcttgccttctcctgttccgtacgtgtgtgctccttccccagggggaacgctgctcccagcgtcaccagcaccttcagacccgtgctcagtcctgcagcacatctcaaatcgtttcagaatcactctgcccataccactgccattaacagccccgctaagacgggtgccggacttgtttgtaattcacctccccccgccagccaatcttgctcaaggctgagggtttgtaatcaaacactgtgtttgtgagtcactgtatcttcgttctctctgtccttgtctgtctgtctctctcttcgttgtggttatggcgtctgttggaaatagaattcggttcatttgttctggttcactttcagtctcatgttttccggttcccttccagctctgacttgattttactttttgaatctgtggacggtgacatgcccagcccagctggaccattgcaggagctgggaacttgcgaattgacaatgtgctaaccgggtgtcgggaggggagagtccaggtggaaaggtccttcttggccacagcccaggggtgagcaccggcacccaccccgacgtgcagacttcccgggcttgcctcacggggaaagtcctgcctccccagggctgccacacccaggacgggaagagggcgggcccgtggctcgagctccaagtttctcttgggctgctgtccagaggaaggaggccagcaggacctggtgggatagtccctggaaggccagggccctgcacacagactgcaagtcaacacaggagctttgctgtctgaacagccccggtcccgcgttcccaggcacgtctacccctccgacctgactttcctctctcttacttcttactgatttccatgactccaaattccctttcttgatgtatttagcagaacatggacaagcagggaagccagggagcatgctggccatcactgccggctgctcagctgtagagatccaggagttggttatcaaggcctcttggtctattcctgggaccctaaccctggatggagttcaaccgcggtgcctcatctataagacagagctgaaaggcctctgtcctcccagccccagttgaatatttgggactattcattaggtgaaccctttcgtgggtttttcagtctcgaggcaggaagccccctgagtgctaaaagcatcattaggaggaagggtgagaaatgcccccagctcctgatcaggggagaagctgtttccatcgcccttcctgtcgcctccccaccgcacagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggtaggttccggtccccgcagcagagagcggcctcctgccttgggggcttggccctcaggctgtggggtttctgacaggtggtttagttaaggtgaggctaagaacaagagatgaaatttagtgactcatctcacccactttctctttacctccttccttcctgctgttccccagaccccaaaattggcagaattaaaagctgctggaacagaattaaaagctggaactgggcacagtggctcattcctgtaatcccagcacttgggaggccaagatgggcaagatagcttgagctcaggagttcaagaccagcctgggcaacatggcgagaccccatctctacaaaaaatacaaaaagtagccgggcatggtggtgcacacctgtggtcccagctattcgggaggctgaggtgggaggatcgcttgaccctgggagtttcaggctgcagggagctgagatcacgccactgcactccagcctggcgacagagggagaccctgtctcaaacaaacaaaaataaaagccgctggaggtgcatcacaatgcccgacttggtgggtttactgcagcgactgtgttctggagtggacttggccaattgtaaagcatgggattcgcgttaaggatgggggaaagaaacctttctgcctggaaagactccgccctctgggcctcaggtgcactggagagaggggggctctgaagtggagcagtgagtgagcaacgacccttggcgtctcctcctcggcccctctcagtagattggtatttattgagatattccttccataagcattcactgggcccagggcactggccatcttgcagcccggattgtgtctctgtttataagctccttcctgggaagtgagtgtcagaggggaatgacctgtctgctggtttctccctcgctgtgaaactgccggtagatctgttgaaggagaaggctgacctggtaaagggaggaactggtgtcctcagaggttgccagcttcctgtgttccttctccttggccatgaatctgcacttttcccaggcatgatgggtggcttttccgtggcttctctcctgcccggtgtagagtggcaagactgcatccgtccacacacctgaccgtgcagttgccgccatcttctcgggattctgcttgcctagggcaggcctctggggaagccagcaccccaggctgacctctctctgccccaggcggagaaggacattctggagcagagcctggacgaggcgcgggggagccgacaggagctggtggagcgcatccactcgctgcgggagcgggccgtggctgccgagaggcagcgagagcaggtgccgtgtgagcccttcctcccttgtgactctcctggggcttgtctcaggggtgcggacaggtctgtggggaagccagattccttcatccacgccgagctcacataattttgctgaacgaatctgtcggcctgttcatctgtccctttgtcagcgccaccctaagcaccgactcgcaccccacagctaagaccatggtcaggcagatgcgtgattcaaacgcaggggatttcagggcccaggccccggggagagccagggacttaggtgaggagggaacggggaggaaaggagacggtagaagagaagaggacagggagggaaaattgtttttctgggacattaaaaacgcaaaacacaactatgcatgcaacatcccctcattgttttaattcagacgtaatcagcctaagcaactttctagatgcacctcgaaatctagcacttaagagacgagcgaggccgggcgcggtggcccacgcatgtagtcagcactttggaaggccgaggcaggcggatcacttgaggtcaggagttccagaccagcctggccaatatagtgaaaccctgtctctactaaaaatacaaaaattagctgggcctggtggtgtgtgcctgtaatcccagctactagggagactgaggcacgagaatcgcttgaacccgggaagcagaggttgcagcgagccgagattgcgccattgcactccagccttggcatcgcagcgagtctctgtctcaaaaaaaaaaaaaaaaagagagagagagacgagtgagaattgaccttatttcatccctagaactgtctccctccctccacccctgggttccccgacccccttctaaggccagaccctcagagctgctgagcttcacggtccatgtgtcccactctgtccagtactgggaagagaaggaacagaccctgctgcagttccagaagagtaagatggcctgccaactctacagggagaaggtgaatgcgctgcaggcccaggtgtgcgagctgcagaaggagcgagaccaggtacctgagaggccgggcccaccccgccaccccatgcttgcttccccaggtgagggctggttccggggacagtctcgtggctccctgcccttgatggcagctggtcccagatttcagggtctctttcctcggtccacacgaagtttcttcactcctccaggcctgttgtccacatgctgtctctatcatccttcttgctcttattcctggtacatgacactgagaaagtacaccccaaatactgggttttatcaacactgcacatgtgaacacgaattgaaatgaatcttaagtttgcacagctcagcgtgggccatttagtggatgtcagatgagcgcaggctagaaacagggctctccttctctagctgaggctccccggtggtgatggcgcggcctccttactcccgtcgtggcccacaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtggtgagtgttcccggctgacccgagctggaggccaggcaggggctgcggtgacagtgggacagagctgggctccagggtggcccatggaggcactgggaggacaggcagggtcccaggctgggccacacgcggcacctgcagagacggcccagtgtcactgtgatgagcgacacactggctcccacgcgtggatggtgccgtgaaacctcgaaggtgcccagtagacaagtagagtctgcctccatatcatcgaatggggagcttagcggaaggttctggaacctgtggagtgtggtgatggatgtggcaggtggcgtttgaagctgtccacaggcagccatttgcagtgtagatgctgtgttcctgaaatgcttaaaagcccagcgtccaagagtggaaagacagacctacatgtaacggagggagcgtgttcccagaaagccagaattcttagaaagcctctcattctgggctggcaggcagctccagctccaggcccccggggaggcaaaggagctcctccctccgcatgcggaacccacccggcccttccttccttaccccctgcatggcaagcatcccacaccgacggtggaaacacacgtgtgcacgcagagaaaaaccctcccggggcaggcaccaacacgcaggctgtgctcattctgggtgtgagatgacgggtggattttattttcttctctaactggttctacttgccttcctccaattttctgtgtgtgtatgtatgtgtgtgtattatacattattcgtaaaactagtaaatcacacatattctaaaagaaatgaaatgctgtgtgtccagctggtttctttcagtctctttgattggcagcgcctgtgatcctgtgatgggctcggaggacagggacacaattgttttccctggaagctgacgagaggaaactgctggggagggtgaaatgggtggtgctgacctggtagaaactccacgggcctcaaagcggaacctttcccgaattaaccagcctgtctggcctgtctttggcagctcaagcaggaagccaggaccagggagccctgtccacgggagaagcagcggctggtgcggatgcatgccatctgccccagagacgacagcgactgcagcctcgtcagctccacagaggtacggccgctcctcccgcctccctcactgccttgaccctctgggccagcccaggggcctctctgtcaggacgaaagtgagcctccttccaccctgtccccacagggaagaggttggtacgattgtgagagttttattttattttattttttgagacagagtctcctctgtcacccaggctggagtgcagtgatgtgatttcggctcactgcaacctccacctcccaggttcaagcgattctcttgcctcagccacccaagtagctgcattacagacacctgccaccatgcccagctaatttttgtgtttttagtagagagggtttcaacatgttggccaggctggtcttgaactcctgacctcaaatgatctgccagcctcagcctcccaaagtgctgggattacaggcatgagccaccgcacctggccctattgcgagagttttaaacatcagaggttgattctgtcacagtcctggagcccagacatccaaagtcaaagtgctgacagggtacccgtctggaaatcctattcccaaagaaggtcacattcacagcttgcagggtggacatgagtttccaggggaaccgattcaacctggcacagacagtccccagacatgagtttccaggggattcaacctggcacagacagtccccagacatgagtttccaggggacccaattcgacctggcacagacagtccccagacatgagtttccaggggacccgattcgacctggcacagacagtccccagacatgagtttccaggggacccgattcaacctggcacacatggtccctgggatgccggcctcactgtggtttctggagcctcaggaccctggcatctgtcctcaccctttggcaaagtaaagaggtggtcccaccatagtgggcatgtggcatgaggatgctgggggtcaaagccccagtgccacaggatgccgggagccgggagggagggagggtgagaggcgggcgaggctgacatccctttgccatgccttggggtggacctggtgtttccttcctggaccatcccatcagtggcccaagagcagcaggcccaggctcacctgccccctggccactcagagagctgggggaggccgggatcttccccagaacactgagtgcacacacggggaagatttcacagtcggtgctgggcctccctgggccaggacagtccaaaccttcaactgaatcgactctcgcatctgccttaacgccctctgtgcccccattccccacaggacagaggccagccgtgtttcccttccccaggggtggattgggtcagggagggaagggacctcaggtgctcagaactggctcgccagaacacaccatcctcattcaccagcctcgtgggcaactgaccgatcagctgccctccagccactctcctcctgccccggctttctaatctggctgctctagggggactgcctcctacttcatgggctctctgcgtgccactgctctgttgctctctctgtctggaatgtgccccctgcccccaacacacacacactccacctcactcctctgtccatgccacttcctccagagagtccgccctggcctccctgccctgcccatgtcgcccacagccctggaatgcctcactccacctcactggtccacgggtgcccgttggttcccccaccccaaggacagtccctgtcctcagatgtacatctgacactgtcaaaggacctggcacatagtagctactccaggaatacttattagtgaaagaaggggcgggattcagacctaccccacacatctggtggcctcagcgcctcgcacgtcacatttgtcagtgtgcactctgagtgcggcctcccctccctagtcactaactcaacctctctgggcctcagttgctttgtgcattagttcgttctcatgctggtgatacccacatacctgagactgggtaatttacaaagaaagaagtttaattgactcacagttcacagttcagcatggctggggaggcctcaggaaacttacaatcatggcagaaggcacctcttcgcagagcggcaggagagagaatgagtgctcagcaaagggggaagccctttataaaaccatcagatcttgtgagaactcagtcactctcacgagaacagcatgggggaaacggaccccatgattcagttatctccacctggtcccacctttgacatgtggggattattacaattcaaggcgagatttgagtgggaacacacggccaaactatatcactttacatgtaaaatgggacagcagtgccaccttacagatttatcgtgagaactaagccaagcagctaatagagcctgacatacagcatgtgtcagtgctgtgtgctaattgcatgtgaccccagtgtctggcatacagcaggtgctcagcgcatgtgaccccatgtgtgtccttctttcccctcctgcctcctctccagtcagttctcactgtggctctctctacaccgtgggggagcaagggaggagtctcagggtgtcctcgtgcgtgccccactgacttctgccctccctcctccagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcaggtagagcactggggtccttcctggcactggggtggcactggggtccttcctggcaactcaccagagacaccaacctagacctcagggcatctgggtattgcaggcagcagctcctgccctcgaagccccagagctggcaggtgctgggggccagtgcttggggcgtggggactcagagggagcaggtgatgcagtttgagcctgctgctgcttatgctttgcagcagctgcctggagatcccggagggagacccgggagccctgccgggagctaaggcaggcgacccacacctggattatgagctcctagacacggcaggtgagcacgcccaaccctgaacctccacagcagtccacctcccctgggcagagcagggagctgatgagaaagccggggcctctctccagggaaagggcagatagaagcagagctcaacttctgccctgggccttgaccttggcctcgaccttgcactttgggaaagtcccgcctgccagccagcgtaagccaaaggccggctgcgctctgtctgctggtgtccttgtgtttttccctagagccaggggagttgtgtctgatccacgccctgctcagcacccagccccctgctctgatctgtaacgcttgggcttcccagtggtttcagaaggcagcaggcagggtggcttagtggtgccaggctgaggcgaggcacagcgtgacatctacctgcggggagcatctctcctctcaggcgctggccctgaggcctcgcgcttctcctgtagctcatttctgtttgtgattggaccggccctctctgcttcccaagtccatgggcccgtcatgggtgggtgccttaatcctttccacctcggcgcgaccggctcccagccttgggccttgcacacagtaggtgctttgctccccatttggaattcaccccatggccaccagggggcgcaagtgccctgcgctgcccctgtgccttctgtgggtcgcagaatcagaaatcttcatctttggggactcatacacgtttttatttataatcgtgataaatcgagagagaccacccaaggcatatctaaattagatgtgagatgagaagaggggcttattcctctttatttttcctctgtgaggattctgcgtaatgccctggttgcatatacttttagtggaattgacctcaaatacatccagagtacacagctcatttcattggctttgaatgtgatcccaatgggtttttgcctgtgagccaggcctagggaactctcaggtctctgctggccctggctctgctgtgtggttcacagagtgagacttgcagccgtcgaccctggcaggctgctccctggttcgggggctcacaggctgtacagtaaaatgctagagcttgggagaccctggggagcctctagtcctaggattgacaactcagagacctgccaccaccagctgggaagcagaggagtctggggtaaggagcaggcagctgctggccagtgccagtgattgcggccacacagaaatgcaggcctgtgtggaaatgcaggccagtgtggaaatgcaggccagtgtggaaatgccgtgtagtacagtagtgcaggtctgggtagaaatgcaggtccatgtttgggaggtcaaggtgggcggatcatgagctcaagagatcgagaccatcttggccaacatggtgaaacctcgtctctactaaaaatacaaaagtcagctgggcatggtggcacacacctgtagtcccagttagtcaggaggctgaggcaggagaatcacttgaacctgggaggtggaggttgcagtgagccaagatcgcaccactgcactccagcctggcgacagagcgagactcagtctcaacaacaataacaacaacaacaaaagaaatacagatccatgtagaaaggcaggccagggccgggtgtggtggctcatgcctgtaatcccagcactttgggaggccaaagtgggtggatcatgaggtcaggagttcgagaccagcctggtcaacatggtgaactcccgtatctactaaaaatacaaaaattatctgggcgtggtggcacatgcctctagtcccagctactcaggaggctgaggcagaagaattgcttgaacccgggaggcggaggttgcagtgagctgagatcacggcactgtactccagcctgggcgacagagtgagactctgtctcaaaaaaaaaaaaaagaaagaaagaaagaaagaaagacaggccagtgcagtgcaggcccacgcagacatggaggtcaatgcagtaatgcaggccagtcctgaaatgcaggtccatgcagaaatacaggtcagtgcggaaatgcagccccagggttacagcagatattttttcaagtgaagccagaaatccagattttaggtgaaacctccctgtctttcaaatgttggcaactcattcaaatatcacaaaatagcatgtggtggtcagaccctcccagttgcagctcctcactagttacagtgattttaggaaagatgaaatcaaggtcccaagcattgaggaaggggtggaggaagagaaagttcagcctcagcacaaaggatggaacaggcagtggggcctgaggctgagggagaaggggctgaggttacaggaggttacaggacgccccatcagcagtggggtgaccaagatctgtgaagaaggggctgaggttacaggaggttacaggacgccccatcagcagtggggtgaccaagatctgtgagctcttggcttcctcccagaccttccgcagctggaaagcagcctgcagccagtctcccctggaaggcttgatgtctcggagaggtaagcagcaggtgggaatcctccgaggctggctggggaaccagggccagggagtggcagagcagagggtgagtgtcctattaccaatgggaggcaacagcctttccaagcacatggggccatggagggggaggagaattccagaacactggggccagagggaagcaatggggaggtggccttgccggctctcctgctctgggcagtgcacaagccggtcgtctcccggcctgcagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggtgagccgtgcgaggcccctcctgtcccccgggctcctcatggggacagtggcagcgggtggggtgacccaggcagacttcacctcccccagacgatgcagatccactctgggctgggcctctgctctttcctgggctgacgtaaagcgttctgctcatttatagatgagagtcgtgccgtgcagaacccagcatgtcacccgtggtgctgctgccatgcggcgcttctgaccaggggtctttgcatgaggccccttgacagggctgctctgggtggtcactttgggtgtgtacagtaaaatacacgtgacataaaattcactattttaaccactggggcatttcttttctttctttttttttgtttgttgttttgaaacagggtctcactctgtcacccaggctagagtgctgcggtgcgatcacagctcactgcagcctcgacctccccaggctcgattgatcctcccacctcagcctcttaagtagctgggaccagaccacaagcatgcgctaccgtgcccggctaatttggggacattttctaaaacttttttttgttgttgttacgaaacgcacaaaactgctgagaagataaatggacacaaatatacaacctggccaggtgtggtggctcacgcctgtaatcccagcagaaggctgaggcaggcagatcacttgaggtcagaagttcaagaccagcctggccaacacggcgaaaccccgtctctactaaaaatgcaaaaattagccaggtgtggtggtgggcgcctgcatggtcagggggtgactttgatgtggcctaaaagcagaattattaaactttaggaaaaaaaaaaacttctgggcacagtggtacatgcctgtagtcctagctactcagatgcctgagcccaggagattgaggctgcaatgagctaagattgcaccactgcactcgagcctgggtgacagagcaaagccttgtctcaaaaaaaaaaaaaaaaaaaagaaaagaaaaaaaaaggccaggcacggtggcttatgcctgtaatcccagcactttgggaggctggagcaggcagatcacctgaggttaggagtttgagaccagcctggacaacatggtgaaaccccgtttctactaaaaatacaaaaaaaaaaaaaaaatagctggtatctataatcccagctactcaggaggctgaggcaggagaatcacttgaacctgggaggcggaggttgcagtgagctgagatggtgccactgcactccagcctgggtgacagagtgagactcggtctcaaaaaagaaaaaaagaaaagaaaaaggaaagcacagtgctttcttaatatgaaaaaaattttaaaccaagaaatgtgcaagatgggcttcacctcattccagaggctcaccctgcggcctccaggaggggactggggatgggggctctggggtgggaaggtgagcacagaggcggggagaggatgcgtctgaacccctcaggcaggagtgttccatgcacccctcactgcccccttggaacaggctgtccaaatgctgagctcccctagggctccaatgatagcacatggagcacctaattcaagcgtccttcacgtcctccacatgacccgggaagcctttctttacatgtcatttttttttttttttttttttttttgagacagagtcttgctctgtcgcccaggctggagtgcagtggctcgatcttggcccactgcaacctccaccccctgggttcaagcgattctcttgcctcagcctcccatgtagctgggattacaggtgcccgccaccacacccggctaacttttgtatttttagtagagacagggcttcaccatgttggccaggctgatctcgaactcctgacctcaagtgatccacccacctcagcctcctaaagtgctgggattacaggcatcagccaccatgcccagcccttctttacatttctagttgtcctcttaagcagcagtccccaacctttttggcaccagagaccggcttcatggaagacaacttttccacagaccgggttgtgggggatggttttgggatgattcaagcacgttacattgattgtacactttatttctattattattacactgtaatatgtaatgaaagaatcatacactgaaccataattcagaatcagtgggagccctgagcttgttttcctgcaactagacggtcccatctgggggtgatgggagacggtaacagatcatcaggaattagattctcataaggagcgtgaaacctagatccctcacttgcacagttcacgatagggctcatgctcctctgagaatctactgctgtgctgagctgacaggaggtggagctgaggccgtaatgctcacttgcccaccacgcccctcctgctgtgtgacccgggtcctgatggaccatggaccagtaccagtatgtggcccaggggttggggaaccctgctcttaaggttcccaattatcagctctgaggtagttcaagcaacagagccccttgacgatgttcagggagatagtcccgatatcctaagggggccaattagattctaatggtgttaaaacacatcttaatttttattgtaaaaatatctactctcctaagcttagaacaatattgagaagaaatgaagtggatggtggaagccctggggggtgggccttcacagtggggaaggctgtgggtggagagccagggcatcgggtaggtgaaggccagggatgccactcagcatcctgtagggcccggtatagcccgcagcagcacagaatgatcccaaggctaagaaacctctatctagaatgctcttgaatgttctagaaccgaggttctttcttttcttttcttttctttttcaagacaggaaagtgcttatcacaaagaacccccgatctcgactggggaagggttggcagttgactctctggccagcactatgtgtagcacgcatcactagaggtgtgaaggccccacagaggctctggtgtgtggctttgttttgaccaaggcgtgcaggcagtggtcctacggcagggctggcccgcgcctcgcctcagtgccctcagcgccttctgtcttctggctggattcagagtcccgggggaaagagactgaccttctcgacttgccctcaggttgattacgaagcctcagagcccttgttcaaggcagtcctggaggacacgaccctggaggaggccgtggggcttctcaggagggtggacggcttctgctgcctgtctgtgaaggtcaacacggacggtacacataccactcctctcgtgtgcacagctgcctggccagactccatgacccttaagtccctggtggttcttctgcacgcccagcagccagggacccccagagccaagagaggatcagccaggctgtgccccaggtccccaggaggcccccaagccagctggaaacctcccacccactgactccagtgccagagcagcttctgagactgggagggtccttccttctctcctactttaattttctgcaaccttcctcgcagaggctcgtatctgtggctcatctgtggctcatgtccccttttatcaggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccaggtgagcagctgcctcgagctcggtgcgtccccagagaggcccacagggaaatggcacccagcctgcctcggcttcctcctcctgcccagcaatagagggtgggcgtggtgagacccccctaaggagggaagcctgccaagatcactgctgaagatgttgtttctttgtgatggatgctttatatattgcaaatgaaatgttcattctagaacattctagatctgggtttcttagctctgggtttcttagctttggtaccatggacgtttggggctggatccccgtctgtggtggggccgtcctgggcactgcaggatatagagcagcatccctggccgccctacccaggatgccgggactactcccatgccccagctgtgacaaccagaaatgtctctataggttgccaagggtcccctggttctcctaggactgtcttggtcttagcactgaaagccccacttgcagggaagcccctcggtcctgggcaagcagggacagctggtcaccctccctggggagtgacattgccccctgccttgctccattgaaaaccactgctctaggccgagcatggtggctcacacctgtaatccaaacactttgggaggccgaggcgggtggatcatctgaggtcaggagttcgagaccagcctgggtaacctggtgaaaccctgtctctattaaaaatacaaaaaacttagctgggcgtggtggcaggtgcctgtaatcccagctactcaggaggctgaggcaggagaatcacttgaaccccggaggcagaggttgcagtgagccgggattgagccattgcactccagcctgggcgacagagtgagactctgtctcaaaaaaaaaaaaaaagaaaaggaaaccattgttctagatcagcctatgggaggctccaagtttcaagtgcacggaacgcacagtgctagaaagcaggagtgttgagctcagcacccccatcactcattgcaaactcaagtcccctggggatcggagccagcaggtccagggagaggcctggcactctgcatttctaacagctctctcggtgactccaggctgcaggccagggacccaccatgaatattgaggtcctggagtggggccctgtacgctggctgctcaacagcaccccctgggtcccgccccaggacaagtaaatcagcatctccaggggtgggccgaggccctggagtcttttgaaagctctggagactggcatggccgccaggatggagcgctccagcctgcagcaaagggatgtgtggagctctaggtggaggcccttctctcccacccggccatctcccccactctcccctgctcggctctcccctgccctgctcacctggcaggaggcagctgggtcagggcctctgctggtctctgcagggctcagcagcagctcatagccctcatccaggacatgactcagcagtgcaccgtgacccgcaaggtgaggctccagggaggggcctggaccccactggggtgggctggaagaggggctcggtgctggcagggtggcaggaggcactgtgtggagagtgggctgctgattggagggtaaccccacctgtctctcctctgcaccccttcaaaccagggcagggtctgcagcccctgcccagcctgcaggctcttgcacaagtgcagacacacctcaggctgttctcagagcatctgcgcctctgcatcactcccaggtcgccctagtgccaatcatctcccctgaattcccattcctgttgatggcttcaacagctcctcctcatcctttctctgtccctcctttagccatcttctgggggaccacagaagctggtccgcatcgtcagtatggacaaagccaaggccagccctctgcgtttgtcctttgacaggggccagttggaccccagcaggatggagggtgaggcctggtgagctggcacaggggccactggctccaagtgggtgaggggctttgggagctgctgctagttggtcagctggggcagggggatgccactcatttaggccaggatctggtcttcaagaatcatggggctgggtgtggtggcgcacacctgtaatcccagatactcgggaggctgaggcaggagaatcgcctgaacccgggaggcagaggtggcagtgagccgagatggtgccattgcactccagcctgggcaataagagcaaaactctgtctcaggaaaaaaaaaaaatttcaggagaggagtacaggacagagggagggctaggaccctgtgccctggaggatggctgaggagaagggtgccactctcccagatcctttggaaggaagaaaaccctggcttccgccatcctcccttgggcctataggaaacaggattaagttgcaggctgcaaagcagtccctggagagccacagagctgtgtaacccccgtgcaaaggagccgctcagccaggggctatggaactgggagtgagtcctgtgaccgctgagcctgtgcccctggaattctaggtgctggggctgctgcagtgagcaaagcagacccagtccctcccggggcagggtaggctggctgggggctgccgcagcctcacccaccctcaggatcctctcctccacaggctccagcacgtgcttctgggccgagagctgcctcaccctggtgccctataccctggtgcggccccatcgacccgcccggccccggcctgtgctcctcgtgcccagggcggttgggaagatcctgagcgagaaactgtgcctcctccaagggtttaagaagtgcctggcaggtatgctgttgcctgggaatccctctaccccttccaccttccctccctccctcctccccttcctccctccttcctccccttcctccctcctccttccctcccccaccacgcacattcccacactcacctgctgtgtccagatagttcaggatggaggtgcagggcacagagcggggtgtgcagggtcaggtttgtaaagtggacatcctaagaagagcttctcccagtgctggcagggttcacggggacaggggtgtttaccatgggactcccccagacccccacacagctggtctatgatggccccgtccaatgtcacctgtagagtacttgagccaggaggagtatgaggcctggagccagagaggggacatcatccaggagggagaggtgtccgggggccgctgctgggtgacccgccatgctgtggagtccctcatggaaaaggtgaggtcaagggcggggtgggcaggggagctgtcctgggaagggtttcaggaatgcagaggagggggatgagataaaggtacagggaccgacctgagacctgggtgaccttgtcgccgacctctgggtcccaacagcccagcaggagcccaaaactcatctcagccagttaggatccacgtgactgtgggtgaggtctcccaactccttgaatctcagtttcctcagcttgggggatgtttaatagatatttgttcgagaatgaataaatccgagctaacaacactctccacgtttgaaggcgcaaacgcgtgaaaagcagctccccgtgaaccacagctttgtgtctgcacaggcacgggaagccgagtctggcatctgcgtgcctcctgtaggggctggcggagctccatgccaagttcacctcatccccagagctcacaatttctagattttcccagtgaaaaatcaaagggatggaaactcttaatactgcatagcacacagcctcatttagaaagtggcaaactcagctgggcctggggctcacgcctgtcatcccagcactttgggaacccgaggtgggaggatcgcttgagcccaggagttcaagaccagcctgagcaacacagtgagacccgtctctaaaaaaaattaaaaaataaaaagagaagaaagtagccgggcacagtggctcgcgcctgtaatccccacactttgggaggcctaggcgggaagattgcttgagcccaggaatttgagaccagcctgagcaacacagtgagacacccgtctctacaaaacatttaaaagctaaaaaaattaaaagtgggccgggtgcggtggctcacgcctctaatcccagcactttgggaggccgaggcgggcagatcacctgaggtcaggagatcaagaccatcctggctaacacggtgaaaccctgtctctactaaaaacagaaaaaattagccaggcgtggtggtgggcgcctgtagtcccagctactcgggaggctgagacaggagaatggcatgaacctgggaggcagagcttgcagtgagccgagatcgcgccactgcactccagcctgggcgacagagcgagactccgtctcaaaaaaataaaaaataaaaataaaaaaaagagagaagaaagtggcaagctctattccctcatctcctctacaaaattcagctctgcccagctcctgccctgccctcagcctgtccggagggcccttctgacctgggcgttggctccctttgcttcctctgaggcctgtgatcttgactcacttcttctctccctcccacaaagaacacccatgccctcctggacgtccagctggacagtgtctgcaccctgcacaggatggacatcttccccatcgtcatccacgtctctgtcaacgagaagatggcaaagaagctcaagtaggtgcacgctgggggctgggcaggggcttcgaagcggctcctgggctcccccaaagcccacggcaggtgcctctggagtgtgctctgcggtttgcaggaagctgaggcgctgacagggccgtttccgcacaactttgggacaagggccccgctgattgctcatgagattcccctgattttggccgggcgtggtggctcacgcctgtaatcccagcactttgggaggccagggtgggcagattgcttgaggtcagcagttcgagaccagcctggccaacatggagaaaccctgtctctattaaaaatacaaaaactagccaggtgtggcggcgggcgcctgtaatcccagctactcgggaggctgagacatgataattacttgaactgggaggtggagttgcggtgagccaagatcgcgccactgcactccagcctgggtgacagagcgagactctgtctcaacaaaacaaaacaacaacaacaacaactgctctgatttcacgcttaccaaacaaacttgatttcaaatctggcctctccagaatcttgataccaggatgacggtgccttttacagtgggcaaaagtagcctagtcactggaaaatgacattttataattgaaatttaaagttgtaaattaacaaattggcactccctcccccaagagcagctcagaggaccattgtaaggccagaaccccacccggcctcagctccactgaccctccacttactggtgcttggctagcacaatctaatccttgtcggctaaggacaaaaaaaaaaaaagtaaaaaaattacttggtttcctggggacagaccaagatgtcctgctactgtgccctttctactccaggaagcaaggctgtgttctagacaacctgcctcccaccactggggcctggggcctattttctttacaaggtcccctcaaagcgaggccacctgtgtttaggggtgtttgggtgcatgtcatcactaccctagccagggctcctgggcccttgctctcccctgagcccgccccccccaactctggcctgtgcaggaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtgggacaggagggacgtcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcagaagcccacatatgctgtgacgctggccaccttttctcagcttctgaggctgcgatgcctcaggaactccagtttacagagaccagtgtgtttacttgtaaataaagcctctgcgtggtggagacggtactttcagtgggtctgtgccccgtggcccctgtgcctgttcggtgggggtgtcccagagaagcctggcaccagtacccccgtacaaggcccagcggactctgccttcccctgacctggctttgcaccccagcccttcttgggccaaacatctttactccaccttcagggctcggggaggacccaggtccgccagcacctggccttgcccctgcctcctggggctgttgcagactgaatgtcattttgacagcagtgtccaagaatcaggaagctgttctagaattcaggttggtatcatcataaatgagttcagaaaaagaacttctgtatattttactaaaataaaaagcttttacaata

SEQ ID NO: 2374 - DNA, 11125 bp, Homo sapiens
  source 1..11125: mol_type = genomic DNA
gtccagaggaaggaggccagcaggacctggtgggatagtccctggaaggccagggccctgcacacagactgcaagtcaacacaggagctttgctgtctgaacagccccggtcccgcgttcccaggcacgtctacccctccgacctgactttcctctctcttacttcttactgatttccatgactccaaattccctttcttgatgtatttagcagaacatggacaagcagggaagccagggagcatgctggccatcactgccggctgctcagctgtagagatccaggagttggttatcaaggcctcttggtctattcctgggaccctaaccctggatggagttcaaccgcggtgcctcatctataagacagagctgaaaggcctctgtcctcccagccccagttgaatatttgggactattcattaggtgaaccctttcgtgggtttttcagtctcgaggcaggaagccccctgagtgctaaaagcatcattaggaggaagggtgagaaatgcccccagctcctgatcaggggagaagctgtttccatcgcccttcctgtcgcctccccaccgcacagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggtaggttccggtccccgcagcagagagcggcctcctgccttgggggcttggccctcaggctgtggggtttctgacaggtggtttagttaaggtgaggctaagaacaagagatgaaatttagtgactcatctcacccactttctctttacctccttccttcctgctgttccccagaccccaaaattggcagaattaaaagctgctggaacagaattaaaagctggaactgggcacagtggctcattcctgtaatcccagcacttgggaggccaagatgggcaagatagcttgagctcaggagttcaagaccagcctgggcaacatggcgagaccccatctctacaaaaaatacaaaaagtagccgggcatggtggtgcacacctgtggtcccagctattcgggaggctgaggtgggaggatcgcttgaccctgggagtttcaggctgcagggagctgagatcacgccactgcactccagcctggcgacagagggagaccctgtctcaaacaaacaaaaataaaagccgctggaggtgcatcacaatgcccgacttggtgggtttactgcagcgactgtgttctggagtggacttggccaattgtaaagcatgggattcgcgttaaggatgggggaaagaaacctttctgcctggaaagactccgccctctgggcctcaggtgcactggagagaggggggctctgaagtggagcagtgagtgagcaacgacccttggcgtctcctcctcggcccctctcagtagattggtatttattgagatattccttccataagcattcactgggcccagggcactggccatcttgcagcccggattgtgtctctgtttataagctccttcctgggaagtgagtgtcagaggggaatgacctgtctgctggtttctccctcgctgtgaaactgccggtagatctgttgaaggagaaggctgacctggtaaagggaggaactggtgtcctcagaggttgccagcttcctgtgttccttctccttggccatgaatctgcacttttcccaggcatgatgggtggcttttccgtggcttctctcctgcccggtgtagagtggcaagactgcatccgtccacacacctgaccgtgcagttgccgccatcttctcgggattctgcttgcctagggcaggcctctggggaagccagcaccccaggctgacctctctctgccccaggcggagaaggacattctggagcagagcctggacgaggcgcgggggagccgacaggagctggtggagcgcatccactcgctgcgggagcgggccgtggctgccgagaggcagcgagagcaggtgccgtgtgagcccttcctcccttgtgactctcctggggcttgtctcaggggtgcggacaggtctgtggggaagccagattccttcatccacgccgagctcacataattttgctgaacgaatctgtcggcctgttcatctgtccctttgtcagcgccaccctaagcaccgactcgcaccccacagctaagaccatggtcaggcagatgcgtgattcaaacgcaggggatttcagggcccaggccccggggagagccagggacttaggtgaggagggaacggggaggaaaggagacggtagaagagaagaggacagggagggaaaattgtttttctgggacattaaaaacgcaaaacacaactatgcatgcaacatcccctcattgttttaattcagacgtaatcagcctaagcaactttctagatgcacctcgaaatctagcacttaagagacgagcgaggccgggcgcggtggcccacgcatgtagtcagcactttggaaggccgaggcaggcggatcacttgaggtcaggagttccagaccagcctggccaatatagtgaaaccctgtctctactaaaaatacaaaaattagctgggcctggtggtgtgtgcctgtaatcccagctactagggagactgaggcacgagaatcgcttgaacccgggaagcagaggttgcagcgagccgagattgcgccattgcactccagccttggcatcgcagcgagtctctgtctcaaaaaaaaaaaaaaaaagagagagagagacgagtgagaattgaccttatttcatccctagaactgtctccctccctccacccctgggttccccgacccccttctaaggccagaccctcagagctgctgagcttcacggtccatgtgtcccactctgtccagtactgggaagagaaggaacagaccctgctgcagttccagaagagtaagatggcctgccaactctacagggagaaggtgaatgcgctgcaggcccaggtgtgcgagctgcagaaggagcgagaccaggtacctgagaggccgggcccaccccgccaccccatgcttgcttccccaggtgagggctggttccggggacagtctcgtggctccctgcccttgatggcagctggtcccagatttcagggtctctttcctcggtccacacgaagtttcttcactcctccaggcctgttgtccacatgctgtctctatcatccttcttgctcttattcctggtacatgacactgagaaagtacaccccaaatactgggttttatcaacactgcacatgtgaacacgaattgaaatgaatcttaagtttgcacagctcagcgtgggccatttagtggatgtcagatgagcgcaggctagaaacagggctctccttctctagctgaggctccccggtggtgatggcgcggcctccttactcccgtcgtggcccacaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtggtgagtgttcccggctgacccgagctggaggccaggcaggggctgcggtgacagtgggacagagctgggctccagggtggcccatggaggcactgggaggacaggcagggtcccaggctgggccacacgcggcacctgcagagacggcccagtgtcactgtgatgagcgacacactggctcccacgcgtggatggtgccgtgaaacctcgaaggtgcccagtagacaagtagagtctgcctccatatcatcgaatggggagcttagcggaaggttctggaacctgtggagtgtggtgatggatgtggcaggtggcgtttgaagctgtccacaggcagccatttgcagtgtagatgctgtgttcctgaaatgcttaaaagcccagcgtccaagagtggaaagacagacctacatgtaacggagggagcgtgttcccagaaagccagaattcttagaaagcctctcattctgggctggcaggcagctccagctccaggcccccggggaggcaaaggagctcctccctccgcatgcggaacccacccggcccttccttccttaccccctgcatggcaagcatcccacaccgacggtggaaacacacgtgtgcacgcagagaaaaaccctcccggggcaggcaccaacacgcaggctgtgctcattctgggtgtgagatgacgggtggattttattttcttctctaactggttctacttgccttcctccaattttctgtgtgtgtatgtatgtgtgtgtattatacattattcgtaaaactagtaaatcacacatattctaaaagaaatgaaatgctgtgtgtccagctggtttctttcagtctctttgattggcagcgcctgtgatcctgtgatgggctcggaggacagggacacaattgttttccctggaagctgacgagaggaaactgctggggagggtgaaatgggtggtgctgacctggtagaaactccacgggcctcaaagcggaacctttcccgaattaaccagcctgtctggcctgtctttggcagctcaagcaggaagccaggaccagggagccctgtccacgggagaagcagcggctggtgcggatgcatgccatctgccccagagacgacagcgactgcagcctcgtcagctccacagaggtacggccgctcctcccgcctccctcactgccttgaccctctgggccagcccaggggcctctctgtcaggacgaaagtgagcctccttccaccctgtccccacagggaagaggttggtacgattgtgagagttttattttattttattttttgagacagagtctcctctgtcacccaggctggagtgcagtgatgtgatttcggctcactgcaacctccacctcccaggttcaagcgattctcttgcctcagccacccaagtagctgcattacagacacctgccaccatgcccagctaatttttgtgtttttagtagagagggtttcaacatgttggccaggctggtcttgaactcctgacctcaaatgatctgccagcctcagcctcccaaagtgctgggattacaggcatgagccaccgcacctggccctattgcgagagttttaaacatcagaggttgattctgtcacagtcctggagcccagacatccaaagtcaaagtgctgacagggtacccgtctggaaatcctattcccaaagaaggtcacattcacagcttgcagggtggacatgagtttccaggggaaccgattcaacctggcacagacagtccccagacatgagtttccaggggattcaacctggcacagacagtccccagacatgagtttccaggggacccaattcgacctggcacagacagtccccagacatgagtttccaggggacccgattcgacctggcacagacagtccccagacatgagtttccaggggacccgattcaacctggcacacatggtccctgggatgccggcctcactgtggtttctggagcctcaggaccctggcatctgtcctcaccctttggcaaagtaaagaggtggtcccaccatagtgggcatgtggcatgaggatgctgggggtcaaagccccagtgccacaggatgccgggagccgggagggagggagggtgagaggcgggcgaggctgacatccctttgccatgccttggggtggacctggtgtttccttcctggaccatcccatcagtggcccaagagcagcaggcccaggctcacctgccccctggccactcagagagctgggggaggccgggatcttccccagaacactgagtgcacacacggggaagatttcacagtcggtgctgggcctccctgggccaggacagtccaaaccttcaactgaatcgactctcgcatctgccttaacgccctctgtgcccccattccccacaggacagaggccagccgtgtttcccttccccaggggtggattgggtcagggagggaagggacctcaggtgctcagaactggctcgccagaacacaccatcctcattcaccagcctcgtgggcaactgaccgatcagctgccctccagccactctcctcctgccccggctttctaatctggctgctctagggggactgcctcctacttcatgggctctctgcgtgccactgctctgttgctctctctgtctggaatgtgccccctgcccccaacacacacacactccacctcactcctctgtccatgccacttcctccagagagtccgccctggcctccctgccctgcccatgtcgcccacagccctggaatgcctcactccacctcactggtccacgggtgcccgttggttcccccaccccaaggacagtccctgtcctcagatgtacatctgacactgtcaaaggacctggcacatagtagctactccaggaatacttattagtgaaagaaggggcgggattcagacctaccccacacatctggtggcctcagcgcctcgcacgtcacatttgtcagtgtgcactctgagtgcggcctcccctccctagtcactaactcaacctctctgggcctcagttgctttgtgcattagttcgttctcatgctggtgatacccacatacctgagactgggtaatttacaaagaaagaagtttaattgactcacagttcacagttcagcatggctggggaggcctcaggaaacttacaatcatggcagaaggcacctcttcgcagagcggcaggagagagaatgagtgctcagcaaagggggaagccctttataaaaccatcagatcttgtgagaactcagtcactctcacgagaacagcatgggggaaacggaccccatgattcagttatctccacctggtcccacctttgacatgtggggattattacaattcaaggcgagatttgagtgggaacacacggccaaactatatcactttacatgtaaaatgggacagcagtgccaccttacagatttatcgtgagaactaagccaagcagctaatagagcctgacatacagcatgtgtcagtgctgtgtgctaattgcatgtgaccccagtgtctggcatacagcaggtgctcagcgcatgtgaccccatgtgtgtccttctttcccctcctgcctcctctccagtcagttctcactgtggctctctctacaccgtgggggagcaagggaggagtctcagggtgtcctcgtgcgtgccccactgacttctgccctccctcctccagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcaggtagagcactggggtccttcctggcactggggtggcactggggtccttcctggcaactcaccagagacaccaacctagacctcagggcatctgggtattgcaggcagcagctcctgccctcgaagccccagagctggcaggtgctgggggccagtgcttggggcgtggggactcagagggagcaggtgatgcagtttgagcctgctgctgcttatgctttgcagcagctgcctggagatcccggagggagacccgggagccctgccgggagctaaggcaggcgacccacacctggattatgagctcctagacacggcaggtgagcacgcccaaccctgaacctccacagcagtccacctcccctgggcagagcagggagctgatgagaaagccggggcctctctccagggaaagggcagatagaagcagagctcaacttctgccctgggccttgaccttggcctcgaccttgcactttgggaaagtcccgcctgccagccagcgtaagccaaaggccggctgcgctctgtctgctggtgtccttgtgtttttccctagagccaggggagttgtgtctgatccacgccctgctcagcacccagccccctgctctgatctgtaacgcttgggcttcccagtggtttcagaaggcagcaggcagggtggcttagtggtgccaggctgaggcgaggcacagcgtgacatctacctgcggggagcatctctcctctcaggcgctggccctgaggcctcgcgcttctcctgtagctcatttctgtttgtgattggaccggccctctctgcttcccaagtccatgggcccgtcatgggtgggtgccttaatcctttccacctcggcgcgaccggctcccagccttgggccttgcacacagtaggtgctttgctccccatttggaattcaccccatggccaccagggggcgcaagtgccctgcgctgcccctgtgccttctgtgggtcgcagaatcagaaatcttcatctttggggactcatacacgtttttatttataatcgtgataaatcgagagagaccacccaaggcatatctaaattagatgtgagatgagaagaggggcttattcctctttatttttcctctgtgaggattctgcgtaatgccctggttgcatatacttttagtggaattgacctcaaatacatccagagtacacagctcatttcattggctttgaatgtgatcccaatgggtttttgcctgtgagccaggcctagggaactctcaggtctctgctggccctggctctgctgtgtggttcacagagtgagacttgcagccgtcgaccctggcaggctgctccctggttcgggggctcacaggctgtacagtaaaatgctagagcttgggagaccctggggagcctctagtcctaggattgacaactcagagacctgccaccaccagctgggaagcagaggagtctggggtaaggagcaggcagctgctggccagtgccagtgattgcggccacacagaaatgcaggcctgtgtggaaatgcaggccagtgtggaaatgcaggccagtgtggaaatgccgtgtagtacagtagtgcaggtctgggtagaaatgcaggtccatgtttgggaggtcaaggtgggcggatcatgagctcaagagatcgagaccatcttggccaacatggtgaaacctcgtctctactaaaaatacaaaagtcagctgggcatggtggcacacacctgtagtcccagttagtcaggaggctgaggcaggagaatcacttgaacctgggaggtggaggttgcagtgagccaagatcgcaccactgcactccagcctggcgacagagcgagactcagtctcaacaacaataacaacaacaacaaaagaaatacagatccatgtagaaaggcaggccagggccgggtgtggtggctcatgcctgtaatcccagcactttgggaggccaaagtgggtggatcatgaggtcaggagttcgagaccagcctggtcaacatggtgaactcccgtatctactaaaaatacaaaaattatctgggcgtggtggcacatgcctctagtcccagctactcaggaggctgaggcagaagaattgcttgaacccgggaggcggaggttgcagtgagctgagatcacggcactgtactccagcctgggcgacagagtgagactctgtctcaaaaaaaaaaaaaagaaagaaagaaagaaagaaagacaggccagtgcagtgcaggcccacgcagacatggaggtcaatgcagtaatgcaggccagtcctgaaatgcaggtccatgcagaaatacaggtcagtgcggaaatgcagccccagggttacagcagatattttttcaagtgaagccagaaatccagattttaggtgaaacctccctgtctttcaaatgttggcaactcattcaaatatcacaaaatagcatgtggtggtcagaccctcccagttgcagctcctcactagttacagtgattttaggaaagatgaaatcaaggtcccaagcattgaggaaggggtggaggaagagaaagttcagcctcagcacaaaggatggaacaggcagtggggcctgaggctgagggagaaggggctgaggttacaggaggttacaggacgccccatcagcagtggggtgaccaagatctgtgaagaaggggctgaggttacaggaggttacaggacgccccatcagcagtggggtgaccaagatctgtgagctcttggcttcctcccagaccttccgcagctggaaagcagcctgcagccagtctcccctggaaggcttgatgtctcggagaggtaagcagcaggtgggaatcctccgaggctggctggggaaccagggccagggagtggcagagcagagggtgagtgtcctattaccaatgggaggcaacagcctttccaagcacatggggccatggagggggaggagaattccagaacactggggccagagggaagcaatggggaggtggccttgccggctctcctgctctgggcagtgcacaagccggtcgtctcccggcctgcagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggtgagccgtgcgaggcccctcctgtcccccgggctcctcatggggacagtggcagcgggtggggtgacccaggcagacttcacctcccccagacgatgcagatccactctgggctgggcctctgctctttcctgggctgacgtaaagcgttctgctcatttatagatgagagtcgtgccgtgcagaacccagcatgtcacccgtggtgctgctgccatgcggcgcttctgaccaggggtctttgcatgaggccccttgacagggctgctctgggtggtcactttgggtgtgtacagtaaaatacacgtgacataaaattcactattttaacca

SEQ ID NO: 2375 - DNA, 39340 bp, Homo sapiens
  source 1..39340: mol_type = genomic DNA
cactgccgttcagttcagccagagattgggccacattcagtcctcgcttccctgggagggggaaggtaagtgcgcgcagtccatccggcgaagagcaggtcagcctacggagggctcagcctacggaggggctcagccgacacaggtctgatggggcccgagagtggtcccaggggagtgggaggggccggcatcttcctcatcaggagtggaggagctgccttgtatgtggactagagaacagaaaacggcttgtctgtgttgctgggtcaatcactggaacattctctgaatgctgagttctgccttaaaacagcatgggtcatgctagatgaaagggatctctgttttatactctcatctcttcgctattgccgtgggatgaaagacagcagaaggaaggtgtctaagttcagaacaaagtgagcaagaccagctggctgctgttggtagcagaggcacagccagcctgtcatggcactggggggccgaggtgagctgtgccccctcctcctgggcttgtgaccctctgccccccatggggtatgtacatgtgtgtgtgtgcgtgtgcgtgtgtgtatgtgtacatgccttcttccctacttcactggcaagggaagagactgacacttgggttaggagaaggatgttgacctgggaggggtcaaataaggagaacccacatcttagatgctcaggattttatgatcttaggctcttctagaattgctgtacagttagattcagagtttggaattagagatctctgggccctcccctcccctcccgtcccctcccctcccgtcccctcccctcctctcccctcccctcctctcccctctcctcccctcccctcttctctcctttttcagaagtctccctctgtcgcccaggctagagttgcagtggcacaatctcggctcactgcaatttctgcctcctgggttcaggtgattctcctgcctcagtctcccaagtagctgggactataggtgcacgccaccacacctggttaatttttttatttttagtagagacagggttttgtcacgttggctaggctggtctcaaactcctgacttcaggtaatccgcccatcttggtctcccaaagtgctgggattacgggcgtgagccacggctcctggcgccttcccattcaccttccccttcccctccccttcctccctccctccctccctccctccctccctcccttccttccttccttccttccttccttccttccttccttctctctctccttcccttccttcctctctctttcttttcttcttttctttctttctttctctctctctctctttctttcttttcctttttttgagccagggtcttgctctgtcacccaggctggagggcagtggcacaatcatagctcactgcagccttgaactcttgagctcaagcaatcctcctgccttggcctccaaagtgctgggattacaggcctgagccactgtgcccagccctaaggttttttgttttgttttgttttgttttactgttaggactaacccttatttacactgggacaagttacaaagaaactcctgcaattgttaactgccattggagactactgtaagttgcttcatggcaactgcagaagggactagtgacttctatttagctccacccactgatgcttgaagttcagtgtggctctgggggctccagaagcctgaggggcagctggctggggcagttggctggggtctggagagttctgcagagcccctgtcttcagctgctggtgaggcagctttggcttgagctgccctggctttctgagttcagtctgatgggagggcacagtcagcaccctcagaccctcctcaggagtcttgtgaggctcgggcaagtcaggggcagagggacaatccaactagaggaccctcccagacccggtcgttgccacctggacccagccccaggaaggcacccgagaaacctgtagtcctcggctgaccaccagtcctggtcctcaggatatccgcagagacctggctgtccagaactcccagggtttcagctgcaagctggagatgtggccccttggcaactcgatatagtaagatactggagagcgtgccagagtgtcatttgctagaaacaaacattatactgcggtaagccctagtttttcagtcattggctctttggcaccaacttaatcacaaggccattggccccaaagaaaggccttgtaggcgactgtttagggacacctgtattttccatctgccttggaacctctaggctcaggccgaatgcctattgaagtagatgtttcgtaagagatttgggggcaaatactgggattttataaagatgctgcactctccttcactaagtagaaagctgagaaatcctgccctgaggggaagaaacagttgtcttcctgactgatgcatcctagaccagccaagacttcctcccgctttccttcttctagaactttccccacttcagccagtatctgtcatcccctgggctcccaccctctccatgtgccgctttcatcggggctgaggggagcaggagaggagacgtttctgctggtgtccccgctgtagctggaggagctcggcgtcggcgtgccttcgcctccccttgccatgatgccccctaaaccgagtctgtattgagagagaaaggtggcaccgttgatcattactccaggacaagagtcataaaaggactgtcccagacaacctaggaccccagtgttctgtggcgaacacttctaggatgaggcccatctccttctctgtttcatcaattggattaattttattgttttctaaaataatgactatggtttttattgaacccatacttgcttattctaaacattcttttttttttttttttttttttttttgaggtagagtttcactctggctcctaggctggaatgcagtggcaccatctcagctctctgcaacctccacttcccaggttcaagcgattctcctgcctcaccctcctgagtagctgggactacaggcgagcaccaccacagccggctaatttttctatttctagtagaaatggggtttcaccatgttggcaggctggtctcgaactctgacctcaagtgatctgcctgcctcagcctctgaaagtgctggattgcaggcgtgagccaccgcaccaggcctaaacagatttctttacaatctaccaccatgaacagcaagcattagcattggtgaggagtgttccagaatccctctgctctctgcctctccatttctctccccctctctttctctctcatgcacacacacacacacacacacacacacgcgcgcgcgcgcgcgcggaatgacaggacagactgatcggcagattggatgaatggatggatgggcacatagattgagggactcccagagataaactaacaccattttataaaaatggtatcatattctacatgattgaaatgtaaacttttaattttacttaaattttagttcagctcagatgttgctggcaaaagtttttttttattatttttattttttatgtactgctccttgaggagctgggctaactcataggcagtgcatccagattcggcatttttttttttttagatggagtctcgcactgtcaccctggctggagtgcaatggcacaatctcggctcactgcaacctctgcctcccaggttcaagtgattctcctgcctcagcttcccaagtagctgggattacaggcacacaccaccacacctgcctaattttttgtattttagtacagatggggtttcactatgttggccagactggtctcgaactcctgaccttatgatctgcccacctcggcctcccaaagtgctgggattacaggcgtgaaccatcgcgcccagccaaaaaatattttttaattgttaaaaataataatggaatgccaaatgtagtagaacagtttcacaatgacaagaactattagttcctaaaaaatccccaagattcagataagagattacaaaaaccttgataaattagtgacattatgtaaaatcaacagtgctgggtttggtggctcagacctgtaatcattgcacttagggaggcagaggcgggaggagtgcttgagcccaggagtttgagagcctggccaacatagcaagaccccattctccacaaaacggaaaatacaataaaataaaatcagcgttttgttttattttattaatttatttgagatggagtctcggtctgtctccctggctggagtgcagtggcgtaatctcagctcactgcagcctctgcctcccgggtttaagcgattctcctgcctcagcctcccaagtagttgggattacaggcatgtaccaccacacccagctaatatttgtatttttagtagagacagggttttgccatgttggccagactggtctggaactcctgacctcaggcgacctgcccgtctctgcctcccaaagtgctgggattacaggcgtgagccacgtcgcctggacttcctttattttagatagcacagggtcatggaagataaagtgatgccttccttcccctaccccctaccccgatttctactgcttgcattatttcttagggtaaagaatcttcttatttggctggaagactctattcccaccgtagtttagtcctggatgtgtgattaaagaaatccagtggttgccctgcgctgagaaggacagccgggcctgggttctctcctggctcagtacagccccctccccactcctgctgaggactcccagggaagctggaggcagctctggggcgttttctctgacttccctagacttctcttcagctgcccaaacagtagagggatgctgaagccctctcttcccgcagtctgtccctaagggttgcgctggcacctgtgcccccagtgccccttggcagcactcctttggtttcagggcttgtctgccatttttcttttttctttctttcttttttttttttaagacagggtctcagtctgtcatccaggctggagtgcagtgatgcaatctcatttcactgcaacctctgcctcccgggctcaagtgatccttccacctcagcctcccaagtagcttggggaccacaggctcacgctaccatgcccggctaatttttgtattttttgtagagacagggtttcgccatgtcacccaggctggtcttgaactcctgggctcaagcgatctgcctgcctcagcctcccaaagttctgggattgcaggtgtgagccaccatgcccggcctgctatttttcagtttgtggcagaaaagttgttttcctttcctcattttgtggttgctgctttattcacttatttatttttttaactttttaaaacgcaacatttggttcatttcaccaggagctggggagggaggtacaggaggctgccctgatcctttgttgggtttgatctggagactttgacgtgacagagcgactgcgcccactggttgtcctctaagaaggcgtgaggggaagcccagacgcctctgcaggagccagagacattcctagggggtcacagggtcagctgaggtgaacagggattctggaatgaggaagccaaggggatggaagggaggaggctggcagggaaacgcccagagcacgtgctcctgcccgacacctccaggcagagaacaggagctggcaagagaggaaccccgcttgtggtggggacgctgaacaggcagggcctggctgggatgggggcccagcctaggctgaaaacgaagagaaaggaaagtgggtgccggtgtcccacgcactgtggacccccagccctggccctggggtggcaggggcagaaccgggcactgcagggacctcctcagcccaccctcctcctgcttcctggcagggatgagagagggaagcaggaggcagggtgggattgccagctgctctcggatcgttttttttttttttttttttttttttttttttttttttttaaaaacgggatcgtgctatgttgctaggctagtcttgaactcctgggctcaagcgatcctcctgcctctgccttccaaattacaggcatgagccactgcaccaagcctggatctttttttttttttttaaacaactttgttgaaatataactcacggccaaacacagtggctcacacctataatcctagcactttcggaggctgaggggggaggatcacttgagcctaggagtttgagaccagcccaggcaacatagtgagacccccttctttacaaaaaacaacaacaacaaaaaaaatgagcctggcatgggggcacatatctgtattcccagatactccggaggctaaggtagaggatcacttaagcccagaagacggatgttgccgtgagctgagattgcaccattgcactccagcctgagcaacagagcaagaccttgtctcaaaaaaaaaaaaaaaaaaaaaggaagagctataacccatacggcacacaattcacccgtttaagatgcttctagtgtattcacagatgtgtgcaatcgccgccacagttaactttaggacattccatcatctgtaaaggaaacatcccctacctttagctaccatcctgacatcctgatagacagggggcctgaagacccctcggtgatgcagggcagggctggagtgggggccctgggctgactttattgctcgctattgctgccttgaaattctgaatacgtttttaaaacaaacgcaccatcctttcattttgccctgagctccacagacgatatagctggtcctgaagtggggcagaggatcattctgacttggagtcagactctagcgacgcaggcttctactgggtggaggcccaggagctcaggagccttctgtgggagtgtgcccattggcagcgcatccctggagatggacggacaatttccacatcgcctttgcccctgtgcacgctccctctggctgccgtcataaattaccacaaactgggtggcttaaaacaacagaaatgtatttgctcatggttctggaggccagaagtccacactccaggggtgagcagggccgcacccccatgaaggctccagggagggtctgcttcatgccttctcttgagtttctagtgttgccaccgacccttggcgtgtcactccagtctcggcctctgccaacatggggtgatcatggggtgtctaggcctagggcccttctcctcctcttcttcttcttctttcttttttttttaagacagggtcttgctctgtcgtccaggctggagtggagtggcactacctcagctctgcaacctacacctcccaggctcaagcgatcctcccacctcagcctcctaagtagctgcgactacaggtgtgcaccacaacacctggctaattaaaaaaaaaatttttttaggccaggtgcagtggttcatgcctgtaatcccagcactttgggaggccgaggcaggcggatcacttgaggtcaggagatcgagaccagcctggccaacatggtgaaaccttgtctctactaaaaataaagaattagctgggcatggtggcatgcacctgtgatcccagatactcagaaggctgaggcaggagaattgcttgaacccgggagacaaaggttgcagtgagccaagattgtgccattgcactgcagcctgggagacgagcaagactctgtctcaaaaaaaaaaaatttttttttagcagattttagcagagacaaggtctcactgtgttgcccaggctggtctcaaactcctgagctcaagcaatctgcccgccttggcctttcaaagtgtgggattacaggcatgagccaccacacccagcccttctcctcttgttataagggcacccatccctggactagggcccaccctaatgacctcaacttgattacgttggcagagacttattcccaaatgaggtcctacttacaggtactgggggtcaagacttcagcattcttttgcggggggccacaatcagtgacaccctgactcgcaagcctcaatcacctgttccagtgagaaacaggactgagatcagaaggaatgaggcagagctgccctcgattggttctcctctcctcctcacctgcccaccccggcctctgcgcccgtcactgtcctctccagctgttcttccttccgggcaaggagactcagcagaagggtatgagtggcctggccctgtggggagccgcagacaggcctgtgggtgctttggataactactgcgcctgtcaactctccttggtagtctagggttcaaagcccaggtccattctagaagtctgcttccaagtgctaaggaagcttcaatagttactgggaaaaccacaggggtcaaaggtccgtcgagttatttcccggatccgagtctgacgtcttttccccgccgcttgcggtggttgtgaccgaaccttgagttttggaacaggtcacatggctttgaaatcacggtcaattcacctggtgctgctttgacttcaggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttggtgagtacttccggagacccggctcctgggacggcttctggcgctgctcctgcacacacgactctccaacgatcattttccatgttttatttttatcttttaatttttgagatggagtctcactctgtcacccaggctggagtgcaatgatgcaatctcagcttactgcaacctctgcctcccaggttcaagtgattgtcctgcctcagcttctcaagtagctgggactacaggcacccgtcaccatgactggctaatttttgtattttcaatagagacgggtttccaccatgttggtcaggctagtctcaaactcctgacctcaggtgatctgcccgccttggcctcccaaagtgctgggattacaggcatgagccactggccccggcccattttccatttttcagatgacaggtgttgatttgctctgattttcaagtatttttagcatacagatccctgcaagaggcatctgtctccagtggtccagcctctccttccaaatgaaaagaatcaagtcacaggaattcatgggtctgtaaggaatcgctcccatctgtgcccaggagattaacaaaggcggtggctgcagctctgtgagcagtggagaaaaattaggcacaacctgatatcctcccacaggagcgtaagtccactgtggttattcatatcattgaatccagtgcacagtttaaaggaccatgcatgtatcaagctgcatgtatcagtatgagaaacctcagaagccgtacagccttgcacagaacgatagtttctgtgaagttccagctaacactgaaggcactgttgatgtaaagctgctgtctgcacgaagtatcatgcaaagatgctatgtactgtttatacacacttccatttgtaggaaatgatttttaaaatatcatttttaggctggactgtaatcccagcactttcagaggctgaggtagacagatcacctgagcccagaagttcgagaccagcctgagcaacatacggagattccatctctacaaaaattaaaaaagaagccaggcatggtggcgcatgcctgcggtctcagctacttgagaggctgaggtgggaggattgcttgggtctgggagctcaaggctgcagtgagccacgatcacgctactgcgttccagcctgggcaacagagtgagaccctacctcaaaaaaaatcatttttaaatgattttagaatgtctggccagagagggagggaagagggactgaagagaacaaaaaggcgccatctgcctcgcatttccttaaaaagaaacctgaagtgcagaatgtcaagatggttgaatccgcatggtagatatgtggatatttgttatttgcaggattttttaatatgctgaaaacagtgcacagttttaaaacattttaaaattatttagatggattaatgggctaatggcctcatgttgatgccagagaggggctcaggcaggggcacagtggggtacacagctcatctctcgctgggatgggaggctgggcaggtgacggctgaggacctccaacagctcttagagtctgcactagccagcatgtcccctgaagagcaggtgttccgggctgtaacggcgacctgcttcgtgtattctgtccagacagacctgggcttgggacatcagccctggtggtggccccagatcagctgcagctcagccctttcggggacctgtccaccctctgtctgcctcgccatctttgtaagcccacaccccccgcagccgagccgtgctggccgttactaccctgaagtgtcttctgcgaggcacttgtgcccagtgtcactccccagcacatttccctcatgtggagtcctctgcgcagtcctctgtgtcactgtcctgggccgctgcaaacaagggaccacctgctgcgtagttgaaaacaatgggaacttttttttttgtttttttagacagagtcttgctctgttgcccaggctggagtgcagtggcacgatctcggctctagagaagccgacagtcttgcttctaatgaaaattacctttcataaagaacttataaagcagcatttccaaagtgcagcacccctactgttatttgtttgtttgtttgtttgtttgtgtgtttgtttaccgggacagggtctccctctgtcacccaggctggagtgcagtggcacaatctcagctcaccacaacctctgtatcccaggctcaagtgatcctcctgcctcagcctcctaagtagctgggattgcaggtgcataccaccatgcctgactaatttttgtatttttagtagagacagggtttcaccatatttgccaggctggtctcgaactcttaggcttgagcaatccttcccccttcgcctctcaaagtgctgggattataggcgtgagccaatacgcctagcctactaccattattttagatgaatttctaaaaaaaaaaaaaagtatttatttactttaattttttagaaaaagctgtaactgacacaacaaagtgtgatttagtgactttattgcttaggattggggtagagcaggtggggccgtggcactcaaccttacacagagggagaaaccagaatggcaaatggccactggaatgcttcctctgccgtaaacatctcaagactgtgggttctgactggcaaagagtgcgccttgctaattttacgatggagttgattttaaaacggtgtcaccctggctatcctggggtcctgcttacctgacaactccacccccatggccacccctcctagggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccggtgagcgcagctccctcttccccacctcttccagcttcccgtggcccacatggctccactgtctgcctctgtcttcagggggtctcttctcgtcctgtctcttataaaaacacttgctgttgcctttagggcccacctggataaccaggatgatctgatcttgaaatcattaacttatatctgcaaaggcccttttcccaaaaaaggtcatctggacaggttccaggtggatgtgtctttgaaggggaaccaccattcacaccactacagctgtctttggagtccattctgatggtctgactagtgtttattcattaaaaaatggggatggtaatggctttactgtatacggttgttaggagaagcaaatgagttactgtttataaaacactcactgcaaagctggggccatagaaaacaggcagtaggtggtagctgtcaacatgataatgttcatgcatgttggcgtacgaaccccaaacacaggagagattgatgcacgctggtcattctggctgagagagatgggctctgggccctgggcgtggaaggccccgaggctctctgggacctgtcacccgcagccccggggtgccactctgctttctgtgcgcagctccaaagctgacagcaccgtggtgggaccctgcgtctgcatcacccaccagcttgccagggaggtgcttgcaagcagggacccacctcctcaccccgtcccggtccccccgcactcgccagagcactggggttgcagtagttgctcgatacatgccagctttgcccttctcgagtctgactgaggtcatgggggtaaagggagcctgtgagagcagtgagggcgcgtcccacccagcagaacccagaaaaccgctttcacctcccgattcttacatgtgcggggggtttcccagccccaggcctctcccccgtggggaagccagccagggagcccagcccccttggtagctgggttctgcccagacagacggttctgcctcccaagggcacttgctggatttgctgaagactcgagggaagaacggggccatcgccttcctggagagcctgaagttccacaaccctgacgtctacaccctggtcaccgggctgcagcctgatgttgacttcagtaactttagcggtgagagctccgactttgacggtttggcaggcacttctaggaacctcaggctcctggtaaccccaggtgccccgcttacttgccgatttgccctactcccccttccctccaggctgcagttcctgtcccagccccagcactctgagggtgaggaaccccctcactgtattggggttggataggataaggagcccctgggccttgactctgaagggtcggtccttagttacccagtgccaaaaggagacccctgagcggtagggtggggagaatctgcttggagagacacaagcaaagggcaagggagtgtctcctggagtccgcctttaaccttgcggctttgctggaggggccagaacggcccagcctcagctcttaggaggcgacagagcggccccggccagagggtacagggccttggcagggccgcggagccttctgtgcactgctcaccattttccttcagggagtaattctaggcttccctggaggagctgttgaaagatttaggtattgaaaggagcaggagcaggactcacacgacccaaaacagtggagaatagaccattttccctgtgttccagcacggtgtgtgtttatgttctttagagttctagtacgcggattcgtattctttttttatctttttctcaggataacgttaaaatgagttagcactgagtgcatttcagctaccgaggagggtcattaagtctgaacagtggggtctcacggggaaggtcagagtgggtaaccctcgtgccaaaatcgggagtcacgctgtttattcaaccaaaagaccaagtctgcttgaggtccaggagcttttaaggagaccagcaggttaaagctgggggcctgctggggagtctgggcaaggctgtgggggcatgggagtcatgcctcggcccaccggcccatctgtgcacctgcacacctgcccacatgcccacccgcccacatgctcagctgcccacatgctcacccgcccacatgctcacccgcccacatgctcacctgcccacatgctcacctgcccacctgctcacctgctcacctacccacctgcccacctattacctccctacctgctcacttgctcacctgcccatctgcccacaggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggaggtagggggacaccctgcaccccggcgcgaccctgctgtcgtctgcccccaggcctttgtactagctggtccatctccctggaactcctttcccctcttccttgtctaacacttccctgccccgagagccttggctgagacccctctgggaagctgatccttcccctccccaggaggccacccaggcccctctgtgtagcctgcatggcgacgaggtgtgccttgtccagtagctgcccgtggcctggctggcttgtctgtgaactgcccatcctgctgacgcctgggcaggtctggacacactctgggctgcatatttgtagggccgcctacgtcccactgcccagctgcggcagtgacatgggatagtcggcctctgtcatcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcggggagggcaggagggttctcaagtgaggcctctgaaactcagtgtgtttcactcacttttctttggggaggatgatctgactgattggtaaggcttctcaaaatactgaggatgtgcactccttgtcattttggcatttgctttttacctttattattattactattatttttaattttttagaggcactatctcgctctgtcaccaaggctggagtgcagtggtacaatcctagctcactacagccttaaactcctgagctcaagtgatccccagcctcccgagtagctgggactacagattgtaccaccatacccagctaattaaaaaaaaattttttttgaaatggggggttctcattatgttgcccaggctggtctcggactcttgggctcaagcgatcctcccacctcggcctccaaagtgctgggattacaggtgtgagcccctgcgctggccagcgctttgcctttaatcatgacatttgttgtttgtttttaattttttacttcttatttagaaataattccaaatatatatttttaaatcacacaaataaaaatagtacaaataatacccacctacccttgctttatcatttgtacttttactctctcgtggccctttatgtctacttcctgaaaatcagcacctgcccctatatagccacagtgcagttctcaacttcagtctttttggtatggacgccctgtttttatccaatccgcctgtgttctggttttctcatctgtcccagtgactccttcacagcctttcccccagcccagggtcgggccctgtgttctgctgttcctctctttagccaccttcatttgggaacagcccacagcctttctttgtctattatgaggtggccctctttaaagcccccaccccttccctttgatgatagacgacctctcatttggggtttgtcttgtgtttcccacatgtatacagaaattatgttctttggccgggaccctgcacagggggtgctggcctgactcagggcatctcctcgagggctctcgaggtcctgtcgcccctcacaggggacgtcacaccgtccaccatttgtcaaggtgcaggccaattgctctactgcagaatggctctttcttttcttccctgcaactgataaatatctcgggtgtggggcgctgagaccagcaagcaccctgctcctggtggacatttcccaggatgtagctgtggtgactctggcgggagctggcccctaccctgggagctgtgaatgacgaccgtgccagtgctccaccttgctgctgcccacggcctctgccttcccttctcccttggctgactttggaccaggccagcccactttgctgctgcccacggcctctgccttcccttctcccgtggctgactctgttcttggcgcagttcatgggttcctactctgcaggggtctgacctctcactgtccttaatgattttggtctcaaatggacccagatgtgaccaatggaacccttcaaccagctccgtgtcctaaaacgggtcccttgtttttggagaaccaactgcttttctggcctcacaagatattccagggtcatcttgtacccggcctaccccaaatccaggctcagcccattctctgagggccccacttcctttttttatttttattttttggtttgtttttttgagacagagtctcactcgcttcccaagctggagtgcagtggcgccatctcagcccactgcaatctccatctcccgggttcaagcaattctcctgcctcagcctcccgagcagctgggattataggcgcgcaccaccacacctggctaatttttcgtatttttagtagagacggggttttgccatgttggccaggctggtctcaaactcctgacctcaggtgatccgcccacctcggtctcccaaagtgctgggattacaggcatgagccaccacgcccggcctcctgcctccttttagagaacaagatgtgggcgtaggtgtgtccatcactactagggtgtctttgcttctcagccctttcaggggacagagctaggaaacacacacacatgtatggacatatacatacacatatgcacacacatacttgtctgtgtacacacacatactcatatgcatggaagtatacatatagttcacgtgcatacttcagaaatcatgggttctcacccatacctctaattccaacccatgccctgcggctttttcttgccttctcctgttccgtacgtgtgtgctccttccccagggggaacgctgctcccagcgtcaccagcaccttcagacccgtgctcagtcctgcagcacatctcaaatcgtttcagaatcactctgcccataccactgccattaacagccccgctaagacgggtgccggacttgtttgtaattcacctccccccgccagccaatcttgctcaaggctgagggtttgtaatcaaacactgtgtttgtgagtcactgtatcttcgttctctctgtccttgtctgtctgtctctctcttcgttgtggttatggcgtctgttggaaatagaattcggttcatttgttctggttcactttcagtctcatgttttccggttcccttccagctctgacttgattttactttttgaatctgtggacggtgacatgcccagcccagctggaccattgcaggagctgggaacttgcgaattgacaatgtgctaaccgggtgtcgggaggggagagtccaggtggaaaggtccttcttggccacagcccaggggtgagcaccggcacccaccccgacgtgcagacttcccgggcttgcctcacggggaaagtcctgcctccccagggctgccacacccaggacgggaagagggcgggcccgtggctcgagctccaagtttctcttgggctgctgtccagaggaaggaggccagcaggacctggtgggatagtccctggaaggccagggccctgcacacagactgcaagtcaacacaggagctttgctgtctgaacagccccggtcccgcgttcccaggcacgtctacccctccgacctgactttcctctctcttacttcttactgatttccatgactccaaattccctttcttgatgtatttagcagaacatggacaagcagggaagccagggagcatgctggccatcactgccggctgctcagctgtagagatccaggagttggttatcaaggcctcttggtctattcctgggaccctaaccctggatggagttcaaccgcggtgcctcatctataagacagagctgaaaggcctctgtcctcccagccccagttgaatatttgggactattcattaggtgaaccctttcgtgggtttttcagtctcgaggcaggaagccccctgagtgctaaaagcatcattaggaggaagggtgagaaatgcccccagctcctgatcaggggagaagctgtttccatcgcccttcctgtcgcctccccaccgcacagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggtaggttccggtccccgcagcagagagcggcctcctgccttgggggcttggccctcaggctgtggggtttctgacaggtggtttagttaaggtgaggctaagaacaagagatgaaatttagtgactcatctcacccactttctctttacctccttccttcctgctgttccccagaccccaaaattggcagaattaaaagctgctggaacagaattaaaagctggaactgggcacagtggctcattcctgtaatcccagcacttgggaggccaagatgggcaagatagcttgagctcaggagttcaagaccagcctgggcaacatggcgagaccccatctctacaaaaaatacaaaaagtagccgggcatggtggtgcacacctgtggtcccagctattcgggaggctgaggtgggaggatcgcttgaccctgggagtttcaggctgcagggagctgagatcacgccactgcactccagcctggcgacagagggagaccctgtctcaaacaaacaaaaataaaagccgctggaggtgcatcacaatgcccgacttggtgggtttactgcagcgactgtgttctggagtggacttggccaattgtaaagcatgggattcgcgttaaggatgggggaaagaaacctttctgcctggaaagactccgccctctgggcctcaggtgcactggagagaggggggctctgaagtggagcagtgagtgagcaacgacccttggcgtctcctcctcggcccctctcagtagattggtatttattgagatattccttccataagcattcactgggcccagggcactggccatcttgcagcccggattgtgtctctgtttataagctccttcctgggaagtgagtgtcagaggggaatgacctgtctgctggtttctccctcgctgtgaaactgccggtagatctgttgaaggagaaggctgacctggtaaagggaggaactggtgtcctcagaggttgccagcttcctgtgttccttctccttggccatgaatctgcacttttcccaggcatgatgggtggcttttccgtggcttctctcctgcccggtgtagagtggcaagactgcatccgtccacacacctgaccgtgcagttgccgccatcttctcgggattctgcttgcctagggcaggcctctggggaagccagcaccccaggctgacctctctctgccccaggcggagaaggacattctggagcagagcctggacgaggcgcgggggagccgacaggagctggtggagcgcatccactcgctgcgggagcgggccgtggctgccgagaggcagcgagagcaggtgccgtgtgagcccttcctcccttgtgactctcctggggcttgtctcaggggtgcggacaggtctgtggggaagccagattccttcatccacgccgagctcacataattttgctgaacgaatctgtcggcctgttcatctgtccctttgtcagcgccaccctaagcaccgactcgcaccccacagctaagaccatggtcaggcagatgcgtgattcaaacgcaggggatttcagggcccaggccccggggagagccagggacttaggtgaggagggaacggggaggaaaggagacggtagaagagaagaggacagggagggaaaattgtttttctgggacattaaaaacgcaaaacacaactatgcatgcaacatcccctcattgttttaattcagacgtaatcagcctaagcaactttctagatgcacctcgaaatctagcacttaagagacgagcgaggccgggcgcggtggcccacgcatgtagtcagcactttggaaggccgaggcaggcggatcacttgaggtcaggagttccagaccagcctggccaatatagtgaaaccctgtctctactaaaaatacaaaaattagctgggcctggtggtgtgtgcctgtaatcccagctactagggagactgaggcacgagaatcgcttgaacccgggaagcagaggttgcagcgagccgagattgcgccattgcactccagccttggcatcgcagcgagtctctgtctcaaaaaaaaaaaaaaaaagagagagagagacgagtgagaattgaccttatttcatccctagaactgtctccctccctccacccctgggttccccgacccccttctaaggccagaccctcagagctgctgagcttcacggtccatgtgtcccactctgtccagtactgggaagagaaggaacagaccctgctgcagttccagaagagtaagatggcctgccaactctacagggagaaggtgaatgcgctgcaggcccaggtgtgcgagctgcagaaggagcgagaccaggtacctgagaggccgggcccaccccgccaccccatgcttgcttccccaggtgagggctggttccggggacagtctcgtggctccctgcccttgatggcagctggtcccagatttcagggtctctttcctcggtccacacgaagtttcttcactcctccaggcctgttgtccacatgctgtctctatcatccttcttgctcttattcctggtacatgacactgagaaagtacaccccaaatactgggttttatcaacactgcacatgtgaacacgaattgaaatgaatcttaagtttgcacagctcagcgtgggccatttagtggatgtcagatgagcgcaggctagaaacagggctctccttctctagctgaggctccccggtggtgatggcgcggcctccttactcccgtcgtggcccacaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtggtgagtgttcccggctgacccgagctggaggccaggcaggggctgcggtgacagtgggacagagctgggctccagggtggcccatggaggcactgggaggacaggcagggtcccaggctgggccacacgcggcacctgcagagacggcccagtgtcactgtgatgagcgacacactggctcccacgcgtggatggtgccgtgaaacctcgaaggtgcccagtagacaagtagagtctgcctccatatcatcgaatggggagcttagcggaaggttctggaacctgtggagtgtggtgatggatgtggcaggtggcgtttgaagctgtccacaggcagccatttgcagtgtagatgctgtgttcctgaaatgcttaaaagcccagcgtccaagagtggaaagacagacctacatgtaacggagggagcgtgttcccagaaagccagaattcttagaaagcctctcattctgggctggcaggcagctccagctccaggcccccggggaggcaaaggagctcctccctccgcatgcggaacccacccggcccttccttccttaccccctgcatggcaagcatcccacaccgacggtggaaacacacgtgtgcacgcagagaaaaaccctcccggggcaggcaccaacacgcaggctgtgctcattctgggtgtgagatgacgggtggattttattttcttctctaactggttctacttgccttcctccaattttctgtgtgtgtatgtatgtgtgtgtattatacattattcgtaaaactagtaaatcacacatattctaaaagaaatgaaatgctgtgtgtccagctggtttctttcagtctctttgattggcagcgcctgtgatcctgtgatgggctcggaggacagggacacaattgttttccctggaagctgacgagaggaaactgctggggagggtgaaatgggtggtgctgacctggtagaaactccacgggcctcaaagcggaacctttcccgaattaaccagcctgtctggcctgtctttggcagctcaagcaggaagccaggaccagggagccctgtccacgggagaagcagcggctggtgcggatgcatgccatctgccccagagacgacagcgactgcagcctcgtcagctccacagaggtacggccgctcctcccgcctccctcactgccttgaccctctgggccagcccaggggcctctctgtcaggacgaaagtgagcctccttccaccctgtccccacagggaagaggttggtacgattgtgagagttttattttattttattttttgagacagagtctcctctgtcacccaggctggagtgcagtgatgtgatttcggctcactgcaacctccacctcccaggttcaagcgattctcttgcctcagccacccaagtagctgcattacagacacctgccaccatgcccagctaatttttgtgtttttagtagagagggtttcaacatgttggccaggctggtcttgaactcctgacctcaaatgatctgccagcctcagcctcccaaagtgctgggattacaggcatgagccaccgcacctggccctattgcgagagttttaaacatcagaggttgattctgtcacagtcctggagcccagacatccaaagtcaaagtgctgacagggtacccgtctggaaatcctattcccaaagaaggtcacattcacagcttgcagggtggacatgagtttccaggggaaccgattcaacctggcacagacagtccccagacatgagtttccaggggattcaacctggcacagacagtccccagacatgagtttccaggggacccaattcgacctggcacagacagtccccagacatgagtttccaggggacccgattcgacctggcacagacagtccccagacatgagtttccaggggacccgattcaacctggcacacatggtccctgggatgccggcctcactgtggtttctggagcctcaggaccctggcatctgtcctcaccctttggcaaagtaaagaggtggtcccaccatagtgggcatgtggcatgaggatgctgggggtcaaagccccagtgccacaggatgccgggagccgggagggagggagggtgagaggcgggcgaggctgacatccctttgccatgccttggggtggacctggtgtttccttcctggaccatcccatcagtggcccaagagcagcaggcccaggctcacctgccccctggccactcagagagctgggggaggccgggatcttccccagaacactgagtgcacacacggggaagatttcacagtcggtgctgggcctccctgggccaggacagtccaaaccttcaactgaatcgactctcgcatctgccttaacgccctctgtgcccccattccccacaggacagaggccagccgtgtttcccttccccaggggtggattgggtcagggagggaagggacctcaggtgctcagaactggctcgccagaacacaccatcctcattcaccagcctcgtgggcaactgaccgatcagctgccctccagccactctcctcctgccccggctttctaatctggctgctctagggggactgcctcctacttcatgggctctctgcgtgccactgctctgttgctctctctgtctggaatgtgccccctgcccccaacacacacacactccacctcactcctctgtccatgccacttcctccagagagtccgccctggcctccctgccctgcccatgtcgcccacagccctggaatgcctcactccacctcactggtccacgggtgcccgttggttcccccaccccaaggacagtccctgtcctcagatgtacatctgacactgtcaaaggacctggcacatagtagctactccaggaatacttattagtgaaagaaggggcgggattcagacctaccccacacatctggtggcctcagcgcctcgcacgtcacatttgtcagtgtgcactctgagtgcggcctcccctccctagtcactaactcaacctctctgggcctcagttgctttgtgcattagttcgttctcatgctggtgatacccacatacctgagactgggtaatttacaaagaaagaagtttaattgactcacagttcacagttcagcatggctggggaggcctcaggaaacttacaatcatggcagaaggcacctcttcgcagagcggcaggagagagaatgagtgctcagcaaagggggaagccctttataaaaccatcagatcttgtgagaactcagtcactctcacgagaacagcatgggggaaacggaccccatgattcagttatctccacctggtcccacctttgacatgtggggattattacaattcaaggcgagatttgagtgggaacacacggccaaactatatcactttacatgtaaaatgggacagcagtgccaccttacagatttatcgtgagaactaagccaagcagctaatagagcctgacatacagcatgtgtcagtgctgtgtgctaattgcatgtgaccccagtgtctggcatacagcaggtgctcagcgcatgtgaccccatgtgtgtccttctttcccctcctgcctcctctccagtcagttctcactgtggctctctctacaccgtgggggagcaagggaggagtctcagggtgtcctcgtgcgtgccccactgacttctgccctccctcctccagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcaggtagagcactggggtccttcctggcactggggtggcactggggtccttcctggcaactcaccagagacaccaacctagacctcagggcatctgggtattgcaggcagcagctcctgccctcgaagccccagagctggcaggtgctgggggccagtgcttggggcgtggggactcagagggagcaggtgatgcagtttgagcctgctgctgcttatgctttgcagcagctgcctggagatcccggagggagacccgggagccctgccgggagctaaggcaggcgacccacacctggattatgagctcctagacacggcaggtgagcacgcccaaccctgaacctccacagcagtccacctcccctgggcagagcagggagctgatgagaaagccggggcctctctccagggaaagggcagatagaagcagagctcaacttctgccctgggccttgaccttggcctcgaccttgcactttgggaaagtcccgcctgccagccagcgtaagccaaaggccggctgcgctctgtctgctggtgtccttgtgtttttccctagagccaggggagttgtgtctgatccacgccctgctcagcacccagccccctgctctgatctgtaacgcttgggcttcccagtggtttcagaaggcagcaggcagggtggcttagtggtgccaggctgaggcgaggcacagcgtgacatctacctgcggggagcatctctcctctcaggcgctggccctgaggcctcgcgcttctcctgtagctcatttctgtttgtgattggaccggccctctctgcttcccaagtccatgggcccgtcatgggtgggtgccttaatcctttccacctcggcgcgaccggctcccagccttgggccttgcacacagtaggtgctttgctccccatttggaattcaccccatggccaccagggggcgcaagtgccctgcgctgcccctgtgccttctgtgggtcgcagaatcagaaatcttcatctttggggactcatacacgtttttatttataatcgtgataaatcgagagagaccacccaaggcatatctaaattagatgtgagatgagaagaggggcttattcctctttatttttcctctgtgaggattctgcgtaatgccctggttgcatatacttttagtggaattgacctcaaatacatccagagtacacagctcatttcattggctttgaatgtgatcccaatgggtttttgcctgtgagccaggcctagggaactctcaggtctctgctggccctggctctgctgtgtggttcacagagtgagacttgcagccgtcgaccctggcaggctgctccctggttcgggggctcacaggctgtacagtaaaatgctagagcttgggagaccctggggagcctctagtcctaggattgacaactcagagacctgccaccaccagctgggaagcagaggagtctggggtaaggagcaggcagctgctggccagtgccagtgattgcggccacacagaaatgcaggcctgtgtggaaatgcaggccagtgtggaaatgcaggccagtgtggaaatgccgtgtagtacagtagtgcaggtctgggtagaaatgcaggtccatgtttgggaggtcaaggtgggcggatcatgagctcaagagatcgagaccatcttggccaacatggtgaaacctcgtctctactaaaaatacaaaagtcagctgggcatggtggcacacacctgtagtcccagttagtcaggaggctgaggcaggagaatcacttgaacctgggaggtggaggttgcagtgagccaagatcgcaccactgcactccagcctggcgacagagcgagactcagtctcaacaacaataacaacaacaacaaaagaaatacagatccatgtagaaaggcaggccagggccgggtgtggtggctcatgcctgtaatcccagcactttgggaggccaaagtgggtggatcatgaggtcaggagttcgagaccagcctggtcaacatggtgaactcccgtatctactaaaaatacaaaaattatctgggcgtggtggcacatgcctctagtcccagctactcaggaggctgaggcagaagaattgcttgaacccgggaggcggaggttgcagtgagctgagatcacggcactgtactccagcctgggcgacagagtgagactctgtctcaaaaaaaaaaaaaagaaagaaagaaagaaagaaagacaggccagtgcagtgcaggcccacgcagacatggaggtcaatgcagtaatgcaggccagtcctgaaatgcaggtccatgcagaaatacaggtcagtgcggaaatgcagccccagggttacagcagatattttttcaagtgaagccagaaatccagattttaggtgaaacctccctgtctttcaaatgttggcaactcattcaaatatcacaaaatagcatgtggtggtcagaccctcccagttgcagctcctcactagttacagtgattttaggaaagatgaaatcaaggtcccaagcattgaggaaggggtggaggaagagaaagttcagcctcagcacaaaggatggaacaggcagtggggcctgaggctgagggagaaggggctgaggttacaggaggttacaggacgccccatcagcagtggggtgaccaagatctgtgaagaaggggctgaggttacaggaggttacaggacgccccatcagcagtggggtgaccaagatctgtgagctcttggcttcctcccagaccttccgcagctggaaagcagcctgcagccagtctcccctggaaggcttgatgtctcggagaggtaagcagcaggtgggaatcctccgaggctggctggggaaccagggccagggagtggcagagcagagggtgagtgtcctattaccaatgggaggcaacagcctttccaagcacatggggccatggagggggaggagaattccagaacactggggccagagggaagcaatggggaggtggccttgccggctctcctgctctgggcagtgcacaagccggtcgtctcccggcctgcagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggtgagccgtgcgaggcccctcctgtcccccgggctcctcatggggacagtggcagcgggtggggtgacccaggcagacttcacctcccccagacgatgcagatccactctgggctgggcctctgctctttcctgggctgacgtaaagcgttctgctcatttatagatgagagtcgtgccgtgcagaacccagcatgtcacccgtggtgctgctgccatgcggcgcttctgaccaggggtctttgcatgaggccccttgacagggctgctctgggtggtcactttgggtgtgtacagtaaaatacacgtgacataaaattcactattttaaccactggggcatttcttttctttctttttttttgtttgttgttttgaaacagggtctcactctgtcacccaggctagagtgctgcggtgcgatcacagctcactgcagcctcgacctccccaggctcgattgatcctcccacctcagcctcttaagtagctgggaccagaccacaagcatgcgctaccgtgcccggctaatttggggacattttctaaaacttttttttgttgttgttacgaaacgcacaaaactgctgagaagataaatggacacaaatatacaacctggccaggtgtggtggctcacgcctgtaatcccagcagaaggctgaggcaggcagatcacttgaggtcagaagttcaagaccagcctggccaacacggcgaaaccccgtctctactaaaaatgcaaaaattagccaggtgtggtggtgggcgcctgcatggtcagggggtgactttgatgtggcctaaaagcagaattattaaactttaggaaaaaaaaaaacttctgggcacagtggtacatgcctgtagtcctagctactcagatgcctgagcccaggagattgaggctgcaatgagctaagattgcaccactgcactcgagcctgggtgacagagcaaagccttgtctcaaaaaaaaaaaaaaaaaaaagaaaagaaaaaaaaaggccaggcacggtggcttatgcctgtaatcccagcactttgggaggctggagcaggcagatcacctgaggttaggagtttgagaccagcctggacaacatggtgaaaccccgtttctactaaaaatacaaaaaaaaaaaaaaaatagctggtatctataatcccagctactcaggaggctgaggcaggagaatcacttgaacctgggaggcggaggttgcagtgagctgagatggtgccactgcactccagcctgggtgacagagtgagactcggtctcaaaaaagaaaaaaagaaaagaaaaaggaaagcacagtgctttcttaatatgaaaaaaattttaaaccaagaaatgtgcaagatgggcttcacctcattccagaggctcaccctgcggcctccaggaggggactggggatgggggctctggggtgggaaggtgagcacagaggcggggagaggatgcgtctgaacccctcaggcaggagtgttccatgcacccctcactgcccccttggaacaggctgtccaaatgctgagctcccctagggctccaatgatagcacatggagcacctaattcaagcgtccttcacgtcctccacatgacccgggaagcctttctttacatgtcatttttttttttttttttttttttttgagacagagtcttgctctgtcgcccaggctggagtgcagtggctcgatcttggcccactgcaacctccaccccctgggttcaagcgattctcttgcctcagcctcccatgtagctgggattacaggtgcccgccaccacacccggctaacttttgtatttttagtagagacagggcttcaccatgttggccaggctgatctcgaactcctgacctcaagtgatccacccacctcagcctcctaaagtgctgggattacaggcatcagccaccatgcccagcccttctttacatttctagttgtcctcttaagcagcagtccccaacctttttggcaccagagaccggcttcatggaagacaacttttccacagaccgggttgtgggggatggttttgggatgattcaagcacgttacattgattgtacactttatttctattattattacactgtaatatgtaatgaaagaatcatacactgaaccataattcagaatcagtgggagccctgagcttgttttcctgcaactagacggtcccatctgggggtgatgggagacggtaacagatcatcaggaattagattctcataaggagcgtgaaacctagatccctcacttgcacagttcacgatagggctcatgctcctctgagaatctactgctgtgctgagctgacaggaggtggagctgaggccgtaatgctcacttgcccaccacgcccctcctgctgtgtgacccgggtcctgatggaccatggaccagtaccagtatgtggcccaggggttggggaaccctgctcttaaggttcccaattatcagctctgaggtagttcaagcaacagagccccttgacgatgttcagggagatagtcccgatatcctaagggggccaattagattctaatggtgttaaaacacatcttaatttttattgtaaaaatatctactctcctaagcttagaacaatattgagaagaaatgaagtggatggtggaagccctggggggtgggccttcacagtggggaaggctgtgggtggagagccagggcatcgggtaggtgaaggccagggatgccactcagcatcctgtagggcccggtatagcccgcagcagcacagaatgatcccaaggctaagaaacctctatctagaatgctcttgaatgttctagaaccgaggttctttcttttcttttcttttctttttcaagacaggaaagtgcttatcacaaagaacccccgatctcgactggggaagggttggcagttgactctctggccagcactatgtgtagcacgcatcactagaggtgtgaaggccccacagaggctctggtgtgtggctttgttttgaccaaggcgtgcaggcagtggtcctacggcagggctggcccgcgcctcgcctcagtgccctcagcgccttctgtcttctggctggattcagagtcccgggggaaagagactgaccttctcgacttgccctcaggttgattacgaagcctcagagcccttgttcaaggcagtcctggaggacacgaccctggaggaggccgtggggcttctcaggagggtggacggcttctgctgcctgtctgtgaaggtcaacacggacggtacacataccactcctctcgtgtgcacagctgcctggccagactccatgacccttaagtccctggtggttcttctgcacgcccagcagccagggacccccagagccaagagaggatcagccaggctgtgccccaggtccccaggaggcccccaagccagctggaaacctcccacccactgactccagtgccagagcagcttctgagactgggagggtccttccttctctcctactttaattttctgcaaccttcctcgcagaggctcgtatctgtggctcatctgtggctcatgtccccttttatcaggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccaggtgagcagctgcctcgagctcggtgcgtccccagagaggcccacagggaaatggcacccagcctgcctcggcttcctcctcctgcccagcaatagagggtgggcgtggtgagacccccctaaggagggaagcctgccaagatcactgctgaagatgttgtttctttgtgatggatgctttatatattgcaaatgaaatgttcattctagaacattctagatctgggtttcttagctctgggtttcttagctttggtaccatggacgtttggggctggatccccgtctgtggtggggccgtcctgggcactgcaggatatagagcagcatccctggccgccctacccaggatgccgggactactcccatgccccagctgtgacaaccagaaatgtctctataggttgccaagggtcccctggttctcctaggactgtcttggtcttagcactgaaagccccacttgcagggaagcccctcggtcctgggcaagcagggacagctggtcaccctccctggggagtgacattgccccctgccttgctccattgaaaaccactgctctaggccgagcatggtggctcacacctgtaatccaaacactttgggaggccgaggcgggtggatcatctgaggtcaggagttcgagaccagcctgggtaacctggtgaaaccctgtctctattaaaaatacaaaaaacttagctgggcgtggtggcaggtgcctgtaatcccagctactcaggaggctgaggcaggagaatcacttgaaccccggaggcagaggttgcagtgagccgggattgagccattgcactccagcctgggcgacagagtgagactctgtctcaaaaaaaaaaaaaaagaaaaggaaaccattgttctagatcagcctatgggaggctccaagtttcaagtgcacggaacgcacagtgctagaaagcaggagtgttgagctcagcacccccatcactcattgcaaactcaagtcccctggggatcggagccagcaggtccagggagaggcctggcactctgcatttctaacagctctctcggtgactccaggctgcaggccagggacccaccatgaatattgaggtcctggagtggggccctgtacgctggctgctcaacagcaccccctgggtcccgccccaggacaagtaaatcagcatctccaggggtgggccgaggccctggagtcttttgaaagctctggagactggcatggccgccaggatggagcgctccagcctgcagcaaagggatgtgtggagctctaggtggaggcccttctctcccacccggccatctcccccactctcccctgctcggctctcccctgccctgctcacctggcaggaggcagctgggtcagggcctctgctggtctctgcagggctcagcagcagctcatagccctcatccaggacatgactcagcagtgcaccgtgacccgcaaggtgaggctccagggaggggcctggaccccactggggtgggctggaagaggggctcggtgctggcagggtggcaggaggcactgtgtggagagtgggctgctgattggagggtaaccccacctgtctctcctctgcaccccttcaaaccagggcagggtctgcagcccctgcccagcctgcaggctcttgcacaagtgcagacacacctcaggctgttctcagagcatctgcgcctctgcatcactcccaggtcgccctagtgccaatcatctcccctgaattcccattcctgttgatggcttcaacagctcctcctcatcctttctctgtccctcctttagccatcttctgggggaccacagaagctggtccgcatcgtcagtatggacaaagccaaggccagccctctgcgtttgtcctttgacaggggccagttggaccccagcaggatggagggtgaggcctggtgagctggcacaggggccactggctccaagtgggtgaggggctttgggagctgctgctagttggtcagctggggcagggggatgccactcatttaggccaggatctggtcttcaagaatcatggggctgggtgtggtggcgcacacctgtaatcccagatactcgggaggctgaggcaggagaatcgcctgaacccgggaggcagaggtggcagtgagccgagatggtgccattgcactccagcctgggcaataagagcaaaactctgtctcaggaaaaaaaaaaaatttcaggagaggagtacaggacagagggagggctaggaccctgtgccctggaggatggctgaggagaagggtgccactctcccagatcctttggaaggaagaaaaccctggcttccgccatcctcccttgggcctataggaaacaggattaagttgcaggctgcaaagcagtccctggagagccacagagctgtgtaacccccgtgcaaaggagccgctcagccaggggctatggaactgggagtgagtcctgtgaccgctgagcctgtgcccctggaattctaggtgctggggctgctgcagtgagcaaagcagacccagtccctcccggggcagggtaggctggctgggggctgccgcagcctcacccaccctcaggatcctctcctccacaggctccagcacgtgcttctgggccgagagctgcctcaccctggtgccctataccctggtgcggccccatcgacccgcccggccccggcctgtgctcctcgtgcccagggcggttgggaagatcctgagcgagaaactgtgcctcctccaagggtttaagaagtgcctggcaggtatgctgttgcctgggaatccctctaccccttccaccttccctccctccctcctccccttcctccctccttcctccccttcctccctcctccttccctcccccaccacgcacattcccacactcacctgctgtgtccagatagttcaggatggaggtgcagggcacagagcggggtgtgcagggtcaggtttgtaaagtggacatcctaagaagagcttctcccagtgctggcagggttcacggggacaggggtgtttaccatgggactcccccagacccccacacagctggtctatgatggccccgtccaatgtcacctgtagagtacttgagccaggaggagtatgaggcctggagccagagaggggacatcatccaggagggagaggtgtccgggggccgctgctgggtgacccgccatgctgtggagtccctcatggaaaaggtgaggtcaagggcggggtgggcaggggagctgtcctgggaagggtttcaggaatgcagaggagggggatgagataaaggtacagggaccgacctgagacctgggtgaccttgtcgccgacctctgggtcccaacagcccagcaggagcccaaaactcatctcagccagttaggatccacgtgactgtgggtgaggtctcccaactccttgaatctcagtttcctcagcttgggggatgtttaatagatatttgttcgagaatgaataaatccgagctaacaacactctccacgtttgaaggcgcaaacgcgtgaaaagcagctccccgtgaaccacagctttgtgtctgcacaggcacgggaagccgagtctggcatctgcgtgcctcctgtaggggctggcggagctccatgccaagttcacctcatccccagagctcacaatttctagattttcccagtgaaaaatcaaagggatggaaactcttaatactgcatagcacacagcctcatttagaaagtggcaaactcagctgggcctggggctcacgcctgtcatcccagcactttgggaacccgaggtgggaggatcgcttgagcccaggagttcaagaccagcctgagcaacacagtgagacccgtctctaaaaaaaattaaaaaataaaaagagaagaaagtagccgggcacagtggctcgcgcctgtaatccccacactttgggaggcctaggcgggaagattgcttgagcccaggaatttgagaccagcctgagcaacacagtgagacacccgtctctacaaaacatttaaaagctaaaaaaattaaaagtgggccgggtgcggtggctcacgcctctaatcccagcactttgggaggccgaggcgggcagatcacctgaggtcaggagatcaagaccatcctggctaacacggtgaaaccctgtctctactaaaaacagaaaaaattagccaggcgtggtggtgggcgcctgtagtcccagctactcgggaggctgagacaggagaatggcatgaacctgggaggcagagcttgcagtgagccgagatcgcgccactgcactccagcctgggcgacagagcgagactccgtctcaaaaaaataaaaaataaaaataaaaaaaagagagaagaaagtggcaagctctattccctcatctcctctacaaaattcagctctgcccagctcctgccctgccctcagcctgtccggagggcccttctgacctgggcgttggctccctttgcttcctctgaggcctgtgatcttgactcacttcttctctccctcccacaaagaacacccatgccctcctggacgtccagctggacagtgtctgcaccctgcacaggatggacatcttccccatcgtcatccacgtctctgtcaacgagaagatggcaaagaagctcaagtaggtgcacgctgggggctgggcaggggcttcgaagcggctcctgggctcccccaaagcccacggcaggtgcctctggagtgtgctctgcggtttgcaggaagctgaggcgctgacagggccgtttccgcacaactttgggacaagggccccgctgattgctcatgagattcccctgattttggccgggcgtggtggctcacgcctgtaatcccagcactttgggaggccagggtgggcagattgcttgaggtcagcagttcgagaccagcctggccaacatggagaaaccctgtctctattaaaaatacaaaaactagccaggtgtggcggcgggcgcctgtaatcccagctactcgggaggctgagacatgataattacttgaactgggaggtggagttgcggtgagccaagatcgcgccactgcactccagcctgggtgacagagcgagactctgtctcaacaaaacaaaacaacaacaacaacaactgctctgatttcacgcttaccaaacaaacttgatttcaaatctggcctctccagaatcttgataccaggatgacggtgccttttacagtgggcaaaagtagcctagtcactggaaaatgacattttataattgaaatttaaagttgtaaattaacaaattggcactccctcccccaagagcagctcagaggaccattgtaaggccagaaccccacccggcctcagctccactgaccctccacttactggtgcttggctagcacaatctaatccttgtcggctaaggacaaaaaaaaaaaaagtaaaaaaattacttggtttcctggggacagaccaagatgtcctgctactgtgccctttctactccaggaagcaaggctgtgttctagacaacctgcctcccaccactggggcctggggcctattttctttacaaggtcccctcaaagcgaggccacctgtgtttaggggtgtttgggtgcatgtcatcactaccctagccagggctcctgggcccttgctctcccctgagcccgccccccccaactctggcctgtgcaggaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtgggacaggagggacgtcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcagaagcccacatatgctgtgacgctggccaccttttctcagcttctgaggctgcgatgcctcaggaactccagtttacagagaccagtgtgtttacttgtaaataaagcctctgcgtggtggagacggtactttcagtgggtctgtgccccgtggcccctgtgcctgttcggtgggggtgtcccagagaagcctggcaccagtacccccgtacaaggcccagcggactctgccttcccctgacctggctttgcaccccagcccttcttgggccaaacatctttactccaccttcagggctcggggaggacccaggtccgccagcacctggccttgcccctgcctcctggggctgttgcagactgaatgtcattttgacagcagtgtccaagaatcaggaagctgttctagaattcaggttggtatcatcataaatgagttcagaaaaagaacttctgtatattttactaaaataaaaagcttttacaata

SEQ ID NO: 2376 - DNA, 38763 bp, Homo sapiens
  source 1..38763: mol_type = genomic DNA
aaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaacttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttattttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttgtgtgtgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaacaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtatccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacagtaacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggatctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcac

SEQ ID NO: 2377 - DNA, 46509 bp, Homo sapiens
  source 1..46509: mol_type = genomic DNA
aaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaacttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttattttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttgtgtgtgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaacaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtatccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacagtaacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggatctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctccttcatcaggagcatttggggtttgatgtttaagttttgggcctctggtgtatttcatatttctgttttgctagaacttagtgcttgtgcaaggttaaattctagaatcaggaaacgttgtttttaggggccttcagcaagcacttcggaggtccctggacgtttacagctgtgagtcgtggatctacccagacatcagaacatagtcatccttggctcattcctcctccgtaggaggggtacacagttggtagagtgtgccctccaagatttcgtgaaacattatgcttgtctgtatttgtgtgtgcatgtctgcgtgaattttgagttcaggaataacaggtgatttgatcacagctatttgacagtggtgatagtcattgtatgccaagatgtttatgaggggaataggtagattgagtgaggttcatgtatattttgcctagttgtactcacctacaagagctgtaattaaatgtttctctctttccccttcctctcttttattcattcttttttttttttttttgacaaagtctcgctctctcacccaggctagagtgtagtggtgtgatcttggcttactgcaaccttcgtctcctgggttcaagcgattctcctgcctccgcctcctgagtagctgggattacaggtgtgcaccaccatgcctggctaattttcatatttctagtagaaacagggttttgccattttggccaggctggtctcgaactcctgacctcaagtgatctgcccactttggcctcccaatggaatgaaccattgtgtctggcctcattcattctttctttcataaaagtttggatactgccaaacaaaattaaagacatgaagacatttgataaattgttattacaaatgtgacagttatttaactactggtgtttatttttattagagtcatagcacctactggcctctgcttcagggattcacaatggtgttgggcaggttggatatcatggggcttacccttagcaaggcattctattccacctatgcccaggcggtgtaaaacatataagcatctggtacgctgtggtaccgacccagtgactggtataacacaatggttaaggttgccaaatagcaacccttaatcaataatgatcaaatctccacggaggtaaactaaactagaagtttacctcatacaggtaatttttgtgccatacatgattcacagaaccttccagatctgatgctttctgagtgatctggtcaatttgttctcaacctggaattcttgggcccttaggtgtttgtaaatttgttctcagagactctgagctctccaccttcatttttaagtgctttaattctttttggtgataatctttaaaacttcacagaggtgtgtcctggctctttggggcgactgcttcatatttgagtactgccacacaatgacagctcatgttctggggcctgcctacagaaagggatgaactttatcttggaccttttaatgtagtgtggatgggcgtctgtagctggaggtcttcaggtgccagtggttaatctgtttgaagcttgcttcactccaacctctcattctgtaacagactcctcctccaccgtccctcacctctgctgaacccttctagcagagggaactcaccacaagtgggggatggatttgggagcttgaaaggaccccaatgaccctgcagtccagccctcaaagtgctaagtgacttactgaagcctcgaagccatttctggaggatttgcaattctttgtatctctggatttgctgccctgtccctccaagccacctggtttcacttttggacagctttaagtgttctcttctctgttctctgtttctgccttcttagaaactatttaaaaccactcattttcattctaaactccggagccataccaaacaactgtaactgtcctctggtgagatttgcgttgtatgtgacaaatcttttaacttttttctgttagggtttcagttttgttggaagtctgcagtttgctcttaaggatgtgataagaatgtaacaacacatttgtatctttgaattttgaataggaaccaaatttttaaatttagtttagttttgttttgtttgagacagagtctcactgtgtcacccaggctggagtacagtgatatcatcttggctaactgcagcctctgcctcctgtgctcaactgatcctcccacctgaacctcctgagtggcagctggggctacaggcaggtgttttttaaaaatggaactcttttctttttttttttttttgagacggagtcttgctatgttgcccaggctggagtgcagtggctcgatcttggctcactgcaagctctgcctcccaggttcatgccattctcctgcctcagcctcccgagtagctgggactatgggcgcccgctaccacgcccagctaattttttatatttttagtagagacagggtttcaccatgttagccaggatggtctcaatctcctgacctcgtgatccgcccgccttggccttccaaagtgctgggattacaagcgtgagccaccgtgcctggccaaaaaaaaatggaactcttaatacattagaaaaaaaatgaaatcccttttaaaaagcactagaggaaattctgtgtttaaagatttacttatttggcaatgcaaacaactgtttatttcctaacataacttttgcaaatctgaatttttatgaaaagatttttaaattaaaaattttaaattgtactaatttttactttttaagtaattttgagtaggtaatatttttataaagatatttgtatggtttgaagataagaaaattaaaggtgttcaagaagagttttgcccccagttctgtccactgtatacccagtcctccccacttctgcatacatatttcagacaggtatttcttggaagaaagaacatatgctgtgaaacttacatgtctcagtaggtctcattttaagtgattctgtaaaatgcctgggaaatactggtgaaattctagaatggaaataactttgtgagattttgagctgagtactggtaaatagtagaaatggacttactaataaataagggaattttatttgataacttttttctgattacatagtaatgtatgttcattatggaatatttgggaaatacaaaaacacaccaagaaaaaagtatatttatttataattctattttgctatgtattttcccattattcactctgtgtttgtcacagatttttccccaccctttttcaatgagtgtatcctccatgtccccccaatcatgcatccagtaaactttgtcattactaccatctgtactttcactcacgtttcaattccaagcatgtccctctctgacaaccacctcccatcattccatcttgcttcttctaggaccttcccttcaaggatcttcagtgccaccagggcttccagttaggttgactgaccctatctattgtcttcccgatgtcagcaccgcccctcactccctcttcattcagcttagagtccatgtgtctttgttaaagtctcctgtacccaccaacacccttgcctttctgtcagttccactgaggtggtagaatcccaactctggttaatcctataaatccttgtcctccaaatttgtactggaattccaggatgtggctggggtaaaaaccttccatgttgcagacaggtctcgtttcaaaccaatgaccacaaacctccaatgggctttcaggggtttcggcaatgctgtgacatttccctggttatatcacccttttgcactctcggtctgttttactaatcatcgaattctctatgatctcaacctaaaaggttagagatatttcctgagaagccccaccttttctcttgataacccactatggagctgtcatttgtgaatttaagaagaaacacttgcctcttgactattttaaaacatcaaaaacaacatttaaaaattgaaggatgaggccggggtgtggtggctcgcgcctgtaatcccagaactttgggaggccgaggcaggcggatcacctgaggtcaggagttcaagaccagcctggccaacttggtgaaacctgtctgtactaaaaaaaattagctgggcatggtggcgcacacctgtgatcctagctacatgggaggctggggcatgagaattgcttgactctggcaggtggaggttgcagtgagccaagatcatgccactgcactccagcctgggtgatagagtgagactctgtctcaaaacaaaaacaaaaacaaaacctgagggatgagccacaaactgggaaatgatatctgccacgttgtataactgataaaggagatatatgtacatatactatatatataatcttctataaatccataaaatattaaacaatccaacctagatgggcaaaaatataaactagttcaaagatgagcaaaaaatatgaaccagtaattaaaaggaaataccaatgagcaataaatatatgaaaacataaccattctctttggtcatcagagaatttgaaaaatacagccacagtgagatagcattttatgtccatcatattatcaacatttaaaactctgtcagtaccaagtgtgggtgaagatacagagcaaagggaactctattacatcgatctaggaaatgtaaattgacacaatcattttagagagcaatttgcaatatttataaatgttggaaatttgcacacagtaaaatctagcaattccatttttggatctatgtcccaaaataaacttaaaaacattgttttgtagagacagggtcttgttatgttgtgcaggaaggtcttgaactcctggcctcaagcaatcttcctgcctcagcctcccaaagtattgaaattataggcgtgagccaccacgcctggccccaaaagaaatcttgcacaggtaccaggagataaggaggaagtgttagttttctgagcagcattgtttgtaaaagtacaaaaaaaaaaatgaaaagaagcaacacaaacaatctatatattcatcaagaggaggatagataaattgtggtatagtcatataaaggaatactatcaagtagtgaaataaaatcaattagaattattaggctgaaccatatgaaattgccattcttctagatcagaaacaaccaaatattggcaatttcatacagtttaaatatatgtatcagtaacataatgctgagcaaataatatatataatatgatatgatttatataatgttaaaatacacataagagtcttttatgttgcttataaattaatatgtatattgtacaaatatacagatgcatgggggtgatgagaagtttagagtagtagttgcctgggatgggattgggtcttggggggacaggggggaacatgccaatggggaggaattacaggggcttcaaatgcatcagtcatgttttatatcttcaactgagtgctagatgtggggatattctcttttctctttaatcctttttgcgtctcagtgctgattaatggaatttagccaccagattgggtgattttttggcttgttgaatagttggccaggtttgcagggaagctttgccctcttgggcagagtatgtttttccaatctagtaactgtctgtttttggtggtgatttctgtggctgtaattaatatgatcagtgttgccaaagcaaggataaggggtattgactcactttttattgccctgagccatccctgttgcaaaataatgatctggatataatctccagaccaggaagcaagctgcagatgggaaactcccttatgacacttctgaagatcccaaacagtttctttttttaatgtaatttgattttttatttatttagttttgagatggagtctcgctctgttgcccaggctggagtgcagtggcacgatctcggctcactgcaagctccacctcctgggttcatgccattctcctgcctcagcctcccgagtagctgggactacaggtgcctgccaccatgcccggctgttttttttttgtatttttagtagagacagggtttcactgtgttagccaggatggtgttgatctcctgaccttgtgatccgcccgtctcggtctcccaaagtgctgggattacaggtgtgagccaccgcgcccggcccccaaaccggtttctaacaaataagtgttaagtcaaggggttcctctacagaatcagtcatcttcaccatgacacccacaacgcccaaattgctgctggcattcctccactctgaatgcacaattagaagctcagcactctattggataaggctgctatttcaccatttgaagaaccttcaaaaaggtctttagagacagggcatggtggctcacacctgtaatcccagcactttggaaggccaaggcaggcatatcacttgaggccaggagtatgagaccagcctggccaacatggtgaaaccctgtctgtactaaaaatgcaaaaattagccgggtgtggtgatgtacacctgtagtcccagctactcagtggccgaggcacaagaattgctcgaacctgagaggtggaggttgcagtaagctgagatcgtgccagtgacactacattccaacctaggtgacacagcgagactccctctaaaaaaaaaattccttagaaacttcagaaggatccttccactagggcagaagggatgagagagtaagaatcttcacccctaccactcatgcctttctgaaggctcagtctggccacactgcaagggcacagtgagccagttttggcctggggcttcttgctgctgccaaattaacaactccagcccttgggtttagccacctgctgctgctaaaaatgttgctgagagtgatggagaggtgttttagttcccattttacagatcagaaaatcaaggcccagagaaactaagtagtcttggagataggagccatggcctctccacttgagttatcatcttgaaacatcaaggacaagccaactttatcaacagttttaggcctgtgagaaatgggcttggtttatcttgaagattgtaaacaaataaaaaaatagactgctccattactgatgagaaatatgagtcattctgccaggaattgaaagtacagctgcccataaaaaagctatgccggggtccagcctctccaggtccttgtgtgtgaaaaaccactcagtcaaagttccccttttatttctctttgtgctcagtaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 2378 - DNA, 38763 bp, Homo sapiens; identical to SEQ ID NO: 2376
  source 1..38763: mol_type = genomic DNA

SEQ ID NO: 2379 - DNA, 46509 bp, Homo sapiens; identical to SEQ ID NO: 2377
  source 1..46509: mol_type = genomic DNA

SEQ ID NO: 2380 - DNA, 38763 bp, Homo sapiens; identical to SEQ ID NO: 2376
  source 1..38763: mol_type = genomic DNA

SEQ ID NO: 2381 - DNA, 38763 bp, Homo sapiens; identical to SEQ ID NO: 2376
  source 1..38763: mol_type = genomic DNA

SEQ ID NO: 2382 - DNA, 36177 bp, Homo sapiens
  source 1..36177: mol_type = genomic DNA
taaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcaggtgagactgagttctaggacatttagggggtctggtgcctggctccgccaaaaatggggactttcgggattgtgatcatcacggcggattgagcagggagagccgtggagggacaagagagggccgaggcagggtggggggcgcgggcaggtgcgagggggatgcggccaagaagcagcgataaagggaacattccacgggtcgggcggctgctgttggatcttagataaagctggaagggattaccggggcaggggtaatagggaccggggacgggaacgcgaaacaggtgaagcgctcagggcgagagcgactcggcttagggagtccgggagaagcctgcggctgccccctcgccgccgaggtcctgcgggtcctgcgggtcctgcgtgctgagccggggcgtgcgcgggcgggggccttcggaccgcgcggcggggcctgccctgacccctggcggcgggcgggggaggcaggcgcgccctgcagagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttctttagtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaaggggaaacagtttaatctgtaactggaagggaaaaaaaaactgtcagaattgactcccttggcttcctggagtaggaaaaaggaaaattggagcatttgcagctttttttgactagctggattatggaatatttaaaagcaacagcaacaaaagtaccttataaactagaaaatagaattgctaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaattctgcccaaagagtgcctggccgatgaacagggtcctatctacatcttatggagactcctattttataaatatgtatcctcaagtccaagcacaaacaaaataacagaaacagggatgattctctcccagtttccatgacagtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacctcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttgtgtttccatttaaatttcaagtaattaatatcaagtaaaatttaaaattcagttccttagtcacactagccacgttgtgagtgtgcaacaggtaaagctagtggcacagacatagaacatttccatcagcacagaaatctctattggacagtgccagattagggtgttctctgcattgtaaaagcatccccttgccaagttaaagaaaacaacaacaaaactctagagaagaaatgaaaccccagtttcatttctggagaggaaagaaaactcatgtgtggcatgagtttatattcaagaaggtgcagcattattacctattttactagtaataatgacacacattatagtatacaatccagttccaataaaattaatttctcatcttactaaaagcttgctgctccacattatgagacaatttacccaaatatagacatttacccaaaaatattaagtagcttgtgaatactttttaaaatttcctttaattaaagtggtcacaaactcaaacccttcattctccctctgagatttctgtgtcatcttttgttcacattgttattcacatgtttattatgtacttattttgattttctagataaataaaatggcttcaaatctataattctgataaaattagccatcaattaatttatttattaaacccatgcaatatgctagattagatgctttgctatgtaattcctacaataaatcctagcaatcacaaagattacagttagtgagacgacatgcacacaggtaaaaagtgtttttaaaaaatacatacatacaaccaaaacagtaagtcactgctacatggaaactgattggtcctttttcctttttttttttttgccttgactgccaggaagcagtttcaaatctatagctggattttaagtttcattaattcatgttcccacatatggttctgtattttcacttcccccttttaactgacatactgtcttatgtgatctctactgtaagccttctcatcattttggaaacagaccaaatataatatatatgataaggaatcaaaagtaaatacagtagtgttgaatattgcataacaaaaaggtttttaaatagggaatggtatcaatatgaagtgttagggagacccagccatgaaaaggatagcagggtcagagaaggaggatgtattgcagctggtttaatggagaatggtatgaaggaggtgcagtttgaattgggtcatggaggacagatggattgcaaatagctggggcaaaagcacaggaaggcattctaaacgagccaggcatggagacaagaatgtctcccacaagggagttgtagtagctcaatcagactgggatttgagatttcatgtggcagagtggtaggtgataaaggtgaaaagactgatcatagtaaaatgcggagtctgtaaatccagcactcatgataagtttggacatcatgtcaacagtggacagccataaatgactgcaagcatcggtgtggtataatgaaggtgacgtttttgtaaaatgactctggtgaaggtacagaaggtaatgaaaagtagccagtctagttgagcagaaaagagttcagatgtaattgcatcatggtccagatgtgaaatgaagacaatgcgaagtggcattgtggatcgaaacatacatgcacaaaatgacagaattttagaatttgaagggatcatcatggttaccaggctggcctccaattcctcttttgtaatattaatagaaattaagggctaacaagtttaaaatgttatccatctttttacatagttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacaaaggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctgttggcattagtattagttttgcttgtgtatttgtttaggagatagcttcacaagttggtgattgatattctaccatgtatgaagtcatgcgtggaattcagaatccccagcttgtaaaattgcattatgatcatctttagtgggaaattgttctcagaatactgagcaaaggatgataccaaaatggcagctattattcattcttaagcatatgaaatgctttcaggttcaacccaaaattacatacattttaaatgcttactaaaagagtcttttccctcctccatctattaactgcaatcaaaaaacttcggttttaactgaacatgatttcatattatttattaaaatttaaggcaaggtgcaccaagtacccttgaattatgaaaagcttcatgatgtgggatattctttcagttaacggcagggttggctacacttttaaggggttcaaagtaggaacagctgcaatagtgagctgcatctggaaagtccagtaatttgaaaaaccacctgtttatgtatcctgcccactcaagtccataaaataacagacactttcatattccaaatgaaactgctttttagtttgccctacttttaaacataactctttgtgatggaatgaccagaaacagctggtctctaagaggacagggctatgtgcgctcacctgcggggttggaccttccataatccccctggctgtggggaaagttgagggctgctgtctttatacaaagatggtttattccaagatacacacactcttcttccacaccctggagaccttgcatatttagtatcttctttaccataatctgaggccctagagaaaaagatttgcaaactatacttgttttaaaacaactttctaaaaaagacactctcagcccctagaaattatgcctaacacatagatgctcagaggcaacctgttgtagtgcaagaggattgtgccaagattagaaaacaaatatttgcaacttttgtaactgtcttctctaaaacttgaatgtggtgattctaaagtaaagaccgacacaaaattctttttctttagcagtcaggaaaaggcatgcatgaagtaatcagatcaggtgtggtttcagcataatggcctaatgctttcatgatctctttcaactggaaagcgttctagtcccactggacaccaaggaggaagaagggacggaaaatattaggcccataggtttatcttcctcagtagtccacgagatttgagcttatatgtagggagcaaaattgtttgtctaaaagcagttaataaatgccccaaaaaggctgggcgcagtgactcactcctgtaatcccagcactttgggagctcaagattggtggatcatgaggttaggagagcaagatcatcctggccaacacggtgaaaccccatctctatgaaaaatacaaaaattagctgggtgtggtagcgcgtgtttaatcccagctactggggaagctgaggcaggagaatggcttgaacccaggaggccaagattgcagtgagccaagattgcgccactgcactccagcctggtgacacagcgagactccgtctcaaaaaataaaataaataaaataaaataaaataaaataaaataaaataaaataaaataaaataaaataaaataaaaataaaatgaacgccccaaaaatattttgggcaaactattttgtgtttcttttctttatttatttatttcttttgagacaaaatcttgctctgttgccccggctggagtgcaatggcacaatcttggctcactgtatcctcaacctcctgggctcaagcaactcctgagtaactgggaccacagggatgtgccacaattcccggctaattgttttagccaggatataaatgctgcctacatagagtttgtagctatctccttgactttctttatgcagattccttcacaaacttttgatggattcctttaccaaattctactgtctgttaaaatcttctatctttatatctttagtccaaacaacacgtcatttataaaccttaaaattgtttctgggcaaataaacaaggcaaaataggaatatatatttttaggcaatttacttctgttttggtctcataaaaaattgtaattaaattgtagaaaatatttcaattcctctttaatatcctctcctcacatactggctctcaacttctaatcctcctattgaaacattgattgggaggccaaggcaggcggatcaactgaggtcaggagtttgagaccagcctggccaacatggtgaaaccctgtctctactaaaaatacaaaagattagctgggcatggtggcatgcacctgtagtcccagctactttggtggctgaggcacgagaatcgctttaacccgggaggcagaagttacagtgtgccaagatcaagccactgaactccagcctgggcgacagagtgagactccatcacaaaaaaataaaaataaaaattgaaatttgcagcctttttaaaaccccatagcctctttataaacccaaaagcactatcaaatttggcgaggtgtcaaaagaatcagaggaatgtttacaaatacagatgcctgggcccacctcagatatatatatatatatatatatatatatatatattttttttttttttttttttttgagacgatgtcttgctctgtcacccaggctggagtgcagtggcatgatctcagctcactgcaagctccgtctcccgggttcacgccattctcctgcctcagcctcccaagtagctgggactacaggcgcccgccaccacggctggctaattttttctattttttagtagagacagggtgtcaccgtgttagccaggatggtctcaatctcctgaccttgtgatccgctcgcctcggcctctcaaagtgctgggattacaggcgtgagccactgcacccggcccagatatattaaattagaatatctagaggtggagcctgagtatctgtatttttcagagtttcaaatgatcgttcttcaaatgattacactgtgaagtcagatttagaaatgactgtacccaaggttggctaaaagatacacaccctggttgattctacctgaagagagcaaataagatacacagcaaagttgtagatgttttccctgccagtagaatacttgcgggttaggccatttaaaaccctgccagagagttttgaaacactgtggagggctcccaaatcaacttgctcaatggttctccatcccttcaggctacttgggcttaaagccaactgcaagcttagagcctcagagtgacctaggaatggggtgaccatatattctaggttgtctcatacagactagccagcactactcagccgcaagtaatagcatccaggcatgctcagaagtgtcccatttggaggaaaaaaacaatattgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaaggtgacgttttaaaaagctgcattcagtgtataaacttctcctgatcccagcaaggatgttgtgatgattttatttaaaaaggtaagttgtgtctagatatggcagtgggtcatctcatgcatggtgcagatgtcaaacacaattacattttcttatttgcaatgactaaaaaaagaagctgagcccaagcagtgagaaagtaggagattgggaggacaagaagcaaaggaaaaaagtaacatgagcaccgttctccctgtcctgccacttgctccattatggactgggctgcgatatctcatatcccagctccacaactcccaacaaccatttatgtgcatggtgcttccatgtgtgatgacccaatcaggctcaggtgtggactgagtagttaaattataacccttgtctctgaagagtttagggcttagtggggaaacagacatgtaaacaaacctgagtgaggtcatgtaatcaaaggacaggccacagtcaaccacaaagaagagagttctcagcagtctccaaagccgaacatatgtttaccaggaacagggtcccagcagagggagcaacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctgtctcacagtaatttaaaagtgaagttttgaaaagctgcatcctgcgcttgtcagaaccatgtctgatgagatatcccctttaaagggctctcggtgcaatggggcaaatcaagggggtttgtgcaagtgggagtgagacaggagatggggtgcttcttccagcactccctataggctgactgagtgacaaagatcattttactgacacctccaatggccctatgagatgggtactattattattatcaccatcatattccttttgcagataaggaaactcaggcttagcagattgccagaacaacacaggcaggaagtggtagagtcagggtttgaacccaggtagtgaaactccaaagcccggattcttaaccactgtcctccagtgcctctctgtaataagtcatgatcccagaagccattggtgtggccacaatatggaaagagatgacagtgtcctcacactgggtgagcagcttatggtgattccagacatgatctctgttgggagtgacaggtctgagcttctaggatcagaccctagatcttggcaagtggtttgaggaaagagaaggaccaatgtaaaaccccaggcttcaaggaatgtggatgctgggcagggaggattaagccccaaagaccagaaatggggtacacagggcaggtgtggccagagtagaactagagtagaacttccagtgactagaaatagaaccagacacgttgcagtggtggataaggtagaatcgcttaagtctttaaagtgcccctgatcacccaagttggccagagaccctggggtggggctgattctgtctggatatacggggaggggtaagcatgaggaaaggaagcaggtcctgacaggtactttgcactaaacagctccttataaggttctcaatttgcctgctcaatttctacagacatttgtgggaccacaccagtacattgtaaaagcaggaaacaattgagaaaaacctgagttttatgttggtaggagaaatgcctatggaatatggcaaatcgtttctctgagacttcctccctagtaattacatatttgttctcaaaaacaaatgccagaaggaagaagcagatttaatagtgcattttacaaggcaccattaatctctaagaagaacaattaaaatgtctcagcaatcatggttcactgtatatcttttctatcttcttagaagtaatatatggctggaaatgggcataccaaaatatgtcaaggaagtggaattgcgttcattagatttcaccactaattattttagttagcttcacagatctctcttccttgcttgttcttgagagcgaggctttttagtaggaagagaaattgtctaaaacgattaataaccacaaattcaccaaactattttgggtaagtccctctatttctctaggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtatgggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattcatcaaagccttccaactatcctgcgtcactgtccttcagtgtcctctctcctctcccttccttctcaccccactttgtgcctgtatccttcaagcagagcaatggcaccctcacttctgtggctgcccagtgccccatgcagagtcagacatcagaaaatagatgctgaattcagttgacactctgaaattctttttaaagtaagttaatgtgtgctttgaatgaaaagacactgggattacattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaagtcccctggcaagggaggggtgaaaggagtgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaaaaagaaaaacaacaacaataacaacacattaatgactctgaaagagtcagacaccattaattccattattggtgtctgtgccaagtgaaatgaacgtcagctcttttcccagatatgtttccttcttttgcctcctataataagagatgattttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaacacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgatttattggaagggttggaaggaaacatggaatgacaattacctttggttattgtcaggttagtatgagacttacaagaaaagcactgctcagacgcaattaccattcaagataagaaataataggaaaggctagcacacttagctttttatttaaaaaagtgttaggtaggctgagcacggtggctcactcctgtaatcccagcactttgggaggccaaggtggatagatgacttgagcccagaagcttgagaccagcctggacaacatggtgaaacctcatgtctacaaaaaaatacaaaaattagccaggcatgatggcatgcacctgtagtctcagctacttggggggccaagaggtgggaagattgcttgagcccaggaagtcgaggctgcagtgagccatgattgtgccactgcatgacagcctgggcaaccgagtgagagcctgcctcaaaaaaaaaaaaaaaaaaagtgttaggtgacatgagagaagatcttccaagtaataagagtggctaatcccaggaatgtgtcaccagaggttattttgtaatagtcgtgtgttaaattccttatttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactccctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcagaatttcttaataattaaacactttatcatgacaagactttcaggaccttaaaggccacagtggggtagttatcatttcactaggtcctcatctggggaggtccttggcatttttactggaatatatttgtcactcaaatttctattacaaaaaattctttcttgcacactgctttagcaactacatgagatatactttgtacatagcacaaatctcatatcacttatgtaatccagctctgtggttccttcctttcctttgcctgtttatttttaattcttcccaagaggaagcttagccagttagaacaccagagtatcatccccctcccccttttcccacctgagttcatggcttagacatactaggaatgaagctgacaacatgcactagtttttttcgaaattatgcagcaaaattcccaaagtgcgagtggccacagagatcttcacagggcccagggacaggcagacatcattctttctccagttcctggcacagaaaagagaccttaggttactgagaagataccagtccctcctcagagcagacaaggaaactgagcctcagaatgaaagactgaatttcagtcctttcttgaacatggacctccagggttatattgggccttggaaaaggcacttacactctggactgtagtttcttcatctataaaatcaagaggcagaaacagacaatctctaagttgcctttatttataaaattccgagattctagttgaccagtattcatacaagagttgaagcctgtaagagtgcagaaagcccacacaaagagacagtggaagacctctcatcagtagtatttttattaccctcttcctaggttttaccagtcaacatcctcactgttaatatacagaccgtggtatttaattaaatcatctttgaaatactgagctatcaacagatggcatgctgaatgcaaaaggaccacaaataaatatttggtactgaagaagatcaagagttggagttcatttcccattctgatctgggctcagaactctgtggtcttccctctaatcatccttgccaccaaattggctgtatctgttctaagatggatcagaaaatcagttccaaagttggctacaaactttcaggtttgggttttgttttgtttttttgttttgttttgttttgtttttgcaaccagccaattcatcttagttcacatgacagagaagtgcataattacttgcaactttagttagagcagtggccttaagaaggtctagctaaataaaaagtgctcagactttctgagtgctgacagttgtcaaattcacctagttcacatggccccatttctatcgtttgttttgttttgtttttgttttttaacagcccatctgtgagcaataggatcagatgactaagagctacagggcagaaacactgttacttagagtcaaattttcccattacctagctgtaaagagtttgtttctctctgactcatataaagtttaccatttaggcccctgcatgattttaattccatcacttaacaccccagccatatgattctgaaggtaaacatgaaggcgtttgaattccagaccacctaaacattcttaaggaaatcatcatctccacgggcagagctatgccaaaatctgtaggttttaactcaaatttcatgataagcaaaaattgaattaatttgtcttccattttgttcacctttttgccaaaattatgcctggattagaataaataaattcaatcaatgaatgcaatcactaattcttacgccagataataacacattcagaattctcctttccctgggagattttatcaggttagtgttcttgtaaacaggagaaagagaaaaatataacttagtaaatagcagtattcactaattcattcatttattcaacaaatattaatttactacctactacattccagggagcttagagtctagtatcagaaataataaccacacacacacatacacacacactacattaaataaggatgtgataggctagatgaaataaataaataaataaaaggtccaggtgagaaaagaaggtgggggctagaaagaagtcattgaagaaaaaacatttaggttaaaacattatgaataacttagagtgagccaagtgcagagtgctgaaggagtgctccaggcaaaatcaacagcaaatggggagtccttgatgtagaaaagggtttgaggaattgtcctgggagaaatactcaagattccagtctgaattctagaggttagtgatttagagaggcaagtacgaaaatgacttcctctcttaccttaaaagtaagtgcaccatagaaggaaatcacccttccttggtaataattcctgagtgagcctgagaagccagaggccatctctattttataggcactgtccccttttcagttacccatggctagctcattgaccttgtcctggtcgtttcctcatttcacttactccatcctcaaaacgtagacgcttcataaatattgtataaatgaatgaactcacaaagtcacagtacagcaaggcaaaagtgcctgcaataaacaagcattctaggctagaaatatttctcaacttcaaattgtgtcttattacattgtattccgattttctagagtggtagttctcagtcaagggaaagtttttcttcccttccaggggatatttggcattgtctggagatagttttagttgtcacgatttgggggatgcttctggctcaacttgggtagagaagcggggatgcttataatcatcctacagtgcacaggacagtacccccacccacactccagtaatgaagaatcattagacctaaaatgttaatggtgtccaggtagaaaaaccctgttgtagaggttggggactgcgtcttgacagccacattatacagtgtatcaaacaattctgtataatgggctgtaattatccttgcctagattttgcaagaaccctagtgtgtatctttttcctcacttgccaagcaatgttcaaacctgcagagatttatttcattcattttctgtgtgtttagtaaacagactagaagcactggaggaaaaaatattccagcaatgaggtaagacgaaagctattagtaaccctagtttaacttagctgaatagtaggaaacaacctctaccgtgaggaagtgtattgtagaaactgaaaagacgctaatgatgtttaaaaagctgtagttcaaacaaatgtgcatgcagaccaatgggtagactgaaaatgatgaagacatttccgtttcttgtgtctttgatagaaaagaaagagcttttattttctttagtgtggcaatcattcagatttgtcccatgacatgcccagaaggttgaagaataacaaactcccaagtgtaaacacagaatttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacatgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttcgagaccagcctcgccaacatggtgaaatcctgcctctactaaaaataaaaaaaaaaaaaattagtcaggtgtggtggcggatgcctgtaatcccagctacttgggaggctgaggcaggagaatcgcttgaacctgggaggcagaggttgcagtgagcaaagatcgcaccattgcacttcagactgggcaacaagaatgagactctgtcacaaaaaaaaaaaaaaaaagtctgcaggctgcataaagaggtatgaaaatgttccagaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatggccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaataagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagattcgaacccagcctccatgctattaaccaggacatcatattgcctttcatacatgctcttcaaaggcaacacagtaatcgattatcacactcactcacatctgattgtcacatttttcagatctgctctcctagcagagaatgaagcctaaggtatccttgtttctcaaagtgtcctccccagaccagctgcatcaaaatgaggggatgaggtgcaaatgcctggaccctgcccttggagcactgattcataatctcaagtcccaagaatctgcattttaacaagcatccccagaaatttcttaagtatactaatgtatgggaaccactgacactaaagaaatggaataaggggaacgtacaatgttacagtaaaccaggaaaagccagaaagacatgacaacacagtgaggactctggtagccaatggtcagtcaaatgcccaggggccctggccagaagagagttaggttgctgaggagtaagagtgatgctgaatgtggaggcttgagagcagaaggaagccagccagctatatcctcttgcttggatcacacaccctttccttggtggaaatggttatttgcagagttagagaaggcatgttttacagtttggatggcaggtatggatgtagacaataaagagcaaccagagtccatgggttcagaaatccccatgtgtttctgtttgaatgagacgcttgcataaacagcacaaggagtttggggtggggttaaagagaatggtgtggtatagggagagctgaatgaggaactgagagagcaaaatcctgtgtttggttcaatcactgattacaacctccctgaggctcggtctcctaatctgtaaaatggggggaaataatacctgccttgcaggtcctcacacacagggcatgatgtgaatccactgaggcatatagcactgtgtaacatgagttattgctattccaaggcccgtaaaaggctcttgccttggaatatatctgccacaccaatgcctgcagtccattaatgacacataaaggacactggagataacgatgtcccttgttctatgcatccctcccacccatgccagaaaagaaaacacagtcacctgaagtcattctaaagagtatgcctgcctcttttcctgcacagacacatatacacagacacgcacatacacagaccatgcacatacacacacatgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcaggtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataaaagaggatgctaaaaataataaatatatatgtatcaaagtgtgcttgtaataccaggcaaagaattaataagagataatattatggttggtgaaatgttatgtatggctacatcctttcaatgagcatttatagttcctttaaaatatgcctactgaagaaatatttacatgctaattaacatgtgcatagtaccactaggtattatagaggataccagatgtttgtagtagacacagaccttgccctaagtcctggtcttgatgtagtcactttttagtcactacaggtgactacatttagtcactacaagtgaccttccttcaatggggaaataaaggactttacaaaagacgtagaagacaattcttaatataaaagtgatttagatcttcacaagtttgtgaagagaagcagatgagtgaaatagaacactatcaatgtaaaatattattctgaggcctctgtaatgactgggaagcaacaagagggaggtcatttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcatttatccaccagtgtccagatgccatccagcacatgaggagctcccagaaaggagcagggaacaaactagggctgtcaggagtggaggagaaagaatggcatatgcaaaaaggagctgtaattaaatccaagggaacatggcacactctagtcttttgcacgagacaaagggcaatcctggtaaaaatacagatccccaggccccaccccaaagagtctgatctgattctgaaatggggccggagaatctgcattttaacaagcaccttcaccaggtgatccttttgctgagaacccctgagaaatgagaaccctgtgctagtgctgaatggagcattatattccagagttgaagtttggtgatcagttttccagatggagctggtccttggtgcatacctgggtataaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgttaacccatcacttttgccatgttttattatttagaagcaaatcactaagtccagcccacaattagagggatggcattacacaagggaatgaacaccagcagacagggtcattgaaagccatcttagatgctgtctatcgcatctaagtgtgatttttccagatgaaaagaatatattaatttgtttcagtcttagtcgatgtgccatcccatttgtgctttgctaaaacttgtatcaatgtaaagcaaacattttctgatacaatttaggtagtgtattgtggtaatagagaccagtagtgttgaaaagatatgttgaggtcagaaattaagctcatgtttctaaaagaggagatatgtacaactactatgcaagccaacaggaaagagtgttttaagaatgctttctgctacaggtaactaaaaacctaaacagctgtggctttaaaataaaggtatatctaagtcacataagcaaaagtctaggggtgggcagctgctggcattgcttcagtagcttgataatggcaaaagcagcatctcttctatttccttggccttctaatcatgcatgtcacctcacaatcacaacataggcaacacctcatattctaagcaagatgaaaagggcaaagagtcatgccatatgcctctgtctcttttcataaggaagacaaagcttccctggaagtcccctctagcagatttcacttagatctcattggccagaactgagtcacatgcctgccttaaaccaatcactcaccaagaagactaacattatcatggcaagtctaaaccaactgtgactcatctctgaaatcaaaggattattaccattacccgaatccatcaggatcctgttggcagagaagtgggactgtaaattttgagcaggcaacaaacaagtcttctgtaaacttcttatgtgttgttttttatgtgttctatatatccagtagaatcacaatttccaataacagtctaaaaagatattttccaatagaaacagaatgtgtaagatcattacttatgaaatcccaaatgtacttaaggtttccttcttgaaaattccttattcaaaataaaatgtccagattttgaaacccagaaaagattctatattttaaaaatcctgtgcacatgtaaactgtttttcaaatattgccttcagatacattgaacagaatgaaatcttctgagatttactacatcagccaagtattatcaaaacaaacaggacagattgcttttcttgacgtctgctgcttgatttgtgttaactcatgtttctgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagcccatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaagcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaacctagtcacagcccggtgcagtagctcacgtctgtaatcccaacactttgggaggccaaggcaggagaactgcttgagctcaggcgttcaacatcagcctaggcaacatagtgagaccctctcatctctacaaaaagcaaaaaattagccagtgatgcatggctgtagtcccagctattctgagggctgaagttggaggattgcttgagcccaggaggtcaaggctgcagtgggcagtgatcatgccgctgcactctagcctggatgacagagcaagaacctgtctccaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttaaataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactagcagtttctgaaaatgcagtttcactgaaaatgcaggcatccagaaatttagtaagcaacttaaaagaaagtgtaagaatctcctatgtattcattgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcccggtaaattgcttcctaaccttctttggtaatagactattttttaataaaggtgatggatcatttcccattatacactcaaaatgtgtgtccatttcagggcagtcatggatgaccattgcccatcttttgaccccagattaagaacacctgctgtagtattttaattctgccttcaaatcctcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatgccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcctacctttctgttggtaattctgtttttaatcctgtgcttcagtgtagtttatataaatctttacagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgggttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaaatctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtca

SEQ ID NO: 2383 - DNA, 34893 bp, Homo sapiens
  source 1..34893: mol_type = genomic DNA
agagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttctttagtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaaggggaaacagtttaatctgtaactggaagggaaaaaaaaactgtcagaattgactcccttggcttcctggagtaggaaaaaggaaaattggagcatttgcagctttttttgactagctggattatggaatatttaaaagcaacagcaacaaaagtaccttataaactagaaaatagaattgctaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaattctgcccaaagagtgcctggccgatgaacagggtcctatctacatcttatggagactcctattttataaatatgtatcctcaagtccaagcacaaacaaaataacagaaacagggatgattctctcccagtttccatgacagtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacctcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttgtgtttccatttaaatttcaagtaattaatatcaagtaaaatttaaaattcagttccttagtcacactagccacgttgtgagtgtgcaacaggtaaagctagtggcacagacatagaacatttccatcagcacagaaatctctattggacagtgccagattagggtgttctctgcattgtaaaagcatccccttgccaagttaaagaaaacaacaacaaaactctagagaagaaatgaaaccccagtttcatttctggagaggaaagaaaactcatgtgtggcatgagtttatattcaagaaggtgcagcattattacctattttactagtaataatgacacacattatagtatacaatccagttccaataaaattaatttctcatcttactaaaagcttgctgctccacattatgagacaatttacccaaatatagacatttacccaaaaatattaagtagcttgtgaatactttttaaaatttcctttaattaaagtggtcacaaactcaaacccttcattctccctctgagatttctgtgtcatcttttgttcacattgttattcacatgtttattatgtacttattttgattttctagataaataaaatggcttcaaatctataattctgataaaattagccatcaattaatttatttattaaacccatgcaatatgctagattagatgctttgctatgtaattcctacaataaatcctagcaatcacaaagattacagttagtgagacgacatgcacacaggtaaaaagtgtttttaaaaaatacatacatacaaccaaaacagtaagtcactgctacatggaaactgattggtcctttttcctttttttttttttgccttgactgccaggaagcagtttcaaatctatagctggattttaagtttcattaattcatgttcccacatatggttctgtattttcacttcccccttttaactgacatactgtcttatgtgatctctactgtaagccttctcatcattttggaaacagaccaaatataatatatatgataaggaatcaaaagtaaatacagtagtgttgaatattgcataacaaaaaggtttttaaatagggaatggtatcaatatgaagtgttagggagacccagccatgaaaaggatagcagggtcagagaaggaggatgtattgcagctggtttaatggagaatggtatgaaggaggtgcagtttgaattgggtcatggaggacagatggattgcaaatagctggggcaaaagcacaggaaggcattctaaacgagccaggcatggagacaagaatgtctcccacaagggagttgtagtagctcaatcagactgggatttgagatttcatgtggcagagtggtaggtgataaaggtgaaaagactgatcatagtaaaatgcggagtctgtaaatccagcactcatgataagtttggacatcatgtcaacagtggacagccataaatgactgcaagcatcggtgtggtataatgaaggtgacgtttttgtaaaatgactctggtgaaggtacagaaggtaatgaaaagtagccagtctagttgagcagaaaagagttcagatgtaattgcatcatggtccagatgtgaaatgaagacaatgcgaagtggcattgtggatcgaaacatacatgcacaaaatgacagaattttagaatttgaagggatcatcatggttaccaggctggcctccaattcctcttttgtaatattaatagaaattaagggctaacaagtttaaaatgttatccatctttttacatagttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacaaaggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctgttggcattagtattagttttgcttgtgtatttgtttaggagatagcttcacaagttggtgattgatattctaccatgtatgaagtcatgcgtggaattcagaatccccagcttgtaaaattgcattatgatcatctttagtgggaaattgttctcagaatactgagcaaaggatgataccaaaatggcagctattattcattcttaagcatatgaaatgctttcaggttcaacccaaaattacatacattttaaatgcttactaaaagagtcttttccctcctccatctattaactgcaatcaaaaaacttcggttttaactgaacatgatttcatattatttattaaaatttaaggcaaggtgcaccaagtacccttgaattatgaaaagcttcatgatgtgggatattctttcagttaacggcagggttggctacacttttaaggggttcaaagtaggaacagctgcaatagtgagctgcatctggaaagtccagtaatttgaaaaaccacctgtttatgtatcctgcccactcaagtccataaaataacagacactttcatattccaaatgaaactgctttttagtttgccctacttttaaacataactctttgtgatggaatgaccagaaacagctggtctctaagaggacagggctatgtgcgctcacctgcggggttggaccttccataatccccctggctgtggggaaagttgagggctgctgtctttatacaaagatggtttattccaagatacacacactcttcttccacaccctggagaccttgcatatttagtatcttctttaccataatctgaggccctagagaaaaagatttgcaaactatacttgttttaaaacaactttctaaaaaagacactctcagcccctagaaattatgcctaacacatagatgctcagaggcaacctgttgtagtgcaagaggattgtgccaagattagaaaacaaatatttgcaacttttgtaactgtcttctctaaaacttgaatgtggtgattctaaagtaaagaccgacacaaaattctttttctttagcagtcaggaaaaggcatgcatgaagtaatcagatcaggtgtggtttcagcataatggcctaatgctttcatgatctctttcaactggaaagcgttctagtcccactggacaccaaggaggaagaagggacggaaaatattaggcccataggtttatcttcctcagtagtccacgagatttgagcttatatgtagggagcaaaattgtttgtctaaaagcagttaataaatgccccaaaaaggctgggcgcagtgactcactcctgtaatcccagcactttgggagctcaagattggtggatcatgaggttaggagagcaagatcatcctggccaacacggtgaaaccccatctctatgaaaaatacaaaaattagctgggtgtggtagcgcgtgtttaatcccagctactggggaagctgaggcaggagaatggcttgaacccaggaggccaagattgcagtgagccaagattgcgccactgcactccagcctggtgacacagcgagactccgtctcaaaaaataaaataaataaaataaaataaaataaaataaaataaaataaaataaaataaaataaaataaaataaaaataaaatgaacgccccaaaaatattttgggcaaactattttgtgtttcttttctttatttatttatttcttttgagacaaaatcttgctctgttgccccggctggagtgcaatggcacaatcttggctcactgtatcctcaacctcctgggctcaagcaactcctgagtaactgggaccacagggatgtgccacaattcccggctaattgttttagccaggatataaatgctgcctacatagagtttgtagctatctccttgactttctttatgcagattccttcacaaacttttgatggattcctttaccaaattctactgtctgttaaaatcttctatctttatatctttagtccaaacaacacgtcatttataaaccttaaaattgtttctgggcaaataaacaaggcaaaataggaatatatatttttaggcaatttacttctgttttggtctcataaaaaattgtaattaaattgtagaaaatatttcaattcctctttaatatcctctcctcacatactggctctcaacttctaatcctcctattgaaacattgattgggaggccaaggcaggcggatcaactgaggtcaggagtttgagaccagcctggccaacatggtgaaaccctgtctctactaaaaatacaaaagattagctgggcatggtggcatgcacctgtagtcccagctactttggtggctgaggcacgagaatcgctttaacccgggaggcagaagttacagtgtgccaagatcaagccactgaactccagcctgggcgacagagtgagactccatcacaaaaaaataaaaataaaaattgaaatttgcagcctttttaaaaccccatagcctctttataaacccaaaagcactatcaaatttggcgaggtgtcaaaagaatcagaggaatgtttacaaatacagatgcctgggcccacctcagatatatatatatatatatatatatatatatatattttttttttttttttttttttgagacgatgtcttgctctgtcacccaggctggagtgcagtggcatgatctcagctcactgcaagctccgtctcccgggttcacgccattctcctgcctcagcctcccaagtagctgggactacaggcgcccgccaccacggctggctaattttttctattttttagtagagacagggtgtcaccgtgttagccaggatggtctcaatctcctgaccttgtgatccgctcgcctcggcctctcaaagtgctgggattacaggcgtgagccactgcacccggcccagatatattaaattagaatatctagaggtggagcctgagtatctgtatttttcagagtttcaaatgatcgttcttcaaatgattacactgtgaagtcagatttagaaatgactgtacccaaggttggctaaaagatacacaccctggttgattctacctgaagagagcaaataagatacacagcaaagttgtagatgttttccctgccagtagaatacttgcgggttaggccatttaaaaccctgccagagagttttgaaacactgtggagggctcccaaatcaacttgctcaatggttctccatcccttcaggctacttgggcttaaagccaactgcaagcttagagcctcagagtgacctaggaatggggtgaccatatattctaggttgtctcatacagactagccagcactactcagccgcaagtaatagcatccaggcatgctcagaagtgtcccatttggaggaaaaaaacaatattgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaaggtgacgttttaaaaagctgcattcagtgtataaacttctcctgatcccagcaaggatgttgtgatgattttatttaaaaaggtaagttgtgtctagatatggcagtgggtcatctcatgcatggtgcagatgtcaaacacaattacattttcttatttgcaatgactaaaaaaagaagctgagcccaagcagtgagaaagtaggagattgggaggacaagaagcaaaggaaaaaagtaacatgagcaccgttctccctgtcctgccacttgctccattatggactgggctgcgatatctcatatcccagctccacaactcccaacaaccatttatgtgcatggtgcttccatgtgtgatgacccaatcaggctcaggtgtggactgagtagttaaattataacccttgtctctgaagagtttagggcttagtggggaaacagacatgtaaacaaacctgagtgaggtcatgtaatcaaaggacaggccacagtcaaccacaaagaagagagttctcagcagtctccaaagccgaacatatgtttaccaggaacagggtcccagcagagggagcaacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctgtctcacagtaatttaaaagtgaagttttgaaaagctgcatcctgcgcttgtcagaaccatgtctgatgagatatcccctttaaagggctctcggtgcaatggggcaaatcaagggggtttgtgcaagtgggagtgagacaggagatggggtgcttcttccagcactccctataggctgactgagtgacaaagatcattttactgacacctccaatggccctatgagatgggtactattattattatcaccatcatattccttttgcagataaggaaactcaggcttagcagattgccagaacaacacaggcaggaagtggtagagtcagggtttgaacccaggtagtgaaactccaaagcccggattcttaaccactgtcctccagtgcctctctgtaataagtcatgatcccagaagccattggtgtggccacaatatggaaagagatgacagtgtcctcacactgggtgagcagcttatggtgattccagacatgatctctgttgggagtgacaggtctgagcttctaggatcagaccctagatcttggcaagtggtttgaggaaagagaaggaccaatgtaaaaccccaggcttcaaggaatgtggatgctgggcagggaggattaagccccaaagaccagaaatggggtacacagggcaggtgtggccagagtagaactagagtagaacttccagtgactagaaatagaaccagacacgttgcagtggtggataaggtagaatcgcttaagtctttaaagtgcccctgatcacccaagttggccagagaccctggggtggggctgattctgtctggatatacggggaggggtaagcatgaggaaaggaagcaggtcctgacaggtactttgcactaaacagctccttataaggttctcaatttgcctgctcaatttctacagacatttgtgggaccacaccagtacattgtaaaagcaggaaacaattgagaaaaacctgagttttatgttggtaggagaaatgcctatggaatatggcaaatcgtttctctgagacttcctccctagtaattacatatttgttctcaaaaacaaatgccagaaggaagaagcagatttaatagtgcattttacaaggcaccattaatctctaagaagaacaattaaaatgtctcagcaatcatggttcactgtatatcttttctatcttcttagaagtaatatatggctggaaatgggcataccaaaatatgtcaaggaagtggaattgcgttcattagatttcaccactaattattttagttagcttcacagatctctcttccttgcttgttcttgagagcgaggctttttagtaggaagagaaattgtctaaaacgattaataaccacaaattcaccaaactattttgggtaagtccctctatttctctaggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtatgggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattcatcaaagccttccaactatcctgcgtcactgtccttcagtgtcctctctcctctcccttccttctcaccccactttgtgcctgtatccttcaagcagagcaatggcaccctcacttctgtggctgcccagtgccccatgcagagtcagacatcagaaaatagatgctgaattcagttgacactctgaaattctttttaaagtaagttaatgtgtgctttgaatgaaaagacactgggattacattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaagtcccctggcaagggaggggtgaaaggagtgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaaaaagaaaaacaacaacaataacaacacattaatgactctgaaagagtcagacaccattaattccattattggtgtctgtgccaagtgaaatgaacgtcagctcttttcccagatatgtttccttcttttgcctcctataataagagatgattttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaacacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgatttattggaagggttggaaggaaacatggaatgacaattacctttggttattgtcaggttagtatgagacttacaagaaaagcactgctcagacgcaattaccattcaagataagaaataataggaaaggctagcacacttagctttttatttaaaaaagtgttaggtaggctgagcacggtggctcactcctgtaatcccagcactttgggaggccaaggtggatagatgacttgagcccagaagcttgagaccagcctggacaacatggtgaaacctcatgtctacaaaaaaatacaaaaattagccaggcatgatggcatgcacctgtagtctcagctacttggggggccaagaggtgggaagattgcttgagcccaggaagtcgaggctgcagtgagccatgattgtgccactgcatgacagcctgggcaaccgagtgagagcctgcctcaaaaaaaaaaaaaaaaaaagtgttaggtgacatgagagaagatcttccaagtaataagagtggctaatcccaggaatgtgtcaccagaggttattttgtaatagtcgtgtgttaaattccttatttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactccctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcagaatttcttaataattaaacactttatcatgacaagactttcaggaccttaaaggccacagtggggtagttatcatttcactaggtcctcatctggggaggtccttggcatttttactggaatatatttgtcactcaaatttctattacaaaaaattctttcttgcacactgctttagcaactacatgagatatactttgtacatagcacaaatctcatatcacttatgtaatccagctctgtggttccttcctttcctttgcctgtttatttttaattcttcccaagaggaagcttagccagttagaacaccagagtatcatccccctcccccttttcccacctgagttcatggcttagacatactaggaatgaagctgacaacatgcactagtttttttcgaaattatgcagcaaaattcccaaagtgcgagtggccacagagatcttcacagggcccagggacaggcagacatcattctttctccagttcctggcacagaaaagagaccttaggttactgagaagataccagtccctcctcagagcagacaaggaaactgagcctcagaatgaaagactgaatttcagtcctttcttgaacatggacctccagggttatattgggccttggaaaaggcacttacactctggactgtagtttcttcatctataaaatcaagaggcagaaacagacaatctctaagttgcctttatttataaaattccgagattctagttgaccagtattcatacaagagttgaagcctgtaagagtgcagaaagcccacacaaagagacagtggaagacctctcatcagtagtatttttattaccctcttcctaggttttaccagtcaacatcctcactgttaatatacagaccgtggtatttaattaaatcatctttgaaatactgagctatcaacagatggcatgctgaatgcaaaaggaccacaaataaatatttggtactgaagaagatcaagagttggagttcatttcccattctgatctgggctcagaactctgtggtcttccctctaatcatccttgccaccaaattggctgtatctgttctaagatggatcagaaaatcagttccaaagttggctacaaactttcaggtttgggttttgttttgtttttttgttttgttttgttttgtttttgcaaccagccaattcatcttagttcacatgacagagaagtgcataattacttgcaactttagttagagcagtggccttaagaaggtctagctaaataaaaagtgctcagactttctgagtgctgacagttgtcaaattcacctagttcacatggccccatttctatcgtttgttttgttttgtttttgttttttaacagcccatctgtgagcaataggatcagatgactaagagctacagggcagaaacactgttacttagagtcaaattttcccattacctagctgtaaagagtttgtttctctctgactcatataaagtttaccatttaggcccctgcatgattttaattccatcacttaacaccccagccatatgattctgaaggtaaacatgaaggcgtttgaattccagaccacctaaacattcttaaggaaatcatcatctccacgggcagagctatgccaaaatctgtaggttttaactcaaatttcatgataagcaaaaattgaattaatttgtcttccattttgttcacctttttgccaaaattatgcctggattagaataaataaattcaatcaatgaatgcaatcactaattcttacgccagataataacacattcagaattctcctttccctgggagattttatcaggttagtgttcttgtaaacaggagaaagagaaaaatataacttagtaaatagcagtattcactaattcattcatttattcaacaaatattaatttactacctactacattccagggagcttagagtctagtatcagaaataataaccacacacacacatacacacacactacattaaataaggatgtgataggctagatgaaataaataaataaataaaaggtccaggtgagaaaagaaggtgggggctagaaagaagtcattgaagaaaaaacatttaggttaaaacattatgaataacttagagtgagccaagtgcagagtgctgaaggagtgctccaggcaaaatcaacagcaaatggggagtccttgatgtagaaaagggtttgaggaattgtcctgggagaaatactcaagattccagtctgaattctagaggttagtgatttagagaggcaagtacgaaaatgacttcctctcttaccttaaaagtaagtgcaccatagaaggaaatcacccttccttggtaataattcctgagtgagcctgagaagccagaggccatctctattttataggcactgtccccttttcagttacccatggctagctcattgaccttgtcctggtcgtttcctcatttcacttactccatcctcaaaacgtagacgcttcataaatattgtataaatgaatgaactcacaaagtcacagtacagcaaggcaaaagtgcctgcaataaacaagcattctaggctagaaatatttctcaacttcaaattgtgtcttattacattgtattccgattttctagagtggtagttctcagtcaagggaaagtttttcttcccttccaggggatatttggcattgtctggagatagttttagttgtcacgatttgggggatgcttctggctcaacttgggtagagaagcggggatgcttataatcatcctacagtgcacaggacagtacccccacccacactccagtaatgaagaatcattagacctaaaatgttaatggtgtccaggtagaaaaaccctgttgtagaggttggggactgcgtcttgacagccacattatacagtgtatcaaacaattctgtataatgggctgtaattatccttgcctagattttgcaagaaccctagtgtgtatctttttcctcacttgccaagcaatgttcaaacctgcagagatttatttcattcattttctgtgtgtttagtaaacagactagaagcactggaggaaaaaatattccagcaatgaggtaagacgaaagctattagtaaccctagtttaacttagctgaatagtaggaaacaacctctaccgtgaggaagtgtattgtagaaactgaaaagacgctaatgatgtttaaaaagctgtagttcaaacaaatgtgcatgcagaccaatgggtagactgaaaatgatgaagacatttccgtttcttgtgtctttgatagaaaagaaagagcttttattttctttagtgtggcaatcattcagatttgtcccatgacatgcccagaaggttgaagaataacaaactcccaagtgtaaacacagaatttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacatgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttcgagaccagcctcgccaacatggtgaaatcctgcctctactaaaaataaaaaaaaaaaaaattagtcaggtgtggtggcggatgcctgtaatcccagctacttgggaggctgaggcaggagaatcgcttgaacctgggaggcagaggttgcagtgagcaaagatcgcaccattgcacttcagactgggcaacaagaatgagactctgtcacaaaaaaaaaaaaaaaaagtctgcaggctgcataaagaggtatgaaaatgttccagaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatggccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaataagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagattcgaacccagcctccatgctattaaccaggacatcatattgcctttcatacatgctcttcaaaggcaacacagtaatcgattatcacactcactcacatctgattgtcacatttttcagatctgctctcctagcagagaatgaagcctaaggtatccttgtttctcaaagtgtcctccccagaccagctgcatcaaaatgaggggatgaggtgcaaatgcctggaccctgcccttggagcactgattcataatctcaagtcccaagaatctgcattttaacaagcatccccagaaatttcttaagtatactaatgtatgggaaccactgacactaaagaaatggaataaggggaacgtacaatgttacagtaaaccaggaaaagccagaaagacatgacaacacagtgaggactctggtagccaatggtcagtcaaatgcccaggggccctggccagaagagagttaggttgctgaggagtaagagtgatgctgaatgtggaggcttgagagcagaaggaagccagccagctatatcctcttgcttggatcacacaccctttccttggtggaaatggttatttgcagagttagagaaggcatgttttacagtttggatggcaggtatggatgtagacaataaagagcaaccagagtccatgggttcagaaatccccatgtgtttctgtttgaatgagacgcttgcataaacagcacaaggagtttggggtggggttaaagagaatggtgtggtatagggagagctgaatgaggaactgagagagcaaaatcctgtgtttggttcaatcactgattacaacctccctgaggctcggtctcctaatctgtaaaatggggggaaataatacctgccttgcaggtcctcacacacagggcatgatgtgaatccactgaggcatatagcactgtgtaacatgagttattgctattccaaggcccgtaaaaggctcttgccttggaatatatctgccacaccaatgcctgcagtccattaatgacacataaaggacactggagataacgatgtcccttgttctatgcatccctcccacccatgccagaaaagaaaacacagtcacctgaagtcattctaaagagtatgcctgcctcttttcctgcacagacacatatacacagacacgcacatacacagaccatgcacatacacacacatgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcaggtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataaaagaggatgctaaaaataataaatatatatgtatcaaagtgtgcttgtaataccaggcaaagaattaataagagataatattatggttggtgaaatgttatgtatggctacatcctttcaatgagcatttatagttcctttaaaatatgcctactgaagaaatatttacatgctaattaacatgtgcatagtaccactaggtattatagaggataccagatgtttgtagtagacacagaccttgccctaagtcctggtcttgatgtagtcactttttagtcactacaggtgactacatttagtcactacaagtgaccttccttcaatggggaaataaaggactttacaaaagacgtagaagacaattcttaatataaaagtgatttagatcttcacaagtttgtgaagagaagcagatgagtgaaatagaacactatcaatgtaaaatattattctgaggcctctgtaatgactgggaagcaacaagagggaggtcatttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcatttatccaccagtgtccagatgccatccagcacatgaggagctcccagaaaggagcagggaacaaactagggctgtcaggagtggaggagaaagaatggcatatgcaaaaaggagctgtaattaaatccaagggaacatggcacactctagtcttttgcacgagacaaagggcaatcctggtaaaaatacagatccccaggccccaccccaaagagtctgatctgattctgaaatggggccggagaatctgcattttaacaagcaccttcaccaggtgatccttttgctgagaacccctgagaaatgagaaccctgtgctagtgctgaatggagcattatattccagagttgaagtttggtgatcagttttccagatggagctggtccttggtgcatacctgggtataaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgttaacccatcacttttgccatgttttattatttagaagcaaatcactaagtccagcccacaattagagggatggcattacacaagggaatgaacaccagcagacagggtcattgaaagccatcttagatgctgtctatcgcatctaagtgtgatttttccagatgaaaagaatatattaatttgtttcagtcttagtcgatgtgccatcccatttgtgctttgctaaaacttgtatcaatgtaaagcaaacattttctgatacaatttaggtagtgtattgtggtaatagagaccagtagtgttgaaaagatatgttgaggtcagaaattaagctcatgtttctaaaagaggagatatgtacaactactatgcaagccaacaggaaagagtgttttaagaatgctttctgctacaggtaactaaaaacctaaacagctgtggctttaaaataaaggtatatctaagtcacataagcaaaagtctaggggtgggcagctgctggcattgcttcagtagcttgataatggcaaaagcagcatctcttctatttccttggccttctaatcatgcatgtcacctcacaatcacaacataggcaacacctcatattctaagcaagatgaaaagggcaaagagtcatgccatatgcctctgtctcttttcataaggaagacaaagcttccctggaagtcccctctagcagatttcacttagatctcattggccagaactgagtcacatgcctgccttaaaccaatcactcaccaagaagactaacattatcatggcaagtctaaaccaactgtgactcatctctgaaatcaaaggattattaccattacccgaatccatcaggatcctgttggcagagaagtgggactgtaaattttgagcaggcaacaaacaagtcttctgtaaacttcttatgtgttgttttttatgtgttctatatatccagtagaatcacaatttccaataacagtctaaaaagatattttccaatagaaacagaatgtgtaagatcattacttatgaaatcccaaatgtacttaaggtttccttcttgaaaattccttattcaaaataaaatgtccagattttgaaacccagaaaagattctatattttaaaaatcctgtgcacatgtaaactgtttttcaaatattgccttcagatacattgaacagaatgaaatcttctgagatttactacatcagccaagtattatcaaaacaaacaggacagattgcttttcttgacgtctgctgcttgatttgtgttaactcatgtttctgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagcccatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaagcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaacctagtcacagcccggtgcagtagctcacgtctgtaatcccaacactttgggaggccaaggcaggagaactgcttgagctcaggcgttcaacatcagcctaggcaacatagtgagaccctctcatctctacaaaaagcaaaaaattagccagtgatgcatggctgtagtcccagctattctgagggctgaagttggaggattgcttgagcccaggaggtcaaggctgcagtgggcagtgatcatgccgctgcactctagcctggatgacagagcaagaacctgtctccaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttaaataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactagcagtttctgaaaatgcagtttcactgaaaatgcaggcatccagaaatttagtaagcaacttaaaagaaagtgtaagaatctcctatgtattcattgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcccggtaaattgcttcctaaccttctttggtaatagactattttttaataaaggtgatggatcatttcccattatacactcaaaatgtgtgtccatttcagggcagtcatggatgaccattgcccatcttttgaccccagattaagaacacctgctgtagtattttaattctgccttcaaatcctcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatgccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcctacctttctgttggtaattctgtttttaatcctgtgcttcagtgtagtttatataaatctttacagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgggttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaaatctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtca

SEQ ID NO: 2384 - DNA, 34828 bp, Homo sapiens
  source 1..34828: mol_type = genomic DNA
ttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttctttagtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaaggggaaacagtttaatctgtaactggaagggaaaaaaaaactgtcagaattgactcccttggcttcctggagtaggaaaaaggaaaattggagcatttgcagctttttttgactagctggattatggaatatttaaaagcaacagcaacaaaagtaccttataaactagaaaatagaattgctaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaattctgcccaaagagtgcctggccgatgaacagggtcctatctacatcttatggagactcctattttataaatatgtatcctcaagtccaagcacaaacaaaataacagaaacagggatgattctctcccagtttccatgacagtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacctcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttgtgtttccatttaaatttcaagtaattaatatcaagtaaaatttaaaattcagttccttagtcacactagccacgttgtgagtgtgcaacaggtaaagctagtggcacagacatagaacatttccatcagcacagaaatctctattggacagtgccagattagggtgttctctgcattgtaaaagcatccccttgccaagttaaagaaaacaacaacaaaactctagagaagaaatgaaaccccagtttcatttctggagaggaaagaaaactcatgtgtggcatgagtttatattcaagaaggtgcagcattattacctattttactagtaataatgacacacattatagtatacaatccagttccaataaaattaatttctcatcttactaaaagcttgctgctccacattatgagacaatttacccaaatatagacatttacccaaaaatattaagtagcttgtgaatactttttaaaatttcctttaattaaagtggtcacaaactcaaacccttcattctccctctgagatttctgtgtcatcttttgttcacattgttattcacatgtttattatgtacttattttgattttctagataaataaaatggcttcaaatctataattctgataaaattagccatcaattaatttatttattaaacccatgcaatatgctagattagatgctttgctatgtaattcctacaataaatcctagcaatcacaaagattacagttagtgagacgacatgcacacaggtaaaaagtgtttttaaaaaatacatacatacaaccaaaacagtaagtcactgctacatggaaactgattggtcctttttcctttttttttttttgccttgactgccaggaagcagtttcaaatctatagctggattttaagtttcattaattcatgttcccacatatggttctgtattttcacttcccccttttaactgacatactgtcttatgtgatctctactgtaagccttctcatcattttggaaacagaccaaatataatatatatgataaggaatcaaaagtaaatacagtagtgttgaatattgcataacaaaaaggtttttaaatagggaatggtatcaatatgaagtgttagggagacccagccatgaaaaggatagcagggtcagagaaggaggatgtattgcagctggtttaatggagaatggtatgaaggaggtgcagtttgaattgggtcatggaggacagatggattgcaaatagctggggcaaaagcacaggaaggcattctaaacgagccaggcatggagacaagaatgtctcccacaagggagttgtagtagctcaatcagactgggatttgagatttcatgtggcagagtggtaggtgataaaggtgaaaagactgatcatagtaaaatgcggagtctgtaaatccagcactcatgataagtttggacatcatgtcaacagtggacagccataaatgactgcaagcatcggtgtggtataatgaaggtgacgtttttgtaaaatgactctggtgaaggtacagaaggtaatgaaaagtagccagtctagttgagcagaaaagagttcagatgtaattgcatcatggtccagatgtgaaatgaagacaatgcgaagtggcattgtggatcgaaacatacatgcacaaaatgacagaattttagaatttgaagggatcatcatggttaccaggctggcctccaattcctcttttgtaatattaatagaaattaagggctaacaagtttaaaatgttatccatctttttacatagttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacaaaggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctgttggcattagtattagttttgcttgtgtatttgtttaggagatagcttcacaagttggtgattgatattctaccatgtatgaagtcatgcgtggaattcagaatccccagcttgtaaaattgcattatgatcatctttagtgggaaattgttctcagaatactgagcaaaggatgataccaaaatggcagctattattcattcttaagcatatgaaatgctttcaggttcaacccaaaattacatacattttaaatgcttactaaaagagtcttttccctcctccatctattaactgcaatcaaaaaacttcggttttaactgaacatgatttcatattatttattaaaatttaaggcaaggtgcaccaagtacccttgaattatgaaaagcttcatgatgtgggatattctttcagttaacggcagggttggctacacttttaaggggttcaaagtaggaacagctgcaatagtgagctgcatctggaaagtccagtaatttgaaaaaccacctgtttatgtatcctgcccactcaagtccataaaataacagacactttcatattccaaatgaaactgctttttagtttgccctacttttaaacataactctttgtgatggaatgaccagaaacagctggtctctaagaggacagggctatgtgcgctcacctgcggggttggaccttccataatccccctggctgtggggaaagttgagggctgctgtctttatacaaagatggtttattccaagatacacacactcttcttccacaccctggagaccttgcatatttagtatcttctttaccataatctgaggccctagagaaaaagatttgcaaactatacttgttttaaaacaactttctaaaaaagacactctcagcccctagaaattatgcctaacacatagatgctcagaggcaacctgttgtagtgcaagaggattgtgccaagattagaaaacaaatatttgcaacttttgtaactgtcttctctaaaacttgaatgtggtgattctaaagtaaagaccgacacaaaattctttttctttagcagtcaggaaaaggcatgcatgaagtaatcagatcaggtgtggtttcagcataatggcctaatgctttcatgatctctttcaactggaaagcgttctagtcccactggacaccaaggaggaagaagggacggaaaatattaggcccataggtttatcttcctcagtagtccacgagatttgagcttatatgtagggagcaaaattgtttgtctaaaagcagttaataaatgccccaaaaaggctgggcgcagtgactcactcctgtaatcccagcactttgggagctcaagattggtggatcatgaggttaggagagcaagatcatcctggccaacacggtgaaaccccatctctatgaaaaatacaaaaattagctgggtgtggtagcgcgtgtttaatcccagctactggggaagctgaggcaggagaatggcttgaacccaggaggccaagattgcagtgagccaagattgcgccactgcactccagcctggtgacacagcgagactccgtctcaaaaaataaaataaataaaataaaataaaataaaataaaataaaataaaataaaataaaataaaataaaataaaaataaaatgaacgccccaaaaatattttgggcaaactattttgtgtttcttttctttatttatttatttcttttgagacaaaatcttgctctgttgccccggctggagtgcaatggcacaatcttggctcactgtatcctcaacctcctgggctcaagcaactcctgagtaactgggaccacagggatgtgccacaattcccggctaattgttttagccaggatataaatgctgcctacatagagtttgtagctatctccttgactttctttatgcagattccttcacaaacttttgatggattcctttaccaaattctactgtctgttaaaatcttctatctttatatctttagtccaaacaacacgtcatttataaaccttaaaattgtttctgggcaaataaacaaggcaaaataggaatatatatttttaggcaatttacttctgttttggtctcataaaaaattgtaattaaattgtagaaaatatttcaattcctctttaatatcctctcctcacatactggctctcaacttctaatcctcctattgaaacattgattgggaggccaaggcaggcggatcaactgaggtcaggagtttgagaccagcctggccaacatggtgaaaccctgtctctactaaaaatacaaaagattagctgggcatggtggcatgcacctgtagtcccagctactttggtggctgaggcacgagaatcgctttaacccgggaggcagaagttacagtgtgccaagatcaagccactgaactccagcctgggcgacagagtgagactccatcacaaaaaaataaaaataaaaattgaaatttgcagcctttttaaaaccccatagcctctttataaacccaaaagcactatcaaatttggcgaggtgtcaaaagaatcagaggaatgtttacaaatacagatgcctgggcccacctcagatatatatatatatatatatatatatatatatattttttttttttttttttttttgagacgatgtcttgctctgtcacccaggctggagtgcagtggcatgatctcagctcactgcaagctccgtctcccgggttcacgccattctcctgcctcagcctcccaagtagctgggactacaggcgcccgccaccacggctggctaattttttctattttttagtagagacagggtgtcaccgtgttagccaggatggtctcaatctcctgaccttgtgatccgctcgcctcggcctctcaaagtgctgggattacaggcgtgagccactgcacccggcccagatatattaaattagaatatctagaggtggagcctgagtatctgtatttttcagagtttcaaatgatcgttcttcaaatgattacactgtgaagtcagatttagaaatgactgtacccaaggttggctaaaagatacacaccctggttgattctacctgaagagagcaaataagatacacagcaaagttgtagatgttttccctgccagtagaatacttgcgggttaggccatttaaaaccctgccagagagttttgaaacactgtggagggctcccaaatcaacttgctcaatggttctccatcccttcaggctacttgggcttaaagccaactgcaagcttagagcctcagagtgacctaggaatggggtgaccatatattctaggttgtctcatacagactagccagcactactcagccgcaagtaatagcatccaggcatgctcagaagtgtcccatttggaggaaaaaaacaatattgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaaggtgacgttttaaaaagctgcattcagtgtataaacttctcctgatcccagcaaggatgttgtgatgattttatttaaaaaggtaagttgtgtctagatatggcagtgggtcatctcatgcatggtgcagatgtcaaacacaattacattttcttatttgcaatgactaaaaaaagaagctgagcccaagcagtgagaaagtaggagattgggaggacaagaagcaaaggaaaaaagtaacatgagcaccgttctccctgtcctgccacttgctccattatggactgggctgcgatatctcatatcccagctccacaactcccaacaaccatttatgtgcatggtgcttccatgtgtgatgacccaatcaggctcaggtgtggactgagtagttaaattataacccttgtctctgaagagtttagggcttagtggggaaacagacatgtaaacaaacctgagtgaggtcatgtaatcaaaggacaggccacagtcaaccacaaagaagagagttctcagcagtctccaaagccgaacatatgtttaccaggaacagggtcccagcagagggagcaacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctgtctcacagtaatttaaaagtgaagttttgaaaagctgcatcctgcgcttgtcagaaccatgtctgatgagatatcccctttaaagggctctcggtgcaatggggcaaatcaagggggtttgtgcaagtgggagtgagacaggagatggggtgcttcttccagcactccctataggctgactgagtgacaaagatcattttactgacacctccaatggccctatgagatgggtactattattattatcaccatcatattccttttgcagataaggaaactcaggcttagcagattgccagaacaacacaggcaggaagtggtagagtcagggtttgaacccaggtagtgaaactccaaagcccggattcttaaccactgtcctccagtgcctctctgtaataagtcatgatcccagaagccattggtgtggccacaatatggaaagagatgacagtgtcctcacactgggtgagcagcttatggtgattccagacatgatctctgttgggagtgacaggtctgagcttctaggatcagaccctagatcttggcaagtggtttgaggaaagagaaggaccaatgtaaaaccccaggcttcaaggaatgtggatgctgggcagggaggattaagccccaaagaccagaaatggggtacacagggcaggtgtggccagagtagaactagagtagaacttccagtgactagaaatagaaccagacacgttgcagtggtggataaggtagaatcgcttaagtctttaaagtgcccctgatcacccaagttggccagagaccctggggtggggctgattctgtctggatatacggggaggggtaagcatgaggaaaggaagcaggtcctgacaggtactttgcactaaacagctccttataaggttctcaatttgcctgctcaatttctacagacatttgtgggaccacaccagtacattgtaaaagcaggaaacaattgagaaaaacctgagttttatgttggtaggagaaatgcctatggaatatggcaaatcgtttctctgagacttcctccctagtaattacatatttgttctcaaaaacaaatgccagaaggaagaagcagatttaatagtgcattttacaaggcaccattaatctctaagaagaacaattaaaatgtctcagcaatcatggttcactgtatatcttttctatcttcttagaagtaatatatggctggaaatgggcataccaaaatatgtcaaggaagtggaattgcgttcattagatttcaccactaattattttagttagcttcacagatctctcttccttgcttgttcttgagagcgaggctttttagtaggaagagaaattgtctaaaacgattaataaccacaaattcaccaaactattttgggtaagtccctctatttctctaggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtatgggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattcatcaaagccttccaactatcctgcgtcactgtccttcagtgtcctctctcctctcccttccttctcaccccactttgtgcctgtatccttcaagcagagcaatggcaccctcacttctgtggctgcccagtgccccatgcagagtcagacatcagaaaatagatgctgaattcagttgacactctgaaattctttttaaagtaagttaatgtgtgctttgaatgaaaagacactgggattacattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaagtcccctggcaagggaggggtgaaaggagtgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaaaaagaaaaacaacaacaataacaacacattaatgactctgaaagagtcagacaccattaattccattattggtgtctgtgccaagtgaaatgaacgtcagctcttttcccagatatgtttccttcttttgcctcctataataagagatgattttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaacacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgatttattggaagggttggaaggaaacatggaatgacaattacctttggttattgtcaggttagtatgagacttacaagaaaagcactgctcagacgcaattaccattcaagataagaaataataggaaaggctagcacacttagctttttatttaaaaaagtgttaggtaggctgagcacggtggctcactcctgtaatcccagcactttgggaggccaaggtggatagatgacttgagcccagaagcttgagaccagcctggacaacatggtgaaacctcatgtctacaaaaaaatacaaaaattagccaggcatgatggcatgcacctgtagtctcagctacttggggggccaagaggtgggaagattgcttgagcccaggaagtcgaggctgcagtgagccatgattgtgccactgcatgacagcctgggcaaccgagtgagagcctgcctcaaaaaaaaaaaaaaaaaaagtgttaggtgacatgagagaagatcttccaagtaataagagtggctaatcccaggaatgtgtcaccagaggttattttgtaatagtcgtgtgttaaattccttatttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactccctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcagaatttcttaataattaaacactttatcatgacaagactttcaggaccttaaaggccacagtggggtagttatcatttcactaggtcctcatctggggaggtccttggcatttttactggaatatatttgtcactcaaatttctattacaaaaaattctttcttgcacactgctttagcaactacatgagatatactttgtacatagcacaaatctcatatcacttatgtaatccagctctgtggttccttcctttcctttgcctgtttatttttaattcttcccaagaggaagcttagccagttagaacaccagagtatcatccccctcccccttttcccacctgagttcatggcttagacatactaggaatgaagctgacaacatgcactagtttttttcgaaattatgcagcaaaattcccaaagtgcgagtggccacagagatcttcacagggcccagggacaggcagacatcattctttctccagttcctggcacagaaaagagaccttaggttactgagaagataccagtccctcctcagagcagacaaggaaactgagcctcagaatgaaagactgaatttcagtcctttcttgaacatggacctccagggttatattgggccttggaaaaggcacttacactctggactgtagtttcttcatctataaaatcaagaggcagaaacagacaatctctaagttgcctttatttataaaattccgagattctagttgaccagtattcatacaagagttgaagcctgtaagagtgcagaaagcccacacaaagagacagtggaagacctctcatcagtagtatttttattaccctcttcctaggttttaccagtcaacatcctcactgttaatatacagaccgtggtatttaattaaatcatctttgaaatactgagctatcaacagatggcatgctgaatgcaaaaggaccacaaataaatatttggtactgaagaagatcaagagttggagttcatttcccattctgatctgggctcagaactctgtggtcttccctctaatcatccttgccaccaaattggctgtatctgttctaagatggatcagaaaatcagttccaaagttggctacaaactttcaggtttgggttttgttttgtttttttgttttgttttgttttgtttttgcaaccagccaattcatcttagttcacatgacagagaagtgcataattacttgcaactttagttagagcagtggccttaagaaggtctagctaaataaaaagtgctcagactttctgagtgctgacagttgtcaaattcacctagttcacatggccccatttctatcgtttgttttgttttgtttttgttttttaacagcccatctgtgagcaataggatcagatgactaagagctacagggcagaaacactgttacttagagtcaaattttcccattacctagctgtaaagagtttgtttctctctgactcatataaagtttaccatttaggcccctgcatgattttaattccatcacttaacaccccagccatatgattctgaaggtaaacatgaaggcgtttgaattccagaccacctaaacattcttaaggaaatcatcatctccacgggcagagctatgccaaaatctgtaggttttaactcaaatttcatgataagcaaaaattgaattaatttgtcttccattttgttcacctttttgccaaaattatgcctggattagaataaataaattcaatcaatgaatgcaatcactaattcttacgccagataataacacattcagaattctcctttccctgggagattttatcaggttagtgttcttgtaaacaggagaaagagaaaaatataacttagtaaatagcagtattcactaattcattcatttattcaacaaatattaatttactacctactacattccagggagcttagagtctagtatcagaaataataaccacacacacacatacacacacactacattaaataaggatgtgataggctagatgaaataaataaataaataaaaggtccaggtgagaaaagaaggtgggggctagaaagaagtcattgaagaaaaaacatttaggttaaaacattatgaataacttagagtgagccaagtgcagagtgctgaaggagtgctccaggcaaaatcaacagcaaatggggagtccttgatgtagaaaagggtttgaggaattgtcctgggagaaatactcaagattccagtctgaattctagaggttagtgatttagagaggcaagtacgaaaatgacttcctctcttaccttaaaagtaagtgcaccatagaaggaaatcacccttccttggtaataattcctgagtgagcctgagaagccagaggccatctctattttataggcactgtccccttttcagttacccatggctagctcattgaccttgtcctggtcgtttcctcatttcacttactccatcctcaaaacgtagacgcttcataaatattgtataaatgaatgaactcacaaagtcacagtacagcaaggcaaaagtgcctgcaataaacaagcattctaggctagaaatatttctcaacttcaaattgtgtcttattacattgtattccgattttctagagtggtagttctcagtcaagggaaagtttttcttcccttccaggggatatttggcattgtctggagatagttttagttgtcacgatttgggggatgcttctggctcaacttgggtagagaagcggggatgcttataatcatcctacagtgcacaggacagtacccccacccacactccagtaatgaagaatcattagacctaaaatgttaatggtgtccaggtagaaaaaccctgttgtagaggttggggactgcgtcttgacagccacattatacagtgtatcaaacaattctgtataatgggctgtaattatccttgcctagattttgcaagaaccctagtgtgtatctttttcctcacttgccaagcaatgttcaaacctgcagagatttatttcattcattttctgtgtgtttagtaaacagactagaagcactggaggaaaaaatattccagcaatgaggtaagacgaaagctattagtaaccctagtttaacttagctgaatagtaggaaacaacctctaccgtgaggaagtgtattgtagaaactgaaaagacgctaatgatgtttaaaaagctgtagttcaaacaaatgtgcatgcagaccaatgggtagactgaaaatgatgaagacatttccgtttcttgtgtctttgatagaaaagaaagagcttttattttctttagtgtggcaatcattcagatttgtcccatgacatgcccagaaggttgaagaataacaaactcccaagtgtaaacacagaatttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacatgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttcgagaccagcctcgccaacatggtgaaatcctgcctctactaaaaataaaaaaaaaaaaaattagtcaggtgtggtggcggatgcctgtaatcccagctacttgggaggctgaggcaggagaatcgcttgaacctgggaggcagaggttgcagtgagcaaagatcgcaccattgcacttcagactgggcaacaagaatgagactctgtcacaaaaaaaaaaaaaaaaagtctgcaggctgcataaagaggtatgaaaatgttccagaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatggccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaataagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagattcgaacccagcctccatgctattaaccaggacatcatattgcctttcatacatgctcttcaaaggcaacacagtaatcgattatcacactcactcacatctgattgtcacatttttcagatctgctctcctagcagagaatgaagcctaaggtatccttgtttctcaaagtgtcctccccagaccagctgcatcaaaatgaggggatgaggtgcaaatgcctggaccctgcccttggagcactgattcataatctcaagtcccaagaatctgcattttaacaagcatccccagaaatttcttaagtatactaatgtatgggaaccactgacactaaagaaatggaataaggggaacgtacaatgttacagtaaaccaggaaaagccagaaagacatgacaacacagtgaggactctggtagccaatggtcagtcaaatgcccaggggccctggccagaagagagttaggttgctgaggagtaagagtgatgctgaatgtggaggcttgagagcagaaggaagccagccagctatatcctcttgcttggatcacacaccctttccttggtggaaatggttatttgcagagttagagaaggcatgttttacagtttggatggcaggtatggatgtagacaataaagagcaaccagagtccatgggttcagaaatccccatgtgtttctgtttgaatgagacgcttgcataaacagcacaaggagtttggggtggggttaaagagaatggtgtggtatagggagagctgaatgaggaactgagagagcaaaatcctgtgtttggttcaatcactgattacaacctccctgaggctcggtctcctaatctgtaaaatggggggaaataatacctgccttgcaggtcctcacacacagggcatgatgtgaatccactgaggcatatagcactgtgtaacatgagttattgctattccaaggcccgtaaaaggctcttgccttggaatatatctgccacaccaatgcctgcagtccattaatgacacataaaggacactggagataacgatgtcccttgttctatgcatccctcccacccatgccagaaaagaaaacacagtcacctgaagtcattctaaagagtatgcctgcctcttttcctgcacagacacatatacacagacacgcacatacacagaccatgcacatacacacacatgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcaggtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataaaagaggatgctaaaaataataaatatatatgtatcaaagtgtgcttgtaataccaggcaaagaattaataagagataatattatggttggtgaaatgttatgtatggctacatcctttcaatgagcatttatagttcctttaaaatatgcctactgaagaaatatttacatgctaattaacatgtgcatagtaccactaggtattatagaggataccagatgtttgtagtagacacagaccttgccctaagtcctggtcttgatgtagtcactttttagtcactacaggtgactacatttagtcactacaagtgaccttccttcaatggggaaataaaggactttacaaaagacgtagaagacaattcttaatataaaagtgatttagatcttcacaagtttgtgaagagaagcagatgagtgaaatagaacactatcaatgtaaaatattattctgaggcctctgtaatgactgggaagcaacaagagggaggtcatttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcatttatccaccagtgtccagatgccatccagcacatgaggagctcccagaaaggagcagggaacaaactagggctgtcaggagtggaggagaaagaatggcatatgcaaaaaggagctgtaattaaatccaagggaacatggcacactctagtcttttgcacgagacaaagggcaatcctggtaaaaatacagatccccaggccccaccccaaagagtctgatctgattctgaaatggggccggagaatctgcattttaacaagcaccttcaccaggtgatccttttgctgagaacccctgagaaatgagaaccctgtgctagtgctgaatggagcattatattccagagttgaagtttggtgatcagttttccagatggagctggtccttggtgcatacctgggtataaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgttaacccatcacttttgccatgttttattatttagaagcaaatcactaagtccagcccacaattagagggatggcattacacaagggaatgaacaccagcagacagggtcattgaaagccatcttagatgctgtctatcgcatctaagtgtgatttttccagatgaaaagaatatattaatttgtttcagtcttagtcgatgtgccatcccatttgtgctttgctaaaacttgtatcaatgtaaagcaaacattttctgatacaatttaggtagtgtattgtggtaatagagaccagtagtgttgaaaagatatgttgaggtcagaaattaagctcatgtttctaaaagaggagatatgtacaactactatgcaagccaacaggaaagagtgttttaagaatgctttctgctacaggtaactaaaaacctaaacagctgtggctttaaaataaaggtatatctaagtcacataagcaaaagtctaggggtgggcagctgctggcattgcttcagtagcttgataatggcaaaagcagcatctcttctatttccttggccttctaatcatgcatgtcacctcacaatcacaacataggcaacacctcatattctaagcaagatgaaaagggcaaagagtcatgccatatgcctctgtctcttttcataaggaagacaaagcttccctggaagtcccctctagcagatttcacttagatctcattggccagaactgagtcacatgcctgccttaaaccaatcactcaccaagaagactaacattatcatggcaagtctaaaccaactgtgactcatctctgaaatcaaaggattattaccattacccgaatccatcaggatcctgttggcagagaagtgggactgtaaattttgagcaggcaacaaacaagtcttctgtaaacttcttatgtgttgttttttatgtgttctatatatccagtagaatcacaatttccaataacagtctaaaaagatattttccaatagaaacagaatgtgtaagatcattacttatgaaatcccaaatgtacttaaggtttccttcttgaaaattccttattcaaaataaaatgtccagattttgaaacccagaaaagattctatattttaaaaatcctgtgcacatgtaaactgtttttcaaatattgccttcagatacattgaacagaatgaaatcttctgagatttactacatcagccaagtattatcaaaacaaacaggacagattgcttttcttgacgtctgctgcttgatttgtgttaactcatgtttctgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagcccatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaagcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaacctagtcacagcccggtgcagtagctcacgtctgtaatcccaacactttgggaggccaaggcaggagaactgcttgagctcaggcgttcaacatcagcctaggcaacatagtgagaccctctcatctctacaaaaagcaaaaaattagccagtgatgcatggctgtagtcccagctattctgagggctgaagttggaggattgcttgagcccaggaggtcaaggctgcagtgggcagtgatcatgccgctgcactctagcctggatgacagagcaagaacctgtctccaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttaaataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactagcagtttctgaaaatgcagtttcactgaaaatgcaggcatccagaaatttagtaagcaacttaaaagaaagtgtaagaatctcctatgtattcattgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcccggtaaattgcttcctaaccttctttggtaatagactattttttaataaaggtgatggatcatttcccattatacactcaaaatgtgtgtccatttcagggcagtcatggatgaccattgcccatcttttgaccccagattaagaacacctgctgtagtattttaattctgccttcaaatcctcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatgccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcctacctttctgttggtaattctgtttttaatcctgtgcttcagtgtagtttatataaatctttacagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgggttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaaatctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtca

SEQ ID NO: 2385 - DNA, 36401 bp, Homo sapiens
  source 1..36401: mol_type = genomic DNA
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcaggtgagactgagttctaggacatttagggggtctggtgcctggctccgccaaaaatggggactttcgggattgtgatcatcacggcggattgagcagggagagccgtggagggacaagagagggccgaggcagggtggggggcgcgggcaggtgcgagggggatgcggccaagaagcagcgataaagggaacattccacgggtcgggcggctgctgttggatcttagataaagctggaagggattaccggggcaggggtaatagggaccggggacgggaacgcgaaacaggtgaagcgctcagggcgagagcgactcggcttagggagtccgggagaagcctgcggctgccccctcgccgccgaggtcctgcgggtcctgcgggtcctgcgtgctgagccggggcgtgcgcgggcgggggccttcggaccgcgcggcggggcctgccctgacccctggcggcgggcgggggaggcaggcgcgccctgcagagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttctttagtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaaggggaaacagtttaatctgtaactggaagggaaaaaaaaactgtcagaattgactcccttggcttcctggagtaggaaaaaggaaaattggagcatttgcagctttttttgactagctggattatggaatatttaaaagcaacagcaacaaaagtaccttataaactagaaaatagaattgctaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaattctgcccaaagagtgcctggccgatgaacagggtcctatctacatcttatggagactcctattttataaatatgtatcctcaagtccaagcacaaacaaaataacagaaacagggatgattctctcccagtttccatgacagtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacctcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttgtgtttccatttaaatttcaagtaattaatatcaagtaaaatttaaaattcagttccttagtcacactagccacgttgtgagtgtgcaacaggtaaagctagtggcacagacatagaacatttccatcagcacagaaatctctattggacagtgccagattagggtgttctctgcattgtaaaagcatccccttgccaagttaaagaaaacaacaacaaaactctagagaagaaatgaaaccccagtttcatttctggagaggaaagaaaactcatgtgtggcatgagtttatattcaagaaggtgcagcattattacctattttactagtaataatgacacacattatagtatacaatccagttccaataaaattaatttctcatcttactaaaagcttgctgctccacattatgagacaatttacccaaatatagacatttacccaaaaatattaagtagcttgtgaatactttttaaaatttcctttaattaaagtggtcacaaactcaaacccttcattctccctctgagatttctgtgtcatcttttgttcacattgttattcacatgtttattatgtacttattttgattttctagataaataaaatggcttcaaatctataattctgataaaattagccatcaattaatttatttattaaacccatgcaatatgctagattagatgctttgctatgtaattcctacaataaatcctagcaatcacaaagattacagttagtgagacgacatgcacacaggtaaaaagtgtttttaaaaaatacatacatacaaccaaaacagtaagtcactgctacatggaaactgattggtcctttttcctttttttttttttgccttgactgccaggaagcagtttcaaatctatagctggattttaagtttcattaattcatgttcccacatatggttctgtattttcacttcccccttttaactgacatactgtcttatgtgatctctactgtaagccttctcatcattttggaaacagaccaaatataatatatatgataaggaatcaaaagtaaatacagtagtgttgaatattgcataacaaaaaggtttttaaatagggaatggtatcaatatgaagtgttagggagacccagccatgaaaaggatagcagggtcagagaaggaggatgtattgcagctggtttaatggagaatggtatgaaggaggtgcagtttgaattgggtcatggaggacagatggattgcaaatagctggggcaaaagcacaggaaggcattctaaacgagccaggcatggagacaagaatgtctcccacaagggagttgtagtagctcaatcagactgggatttgagatttcatgtggcagagtggtaggtgataaaggtgaaaagactgatcatagtaaaatgcggagtctgtaaatccagcactcatgataagtttggacatcatgtcaacagtggacagccataaatgactgcaagcatcggtgtggtataatgaaggtgacgtttttgtaaaatgactctggtgaaggtacagaaggtaatgaaaagtagccagtctagttgagcagaaaagagttcagatgtaattgcatcatggtccagatgtgaaatgaagacaatgcgaagtggcattgtggatcgaaacatacatgcacaaaatgacagaattttagaatttgaagggatcatcatggttaccaggctggcctccaattcctcttttgtaatattaatagaaattaagggctaacaagtttaaaatgttatccatctttttacatagttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacaaaggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctgttggcattagtattagttttgcttgtgtatttgtttaggagatagcttcacaagttggtgattgatattctaccatgtatgaagtcatgcgtggaattcagaatccccagcttgtaaaattgcattatgatcatctttagtgggaaattgttctcagaatactgagcaaaggatgataccaaaatggcagctattattcattcttaagcatatgaaatgctttcaggttcaacccaaaattacatacattttaaatgcttactaaaagagtcttttccctcctccatctattaactgcaatcaaaaaacttcggttttaactgaacatgatttcatattatttattaaaatttaaggcaaggtgcaccaagtacccttgaattatgaaaagcttcatgatgtgggatattctttcagttaacggcagggttggctacacttttaaggggttcaaagtaggaacagctgcaatagtgagctgcatctggaaagtccagtaatttgaaaaaccacctgtttatgtatcctgcccactcaagtccataaaataacagacactttcatattccaaatgaaactgctttttagtttgccctacttttaaacataactctttgtgatggaatgaccagaaacagctggtctctaagaggacagggctatgtgcgctcacctgcggggttggaccttccataatccccctggctgtggggaaagttgagggctgctgtctttatacaaagatggtttattccaagatacacacactcttcttccacaccctggagaccttgcatatttagtatcttctttaccataatctgaggccctagagaaaaagatttgcaaactatacttgttttaaaacaactttctaaaaaagacactctcagcccctagaaattatgcctaacacatagatgctcagaggcaacctgttgtagtgcaagaggattgtgccaagattagaaaacaaatatttgcaacttttgtaactgtcttctctaaaacttgaatgtggtgattctaaagtaaagaccgacacaaaattctttttctttagcagtcaggaaaaggcatgcatgaagtaatcagatcaggtgtggtttcagcataatggcctaatgctttcatgatctctttcaactggaaagcgttctagtcccactggacaccaaggaggaagaagggacggaaaatattaggcccataggtttatcttcctcagtagtccacgagatttgagcttatatgtagggagcaaaattgtttgtctaaaagcagttaataaatgccccaaaaaggctgggcgcagtgactcactcctgtaatcccagcactttgggagctcaagattggtggatcatgaggttaggagagcaagatcatcctggccaacacggtgaaaccccatctctatgaaaaatacaaaaattagctgggtgtggtagcgcgtgtttaatcccagctactggggaagctgaggcaggagaatggcttgaacccaggaggccaagattgcagtgagccaagattgcgccactgcactccagcctggtgacacagcgagactccgtctcaaaaaataaaataaataaaataaaataaaataaaataaaataaaataaaataaaataaaataaaataaaataaaaataaaatgaacgccccaaaaatattttgggcaaactattttgtgtttcttttctttatttatttatttcttttgagacaaaatcttgctctgttgccccggctggagtgcaatggcacaatcttggctcactgtatcctcaacctcctgggctcaagcaactcctgagtaactgggaccacagggatgtgccacaattcccggctaattgttttagccaggatataaatgctgcctacatagagtttgtagctatctccttgactttctttatgcagattccttcacaaacttttgatggattcctttaccaaattctactgtctgttaaaatcttctatctttatatctttagtccaaacaacacgtcatttataaaccttaaaattgtttctgggcaaataaacaaggcaaaataggaatatatatttttaggcaatttacttctgttttggtctcataaaaaattgtaattaaattgtagaaaatatttcaattcctctttaatatcctctcctcacatactggctctcaacttctaatcctcctattgaaacattgattgggaggccaaggcaggcggatcaactgaggtcaggagtttgagaccagcctggccaacatggtgaaaccctgtctctactaaaaatacaaaagattagctgggcatggtggcatgcacctgtagtcccagctactttggtggctgaggcacgagaatcgctttaacccgggaggcagaagttacagtgtgccaagatcaagccactgaactccagcctgggcgacagagtgagactccatcacaaaaaaataaaaataaaaattgaaatttgcagcctttttaaaaccccatagcctctttataaacccaaaagcactatcaaatttggcgaggtgtcaaaagaatcagaggaatgtttacaaatacagatgcctgggcccacctcagatatatatatatatatatatatatatatatatattttttttttttttttttttttgagacgatgtcttgctctgtcacccaggctggagtgcagtggcatgatctcagctcactgcaagctccgtctcccgggttcacgccattctcctgcctcagcctcccaagtagctgggactacaggcgcccgccaccacggctggctaattttttctattttttagtagagacagggtgtcaccgtgttagccaggatggtctcaatctcctgaccttgtgatccgctcgcctcggcctctcaaagtgctgggattacaggcgtgagccactgcacccggcccagatatattaaattagaatatctagaggtggagcctgagtatctgtatttttcagagtttcaaatgatcgttcttcaaatgattacactgtgaagtcagatttagaaatgactgtacccaaggttggctaaaagatacacaccctggttgattctacctgaagagagcaaataagatacacagcaaagttgtagatgttttccctgccagtagaatacttgcgggttaggccatttaaaaccctgccagagagttttgaaacactgtggagggctcccaaatcaacttgctcaatggttctccatcccttcaggctacttgggcttaaagccaactgcaagcttagagcctcagagtgacctaggaatggggtgaccatatattctaggttgtctcatacagactagccagcactactcagccgcaagtaatagcatccaggcatgctcagaagtgtcccatttggaggaaaaaaacaatattgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaaggtgacgttttaaaaagctgcattcagtgtataaacttctcctgatcccagcaaggatgttgtgatgattttatttaaaaaggtaagttgtgtctagatatggcagtgggtcatctcatgcatggtgcagatgtcaaacacaattacattttcttatttgcaatgactaaaaaaagaagctgagcccaagcagtgagaaagtaggagattgggaggacaagaagcaaaggaaaaaagtaacatgagcaccgttctccctgtcctgccacttgctccattatggactgggctgcgatatctcatatcccagctccacaactcccaacaaccatttatgtgcatggtgcttccatgtgtgatgacccaatcaggctcaggtgtggactgagtagttaaattataacccttgtctctgaagagtttagggcttagtggggaaacagacatgtaaacaaacctgagtgaggtcatgtaatcaaaggacaggccacagtcaaccacaaagaagagagttctcagcagtctccaaagccgaacatatgtttaccaggaacagggtcccagcagagggagcaacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctgtctcacagtaatttaaaagtgaagttttgaaaagctgcatcctgcgcttgtcagaaccatgtctgatgagatatcccctttaaagggctctcggtgcaatggggcaaatcaagggggtttgtgcaagtgggagtgagacaggagatggggtgcttcttccagcactccctataggctgactgagtgacaaagatcattttactgacacctccaatggccctatgagatgggtactattattattatcaccatcatattccttttgcagataaggaaactcaggcttagcagattgccagaacaacacaggcaggaagtggtagagtcagggtttgaacccaggtagtgaaactccaaagcccggattcttaaccactgtcctccagtgcctctctgtaataagtcatgatcccagaagccattggtgtggccacaatatggaaagagatgacagtgtcctcacactgggtgagcagcttatggtgattccagacatgatctctgttgggagtgacaggtctgagcttctaggatcagaccctagatcttggcaagtggtttgaggaaagagaaggaccaatgtaaaaccccaggcttcaaggaatgtggatgctgggcagggaggattaagccccaaagaccagaaatggggtacacagggcaggtgtggccagagtagaactagagtagaacttccagtgactagaaatagaaccagacacgttgcagtggtggataaggtagaatcgcttaagtctttaaagtgcccctgatcacccaagttggccagagaccctggggtggggctgattctgtctggatatacggggaggggtaagcatgaggaaaggaagcaggtcctgacaggtactttgcactaaacagctccttataaggttctcaatttgcctgctcaatttctacagacatttgtgggaccacaccagtacattgtaaaagcaggaaacaattgagaaaaacctgagttttatgttggtaggagaaatgcctatggaatatggcaaatcgtttctctgagacttcctccctagtaattacatatttgttctcaaaaacaaatgccagaaggaagaagcagatttaatagtgcattttacaaggcaccattaatctctaagaagaacaattaaaatgtctcagcaatcatggttcactgtatatcttttctatcttcttagaagtaatatatggctggaaatgggcataccaaaatatgtcaaggaagtggaattgcgttcattagatttcaccactaattattttagttagcttcacagatctctcttccttgcttgttcttgagagcgaggctttttagtaggaagagaaattgtctaaaacgattaataaccacaaattcaccaaactattttgggtaagtccctctatttctctaggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtatgggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattcatcaaagccttccaactatcctgcgtcactgtccttcagtgtcctctctcctctcccttccttctcaccccactttgtgcctgtatccttcaagcagagcaatggcaccctcacttctgtggctgcccagtgccccatgcagagtcagacatcagaaaatagatgctgaattcagttgacactctgaaattctttttaaagtaagttaatgtgtgctttgaatgaaaagacactgggattacattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaagtcccctggcaagggaggggtgaaaggagtgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaaaaagaaaaacaacaacaataacaacacattaatgactctgaaagagtcagacaccattaattccattattggtgtctgtgccaagtgaaatgaacgtcagctcttttcccagatatgtttccttcttttgcctcctataataagagatgattttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaacacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgatttattggaagggttggaaggaaacatggaatgacaattacctttggttattgtcaggttagtatgagacttacaagaaaagcactgctcagacgcaattaccattcaagataagaaataataggaaaggctagcacacttagctttttatttaaaaaagtgttaggtaggctgagcacggtggctcactcctgtaatcccagcactttgggaggccaaggtggatagatgacttgagcccagaagcttgagaccagcctggacaacatggtgaaacctcatgtctacaaaaaaatacaaaaattagccaggcatgatggcatgcacctgtagtctcagctacttggggggccaagaggtgggaagattgcttgagcccaggaagtcgaggctgcagtgagccatgattgtgccactgcatgacagcctgggcaaccgagtgagagcctgcctcaaaaaaaaaaaaaaaaaaagtgttaggtgacatgagagaagatcttccaagtaataagagtggctaatcccaggaatgtgtcaccagaggttattttgtaatagtcgtgtgttaaattccttatttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactccctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcagaatttcttaataattaaacactttatcatgacaagactttcaggaccttaaaggccacagtggggtagttatcatttcactaggtcctcatctggggaggtccttggcatttttactggaatatatttgtcactcaaatttctattacaaaaaattctttcttgcacactgctttagcaactacatgagatatactttgtacatagcacaaatctcatatcacttatgtaatccagctctgtggttccttcctttcctttgcctgtttatttttaattcttcccaagaggaagcttagccagttagaacaccagagtatcatccccctcccccttttcccacctgagttcatggcttagacatactaggaatgaagctgacaacatgcactagtttttttcgaaattatgcagcaaaattcccaaagtgcgagtggccacagagatcttcacagggcccagggacaggcagacatcattctttctccagttcctggcacagaaaagagaccttaggttactgagaagataccagtccctcctcagagcagacaaggaaactgagcctcagaatgaaagactgaatttcagtcctttcttgaacatggacctccagggttatattgggccttggaaaaggcacttacactctggactgtagtttcttcatctataaaatcaagaggcagaaacagacaatctctaagttgcctttatttataaaattccgagattctagttgaccagtattcatacaagagttgaagcctgtaagagtgcagaaagcccacacaaagagacagtggaagacctctcatcagtagtatttttattaccctcttcctaggttttaccagtcaacatcctcactgttaatatacagaccgtggtatttaattaaatcatctttgaaatactgagctatcaacagatggcatgctgaatgcaaaaggaccacaaataaatatttggtactgaagaagatcaagagttggagttcatttcccattctgatctgggctcagaactctgtggtcttccctctaatcatccttgccaccaaattggctgtatctgttctaagatggatcagaaaatcagttccaaagttggctacaaactttcaggtttgggttttgttttgtttttttgttttgttttgttttgtttttgcaaccagccaattcatcttagttcacatgacagagaagtgcataattacttgcaactttagttagagcagtggccttaagaaggtctagctaaataaaaagtgctcagactttctgagtgctgacagttgtcaaattcacctagttcacatggccccatttctatcgtttgttttgttttgtttttgttttttaacagcccatctgtgagcaataggatcagatgactaagagctacagggcagaaacactgttacttagagtcaaattttcccattacctagctgtaaagagtttgtttctctctgactcatataaagtttaccatttaggcccctgcatgattttaattccatcacttaacaccccagccatatgattctgaaggtaaacatgaaggcgtttgaattccagaccacctaaacattcttaaggaaatcatcatctccacgggcagagctatgccaaaatctgtaggttttaactcaaatttcatgataagcaaaaattgaattaatttgtcttccattttgttcacctttttgccaaaattatgcctggattagaataaataaattcaatcaatgaatgcaatcactaattcttacgccagataataacacattcagaattctcctttccctgggagattttatcaggttagtgttcttgtaaacaggagaaagagaaaaatataacttagtaaatagcagtattcactaattcattcatttattcaacaaatattaatttactacctactacattccagggagcttagagtctagtatcagaaataataaccacacacacacatacacacacactacattaaataaggatgtgataggctagatgaaataaataaataaataaaaggtccaggtgagaaaagaaggtgggggctagaaagaagtcattgaagaaaaaacatttaggttaaaacattatgaataacttagagtgagccaagtgcagagtgctgaaggagtgctccaggcaaaatcaacagcaaatggggagtccttgatgtagaaaagggtttgaggaattgtcctgggagaaatactcaagattccagtctgaattctagaggttagtgatttagagaggcaagtacgaaaatgacttcctctcttaccttaaaagtaagtgcaccatagaaggaaatcacccttccttggtaataattcctgagtgagcctgagaagccagaggccatctctattttataggcactgtccccttttcagttacccatggctagctcattgaccttgtcctggtcgtttcctcatttcacttactccatcctcaaaacgtagacgcttcataaatattgtataaatgaatgaactcacaaagtcacagtacagcaaggcaaaagtgcctgcaataaacaagcattctaggctagaaatatttctcaacttcaaattgtgtcttattacattgtattccgattttctagagtggtagttctcagtcaagggaaagtttttcttcccttccaggggatatttggcattgtctggagatagttttagttgtcacgatttgggggatgcttctggctcaacttgggtagagaagcggggatgcttataatcatcctacagtgcacaggacagtacccccacccacactccagtaatgaagaatcattagacctaaaatgttaatggtgtccaggtagaaaaaccctgttgtagaggttggggactgcgtcttgacagccacattatacagtgtatcaaacaattctgtataatgggctgtaattatccttgcctagattttgcaagaaccctagtgtgtatctttttcctcacttgccaagcaatgttcaaacctgcagagatttatttcattcattttctgtgtgtttagtaaacagactagaagcactggaggaaaaaatattccagcaatgaggtaagacgaaagctattagtaaccctagtttaacttagctgaatagtaggaaacaacctctaccgtgaggaagtgtattgtagaaactgaaaagacgctaatgatgtttaaaaagctgtagttcaaacaaatgtgcatgcagaccaatgggtagactgaaaatgatgaagacatttccgtttcttgtgtctttgatagaaaagaaagagcttttattttctttagtgtggcaatcattcagatttgtcccatgacatgcccagaaggttgaagaataacaaactcccaagtgtaaacacagaatttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacatgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttcgagaccagcctcgccaacatggtgaaatcctgcctctactaaaaataaaaaaaaaaaaaattagtcaggtgtggtggcggatgcctgtaatcccagctacttgggaggctgaggcaggagaatcgcttgaacctgggaggcagaggttgcagtgagcaaagatcgcaccattgcacttcagactgggcaacaagaatgagactctgtcacaaaaaaaaaaaaaaaaagtctgcaggctgcataaagaggtatgaaaatgttccagaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatggccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaataagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagattcgaacccagcctccatgctattaaccaggacatcatattgcctttcatacatgctcttcaaaggcaacacagtaatcgattatcacactcactcacatctgattgtcacatttttcagatctgctctcctagcagagaatgaagcctaaggtatccttgtttctcaaagtgtcctccccagaccagctgcatcaaaatgaggggatgaggtgcaaatgcctggaccctgcccttggagcactgattcataatctcaagtcccaagaatctgcattttaacaagcatccccagaaatttcttaagtatactaatgtatgggaaccactgacactaaagaaatggaataaggggaacgtacaatgttacagtaaaccaggaaaagccagaaagacatgacaacacagtgaggactctggtagccaatggtcagtcaaatgcccaggggccctggccagaagagagttaggttgctgaggagtaagagtgatgctgaatgtggaggcttgagagcagaaggaagccagccagctatatcctcttgcttggatcacacaccctttccttggtggaaatggttatttgcagagttagagaaggcatgttttacagtttggatggcaggtatggatgtagacaataaagagcaaccagagtccatgggttcagaaatccccatgtgtttctgtttgaatgagacgcttgcataaacagcacaaggagtttggggtggggttaaagagaatggtgtggtatagggagagctgaatgaggaactgagagagcaaaatcctgtgtttggttcaatcactgattacaacctccctgaggctcggtctcctaatctgtaaaatggggggaaataatacctgccttgcaggtcctcacacacagggcatgatgtgaatccactgaggcatatagcactgtgtaacatgagttattgctattccaaggcccgtaaaaggctcttgccttggaatatatctgccacaccaatgcctgcagtccattaatgacacataaaggacactggagataacgatgtcccttgttctatgcatccctcccacccatgccagaaaagaaaacacagtcacctgaagtcattctaaagagtatgcctgcctcttttcctgcacagacacatatacacagacacgcacatacacagaccatgcacatacacacacatgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcaggtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataaaagaggatgctaaaaataataaatatatatgtatcaaagtgtgcttgtaataccaggcaaagaattaataagagataatattatggttggtgaaatgttatgtatggctacatcctttcaatgagcatttatagttcctttaaaatatgcctactgaagaaatatttacatgctaattaacatgtgcatagtaccactaggtattatagaggataccagatgtttgtagtagacacagaccttgccctaagtcctggtcttgatgtagtcactttttagtcactacaggtgactacatttagtcactacaagtgaccttccttcaatggggaaataaaggactttacaaaagacgtagaagacaattcttaatataaaagtgatttagatcttcacaagtttgtgaagagaagcagatgagtgaaatagaacactatcaatgtaaaatattattctgaggcctctgtaatgactgggaagcaacaagagggaggtcatttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcatttatccaccagtgtccagatgccatccagcacatgaggagctcccagaaaggagcagggaacaaactagggctgtcaggagtggaggagaaagaatggcatatgcaaaaaggagctgtaattaaatccaagggaacatggcacactctagtcttttgcacgagacaaagggcaatcctggtaaaaatacagatccccaggccccaccccaaagagtctgatctgattctgaaatggggccggagaatctgcattttaacaagcaccttcaccaggtgatccttttgctgagaacccctgagaaatgagaaccctgtgctagtgctgaatggagcattatattccagagttgaagtttggtgatcagttttccagatggagctggtccttggtgcatacctgggtataaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgttaacccatcacttttgccatgttttattatttagaagcaaatcactaagtccagcccacaattagagggatggcattacacaagggaatgaacaccagcagacagggtcattgaaagccatcttagatgctgtctatcgcatctaagtgtgatttttccagatgaaaagaatatattaatttgtttcagtcttagtcgatgtgccatcccatttgtgctttgctaaaacttgtatcaatgtaaagcaaacattttctgatacaatttaggtagtgtattgtggtaatagagaccagtagtgttgaaaagatatgttgaggtcagaaattaagctcatgtttctaaaagaggagatatgtacaactactatgcaagccaacaggaaagagtgttttaagaatgctttctgctacaggtaactaaaaacctaaacagctgtggctttaaaataaaggtatatctaagtcacataagcaaaagtctaggggtgggcagctgctggcattgcttcagtagcttgataatggcaaaagcagcatctcttctatttccttggccttctaatcatgcatgtcacctcacaatcacaacataggcaacacctcatattctaagcaagatgaaaagggcaaagagtcatgccatatgcctctgtctcttttcataaggaagacaaagcttccctggaagtcccctctagcagatttcacttagatctcattggccagaactgagtcacatgcctgccttaaaccaatcactcaccaagaagactaacattatcatggcaagtctaaaccaactgtgactcatctctgaaatcaaaggattattaccattacccgaatccatcaggatcctgttggcagagaagtgggactgtaaattttgagcaggcaacaaacaagtcttctgtaaacttcttatgtgttgttttttatgtgttctatatatccagtagaatcacaatttccaataacagtctaaaaagatattttccaatagaaacagaatgtgtaagatcattacttatgaaatcccaaatgtacttaaggtttccttcttgaaaattccttattcaaaataaaatgtccagattttgaaacccagaaaagattctatattttaaaaatcctgtgcacatgtaaactgtttttcaaatattgccttcagatacattgaacagaatgaaatcttctgagatttactacatcagccaagtattatcaaaacaaacaggacagattgcttttcttgacgtctgctgcttgatttgtgttaactcatgtttctgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagcccatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaagcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaacctagtcacagcccggtgcagtagctcacgtctgtaatcccaacactttgggaggccaaggcaggagaactgcttgagctcaggcgttcaacatcagcctaggcaacatagtgagaccctctcatctctacaaaaagcaaaaaattagccagtgatgcatggctgtagtcccagctattctgagggctgaagttggaggattgcttgagcccaggaggtcaaggctgcagtgggcagtgatcatgccgctgcactctagcctggatgacagagcaagaacctgtctccaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttaaataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactagcagtttctgaaaatgcagtttcactgaaaatgcaggcatccagaaatttagtaagcaacttaaaagaaagtgtaagaatctcctatgtattcattgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcccggtaaattgcttcctaaccttctttggtaatagactattttttaataaaggtgatggatcatttcccattatacactcaaaatgtgtgtccatttcagggcagtcatggatgaccattgcccatcttttgaccccagattaagaacacctgctgtagtattttaattctgccttcaaatcctcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatgccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcctacctttctgttggtaattctgtttttaatcctgtgcttcagtgtagtttatataaatctttacagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgggttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaaatctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtca

SEQ ID NO: 2386 - DNA, 266474 bp, Homo sapiens
  source 1..266474: mol_type = genomic DNA
taagaaaaataactttgttattaagcatatacaatcataacaaaagtacatcatagtatcacatccataattgcttgaatgctaacttgactgttacatggacctgttacaaataatgaacaacagagctactccagtatatgactagtcactgtgaaataaaaacagacccacggcacacatgaaattcctaaggggacttgctttgatcccctggggagtaagagggtccttttctatgatttccctagagcagtaacgtttgttgagggagcatgtgaagttcatgattatatgccttaacaattacagtcatggtgtgttttgttttccaaatggaaaattatttttgacttgttgtgagatataaatattgactatgccaggaaaaaattcatctatttccctgaactcattattaataactttagatggctctattctacttgttgtttggcctggattcctccaataactttccttttcaggaaggttatttgacagatgttaagtctgcagaatgaggctgctgtggttgtttctggggcacaggctgagaagtggggagagagagtggggaatgacacccaaaatatgatgggggagttgctacctgaaaacctacagaaatgtctggcctggagaagccctcccttgcatacctgggaacagggctcaccaggcccacagcaattatgaaccttggaaagatggccaaagccagggtgctcttcgctggtatttggtggggtaatactcacctttccttccttccaaaaccaatgaacatttattatttacttgttgggctatgatactcctgagtttatacagtagaaatgacttcctttggtcaatgaatccaatggcagatgtcgggcattaactcagaaggtgagaaaaggcaccattctctctgcagccccactcacttttggcacagtatagcttataatttctccctctggaactgggaagggaggggggtttcctaaactaaaatgcatgccctccatgtactattttcttttttcgagacggagtctcactctgtagccaggctggagtgcagtggcgcaatcttggctcactgcaacctccacctcccgggttcaagcaattcttgtgtctcagcttcccgagtagctgagactacaggcgtgcaccaccacgcctggctaatttttttttttatttattttagtagagatggggtttcaccacgtgttggtcaggatggtcttgatctcctgacctcatgatgcgcccgcctcagcctcccaaagtgttgggattacaggcataaccactgtgcctggccccatgcactattttcaacagcatatttttattcccattgctttccaagaacagaggcaacttatgaggtcctgtgaagagggtgcaaaaaatcgaagtcaacatttctactaacaggttgaggaggtgtacaaagatctttttccctataaaacatgaaatgacctagaagcactgttacaaatcttaccccagaaatagctttcccattaggttttgagcagaagtcctgtttagacagtaaagctttttctatctagttaaaagatacattagaaataatgatgccttatgatgtcctatctttgaaaaatatgatttgggcataaaaagtacatatcagtcttgcagtagtccaagttttgaaaatctgaggattaaaaattattttctaaattaacttggtccagcagattgacattataaaatacaggttaccataagttttgctggagaatattatctggaatagtttcatgaaacccagacaatactactttccattaattcttttaatatattattctagcctatggccaaacatgcagtttggttgcattttatgagcatttcacaataaagatcatatttctaaatacagttcactgtcaaagaaaaggtattaaaattcttcttttaaaaaaaatcatagatggacctagccatctctcatacagcttgtgcatagttttgtgtgtttttttttaaacattcatccatccacaccctttaaataccatgctccacaagcaggcaaacattaaatatattccagatgggaatcaacagctgttcagttcctctctctataaacccgtggttggtgtggccctctgtcatgaatgttgaattttgcagagagaaggaggaaggaaagatgctagataaagagcaccccaccctaaaaagaaattttttctttttaaaaagtctcctttattcgaaaagaggcagactggttcctggggttactgcccttctaggggaaagtgccacatttaataaaacttatttttttttttttagggatggggtcttgctatgttgcccagactggccttgaactcctgggctcaagggatcctctcgctcactttttttaaagtgaaagtttgctttcactttaaaaatgttagtggagagtcaccaggaattttgcataaatgagacatagaggagcaaagtgttcatgaaagactcggtcacatgctgactgacatgagtcctgcatttccaacgtggtaggaagaagggaaggaagactgttgccactagaggtttgcaaagccccttcctaacattcttaaggaagaagactgaaaggtggcattcaaacacaacaaaagggatatttttttttttttgagacagagtctcgctctgtcgcccaggctggagtgcagtggcacgatctcggctcagcgcaagctccgcctcccaggttcacgccattctcctgcctcagcctcccgagcagctgggaccacaggcgcccaccaccacgcccgactaattttttgtgtttttagtagagacagggtttcactgtggtctcgatctcctgacctcgtgatccgcccgcctcggcctcccaaagtgctgggattacaggcatgagccaccaagcccggcctttttttttttttttttttttttttaatgagacagagtctccctctgttgcctaggctggagtgcagtagcgcaatctaggctccccccgcaggttaaagtaattctcctgcctcagcctcctgagtagctgggattacaggtgtgtgccaacacgcccagctaatttttgtatttttagtagagacagggtttcaccatgttggtcaggctggtctcgatctcctgaccttgtgatctccccgcctcagcctcccaaagtgctgggattagaggcgtgggctaccacacccggccaagagggattttctttaagcaagctttcacagtagtggagttaaatgatgtgggctaaaaggtggaggcaaaaaagccaaaaagaaatgggaaaggacatggcaggatgggaaattccaacatgagctaatatgagtgtgagaacgatcatttgcaggagagtgaaaatctcccgcaaaggtagataaagagccactttgtgtgtccagtgagaaagtggactgtgagtaacctataagctgctcattggaaacaagagggccctcaacaacgttacaaaggagcagatcatccttctggtctcttgctcctggtgcttctgaatccacagcaaaccttggcaggaacatgcttccctttgccacccagaggtgctctgagaaaacactctaactcactaggaggtggagatatagacctttttctgaactgcttctcacatgcaggggaaaataaatcaaagagaaggcctaaaagaactggaacttggactaaattaaagaaaattaagaaaaaatgagaataggaaggaagtttttgcaaacaaggaaaaccactatttttttttctccccatccaagataactttcaatagtgtattactctcaatatgttggtggcaagcttggttggctccagacaaaaacttgtaatacccaaggagaaaaaatttacctaccgctgctgatggcattagtgaggtcagcccaagccagcaacctccttgcagacttcagccccactgtatattggttcagcctggatcatggcacctaatggtaccttctgggcacctgctcagaaccaggaattctgcacctctctctaagctcagccagtttattgaacaaataatctatatttatagagcagactccactgttgattaaacagctttaaaatattatagcaaacgagagcccattgttttaatgtgaatccaggcatttcactttgtttttttgaaaagagagtttaatcttcttccctaaataggatacttacagataagcatggcatgaaaccttaagcaccgtatttgaattttagaatgtggcaatctatataacagtaaatatatgactgtgattcttttctatcttctctaaacgccattcaattctctcctctctttaattgaatttgggaaacaaggtttgacaaagggatacaatatttaaagtctactagaagcacaaggaaaaaattctccaccaaagcacatcgacacgtttgtcctccccacccctttttaactgaagagccccaattttgatactagaggagttatggtctattgtgaacacacatcttagaagtagcctcacattttcttagagctcactttgtcattttcccccttttgatactctgccaaatttaacttcaagaatttatgatttaagacactgtgagagtacttaaatccaaagttcctggaaaaataggatgtaaaagaaaagttacaatgcaaaccaccccaatggactcttagtgagaagcaggtaaatcaatcattcactccctcatgtctgcaggcctaggaggggactctgaaaatagcatcgtatttggaagaagaggagtggagagacgtcaggagaagagaagagaaaaatgtatgttttctaggtctccagtggtctttcttctctttagatggtttaactgcaggtgagttgatctttctcttcctttggcgtgacggtgttgggatgtgctatgggtagaagtctctgggggctctcaagtctcttgtctcagttcttcttggatggtcatctccagagcccaggtccatggcttctgggtagctgggaaattcctgaggtaaagggaactcctctgctgaagagtgagtccggtgcccgaacaccttttcctgcagctcagtgatgtcattgcggatgtcagccagcataagtagcaggaagtcgaaagaaccagggggtccctgtgtacatgggaggaatcaaagctagaatacgacagacagcaatggcctccggggctccatgacttgacctgctgcttgctggcaactactttctcaataactctgtgccccaaatggagccaatgtgaggactgctacaggagcctgggggtcctccatattgttttctaattctgtcacttctcagctgagctttggtgatgtattcacctttcctccctcctaacgctttatcaaatccagtagaggaaaggatataagaataactctcctaggttactttccaaagcagtctggaagatgcttatgaaggcagcagagcagtggttaagagactggggttctgttggatttgaatctcatctctgccgcttactagctgtgtcatcttaatttcttgtggttcagtttccccatctgtaaaacggggataataatagtcccaacttcatagggttttgtaggattcataagtgaggatttaagcaagtaaatacgtgtaaagggctttgagcataatacgtattcaaaaatgttatctgggccaggtgtggtggctcacgcctataatcctagcactttgggaggccgaggtggatggatagcttgagcccaggagttcaagaccaacctggaaaacatggtgaaaccctgtctctacaaaaatttaacaaaaatttagccaggtgtggtggtgggcacctgtggacccagctacttgggaggctaaggtgggaggatcacttgagcccaagaggtcgaggctgcagtgagccaagattgtgccactgcactccagcctgggtgacagagtgagaccctgtctcaaaaaaaacaatgctgttattttttaaaagcaaaattattaaaatgtttataagatggctgactataagcacaaactaaatgaagttgagaggatgttgtaaagacgtcaactcctcgttgactaggaaaggtccaaacaaaatcttcctaatttttctatgtattgagtatcctttatcatcatatagtatttactaagccttaatttcatatagcgctgtgtggggcatggtaaaaaagaaatgcacaaacacgcatgttctgggcttgtcagaagcttgtagtaaaatcgttatcatctcccgcaactgctgctacagcagcgggcaccgtggaagcagagcttacaccgtaaagcactaagagaggcacagtattttcatatcatttgaccctcacagtagccacttcagggatggcaggtcagattccactatcgccactgcacagtggggggcaagaatgcccagagaccctcagtgaagtgcccgtggtcagaaagccagcaggtagaagagttgagatgggaacccacgactcctacctctgtggccacagccgctggatttcagaaatgatacttcttcagaagcagtgacgtggtttgaattttctatgcttttgaatactactatttctcatttttaatctcccagatactatgcttatatgcagctaatttcttctcaggtcctaaacagccctgcgtggttttgcactttttaagaggagatggccatctggcctgctagggttgcagcagtggctaaattctcaagtacgcagagttatgatttaaacccatagatttccttcctagacctttcaaatgttttatgataatacttggaaacagactcatggcatagcagggttttgagctttaggaaagacatttcaaataaagattagccatgataaaagagaaaacagcaacagaaaacaaatttgaaaaataaatccaaactagcagctaagggcttctatgactctcttcctaaccacagagttctgttcaggtgggctgagtggcatcaggaaggggcgggcttttgctactagaccaacctataggctcatcagagctgcatccctgagaacgttcccctggggaagcaggacacagagtgctacttactggagaccctctgggcccaggcgctcctctctccccctaaaaacagaaaggccagggttagctttctagagcacatggatatcacaagaatagtctctatttatacacccaccataaccacttccctgcacaaaacaataaacattttctatagaaaacatatgtaaaactgagctggactcacgggaccacttatttgaacaggactgcttgggtcaagtgtctctcattctgatttccctcaagcccatctattttcaaaccttcttggcaagaggaatgttcatatttcccaacagcatgtggagtaacaaactttctgaagtaactcacactgacttctttgtgaggcaaaaaagagcaggcagctctcagaggggaaccaccctgcttgcaaaaagaatggagcatctcctgttcctgagaaatctcacagaaatggaaacacacaaaaagctatcccgtaaagcaacactggttaaagagaaaaacacatgtgagaatcacaacacagaggctcatttaaaatttacaggggtcacttttcctatgagtggttgtggtggttgtttttgtctttggggttggttttggaattgaagacaatggcttttcagattttgttcccagctttggggaaaaagttctatctggtatctgtgtctcacttctgctgcatgcaaaatggggttggtaaacagtgtctggtgagctttcctggatgtcagtgcaagaggtagaaagtgagagaccttcaggccgggagcggtgcctcacacctgtaataccagcactttgggaggctgagacgggcagatcacctggggtcaggagtttaaggccagcctgggtaacatggcgaaaccccgtctctactaaaaaatccaaaaattaggccgggtgtggtggctcacgcctgtaatcccagcacttggggaggccgaggtgggcggatcacgaagtcaggagatggagaccatcctggctaacacgatgaaaccctgtctctactgaaaatacaaaaaaattagccaggtgtggtggcggtcgcctgtagtcccagctactcgggaggctgaggcaggagaatggcgtgaactcgggaggtggagcttgccgtgagctgagatcgtgccactgcactccagcctgggtgacagagtgagactctgtctcaaaaagaaaaaaaaagaaaaatccaaaaattagccgggagtggtggtgcacacctgtggtcccagctgcttgggaggctgaggcgggagaattgggcttgagccagagaggcagaggctgtaatgagccaagattgtgccattgcactccagcctgggtgacagagcaagaccatctcaaaaaacaaaaacaaaacaaaacaaaaaaatcgaaagtgagagacctttagcttgtgaggaccactcataaggcttaccttagaaccatctcttcctggtgcccctggtggaccctgtaatacaaaaggatctggtttaaccacaggcaaaagcatgggacaaaaacacattttcccccaaaaaggaagtggatctctgataagatactgaccacagggcccctccggccttgcttaatgtgggacagatcaggagatggtcccatgggtcccattgagccccgtgggccgggctgcccaggagggcctggcataccggggaagcctgggcttccctttggtcctggtgagcctgtaatcaaagaacacctcattagctcacagcacatgagaaggacaaagggccctggctaacaagagtccaggacccctgcagccatttctctttgtactctctctgcctttgccttctgacatctccatcaggctgtcccacaggcattttaaacttgatacgatcaaaagcggcttccccatcttcctctcttttcgcggactgccagtcatacatccactcaagccaaaaactggagagtcttcctctatatttccctgtttctgcaacctcctttttgaatcagtggccagctcctgtgcattttacctctttaacatctcacagctgtctgctcccttctatccactggatcacagcagagtagtggccaccaccacagagaagtggtgatcatggctggagagcagtacaggttttagcatcagggagacttgggtttgaatctgacaagttgcctgagccatctgagctttagtttctcatctcatctgtaaaagtgggctaataaaaatcttccttatggagtagttgcattacatgagatttcagatatatacacagcacttagtatagtacttcacacatagtaagtactaaaacatctgctaggccttccttatatttgctttgactcttgcctcattgctagtctttctgccccgaaccagtcttttcaccccttgcccatttttgatatttctatagggatgacacatctaaaacaagtcttactatgtaacccacctactttcaaccttctggtgcaaatgtctcaaggcactcggtgggtcagcaaactcactctctcttgcaggccccagagaaatatcccttacttcttagtgaggggtaggaaatgttcttctggctaagatttgccacaggtacaaggcatgctgggggatgagttgggggatatggggaagatcatctcaccccaaggcccagaagcataggtcatgcttaggattgcagctggagcaggagaactgaaaatgtcccgttgccccacaactctagcatggagtaagtaatagcaatctacagtgtggggagagaacccctctgtggcacaggtgtgtgtgtaggggctgctgaaagctcagagtataaacactgagaaaaatccactggtaacctaggcctccactaagcataaggtaacagcatccttccattggaggaattatttgaagactgtggaacacaaagtaaatatagtgacaataaagccaaaacccagctcagttattcattaggttgacttagcttcccatggcagtggcctgacaaaagaagagagtacccatctccaggagtgataaccatgtgcctcagtctctactgtttctctgcaaatgatgtctggcattcaatccaaaattttcagacatggaaagaaaagggctgggcacagtggctcatgcctgtaatcccagcactttgggaggttgaggcgggtggatcacctgaggtcaggagttcgagatcagcctgggcaacatggtgaaaccccatctctactaaaaatacaaaaattagtcaggtgtggtggtgggtacctgtaatcccagctactcaggaggctgaagcggcggttgcagtgagctgagattgtaccactgcagtccagcctgggtgacaaagcgagactccatctcaaaaaaaaaaaaaaaatcaaaacaaaaaaacacattgtcaagtaatagaacaatcagcaggacaagcctcagaggggacccagatgttggaataatgagatatgggctttaaaataacagcatgtgaacggtgctgttggaaaagataaacagtgtgtctgagcagatgagggatttcagcagagagatggaaattaaaggaaaaagtcaaatggaaatgaaaaatataatatcatgtatgaaaacaatataggctcatcaacagactgctcccagctgagcaaagaatcagtgaacttaaagataagtcaacagttactcaaagtgaatcacaaagaggaagataaaatgaagcatccaaaagaggtgagataatatcgaaccatctaacataagtgtaattggagtccaaggagaaaaagaaaaccctacagtggctcccctctgcatagagaataaagctctaactcctcagcatagtatccttgttcattcttgtctttcttgccaagcattttttccatgattgcctccttcctaattgccccatagtcccatcctccctgaataaaccataccatagcacacaatccagctcacactattctttctgtcttgtctccatcaccacagatcacctatctccaaaaacattttaacatctcccccgtcgtaccaacaactatcatcagacaggcacaaaaacagatgacttgttaaactcggtatagtctcagtgctgtgtcgatacaggcttctgaaagttaaactcggtatagtctcagtgctgtgtcgatacgggcttctgaaagtaagaattaactgctttcttcattgtacatgcttgcagtatatctatagtataatgtgtgtgtttatatgcattcatgcactgtacatgtatgtgttttctgtttatgtgtatcattttcttccgagcattcttaacatttaaaaattggggccaggtgcggtggctcatgcctgtaatcccagcactttgagaggctgaggtgggcagatcacttgaggtcaggagtttgagaccagcgtggccaacacagtgaaaccccatctctactaaaaatacaaaaattagctggacttgatggcaagcgcctataatcctagctgcttgggagactgaggcaggagaatctcctgaacctgggaggcagagattgcagtgagccgagatcatgccactgctttccagcctaggcaacagaatgagactccatctcaaaaataaataaataaataaaaataaaaattgggagatttcatataaaaatctgggttcctgactctggtttgaaataggaagcacaaaaaccacaattccatcatcagcacaaccaactggagttctcagtaggggctgcccctttacatggggtgagtgctctctggtttggttcagttcccttgtttctaactgctcccctgcccagctcccttctatgtatctatgtgacctgcccatctctgtagaggttgaggggttgtgttttgttttgtttttttaattcttttcagaggcctgtatcgacacagctctgagaccataccgagtttaacaagtcatctgctcttgtgtctgataatggttgtttgcatgtgtgccagaatacggcataccaccttatcatggaagctgatggggaagagacctttaggcatcatctatcttgacccacaacacagagagttgtaaacagccgctttgtattgggttgggttagcggcgcttccccacttgtgtgtggaacacagcatttctgcccacaccggggactctagcggacaccttgctggctcaagggccacagctgtgtctgtggggcagcacctgggtacagacatcagcatgttcacctctgctttaggccttgaacatcagctggggggatgagggaagagagagtgggggcctgacaagcatttttaaaaacttgtgataaaaaatccacaaaatttgccaactttttttttttttttgagatggagtcttgctctgtcacctaggctggagtgcagtggtgcaatctcgtctcactgcaacctccgcttcccaggttcaagcaattctcccgcctcaacctcccaagtagatgggattacaggtgcccaccaccacccccggctaatttttttgtattttcagtagagatggggtttcaccatgttggccaggctagtcttgaactcctgacctcaagtgatctgcctacctcagcctccccaaagtgctgggattacaggtgtgagccacggcccccagcccatcttaactattttttaaatgtagtgtttagtaatgctaagtatattcccattgttgtgcaacagatctctataactttctcatcctgtaaaacagaaactctagaccaccgaataactccccattttccactctgctcagcccctgataacaaccagtctactttctgtttctatgagtttaattattttagataccttatataagtgttaattatatagtgtgtcattttttgactagcttatttcacttagcctaatatccttaagattcatctatattgttccgtgtcaaaatttccatctttttaaaggctgaataatattccattgtaagtgtatgtcacattttgtttttccattcttatccattgatggacacctgggttatatccattgatggacacttgggttgcttccacctcttggctattgtgaaaagtgctgctatgaagatgcgtgtgtgagtatctcttcaagatcctgcttttaattctttggggtatattcccaggagtggcatttctggatctcattcatatatatacattttttttagttagggtctctgttgcctaggctggcctcgaactcctgagcccatgtgatcctcctgcttaagcctcctgatatgtttaattttttgaggaatctccacactcttttccacagtgactgaaccattttacattcacaccaacagtgcccagggttccaatttttccatatccttgtcaatacttattttctcggtggtttttttttgagagggggtcttgctctgtcacacaggctggaatgcagtgttgttttcatggctcactgtagcctcgacctcctgggcttaagcgatcttctacccctcagcctcctgagtagctgggactatagcctggctagtttaaattttctcttatacagacagggtctccctatgtttcccaagcttgtattttttcaaaaatagtggccatcctaatgggtgtgggatggcatctcactgtagttttggtttgcaatgctctaatgatcagtgatgttgagtatcttttaatatggtttttggccatttgtatgtcttctttggagaaatgtctattcaagtccttttcccatctttttaatcaggtgcttttttgttgaatattgaagttcttatatatcctagatattaaccccttatcagatatatgacttacaattattttcttccatcctgtaggttgtttttgccctgttgattgtttgatttgagacacagaaatttaagtttgatgtagtcccattcatctactgcttttgctgcctatgcttttgggggtcatatccaagaactcatcaccaaatccaatgtcatgaagctttcctctatgttttcttctaggattttcatagttttggggtcttacatttcactctttaatccattttgagttaatttttgcagatggtgtaaggtaagggtccaacctcattcttctgcatgcagaaggacattgtgttttaacccattttagataatcagctctgtgagagcttgaattgtgtcttatttattagcatatcctcagatagtcctggatacatagtgggctgcttagtaaatgttttttactaagtgattgcattgaagagactgagaagattgttatactatacttgtctcataattgttcttttaaatgcacatagtaattgctttttgatcatacctaacccctagtactgacagagcagtgacaagatggaatgacagtcagactccagcaaataaaacaaagaaacggagactttaaacttttcacatttagataagtcttttttagttcacagaataattacgccaaagttaaaagcagtcgatgttccatccaaacatgtctcacacccctactcttaatactggttccaggtatatctacaatgagtttgggaagggtgccagatccctccttttactaaatattttacctccagtagcacaaaaaagaggccagagataatatctcacccacatttacacaatcagtacactacagagatcacagtatgtcaagtgcctttgaaatgtgggactttaatgtacaaacggcagcaccttacgtatgacagtggaggccagaaagcagcagccgcccccttaccaccaaagctaagcagattccaacccagagtagtttcctgtattggtgctccagtctgattcaccacaggcctcggaactggacttttatttaagggtgagagaaagcctattagctttctagcttccctaataagtctcagtggtgggtaccacaaacactagaagttaagagagagaaggaaatgggtttggaatgtccccattcaaaggccgggtctgttgcaaaagcttattcatcctcaatcattctctgctccatcaaggaccctggacagctcaaaccatgttacaagccagatggcagcattggagaagaaagcttgcaaggcatttattaagcaagacagccaatgactcccctgctcctacagttggttttgttctagtgatctatagcctggagttgacttcctccagagaagcaaagcaagagcattctcttagaggagggtggagagcactatgctaggaagcagtttataaggagagaccccagtctgtttagaagcagccagagggtgcctgtgtgaagtgtttgctggtgaaaactccaccatgacccggagtacctcaggccaagggaatgaacgaggataagccaaatcctgaatcgtcttattctctggatggacggagactcaggcttgtgtttgaagagtttaagacataagtggagagaaaacacacaaatcctccgtgaagaactctgagcttttgttcttgctgactttccaaccgaaaacccacctgtgtccttcctccttgggcaaattctaccagtctgccatgtccagatcaaacctaaatgccgctgaccactgcagactacagtgctcgctcccttcaagctcccacagcaggaagcatctgtgcacttacctggagggcatgtgggtactgttttattctatttgcatatgctctatgtgtctggtcttcccaattaggatgtcaagaggtcattcataatgcctagcacactgctaagcaatgatagccagggataaggcactcaaaggtttagaatcatttgctaacactaaagtcatttcccttaccagtgtggagaaaaaagtctattgctctatacctccataagtactaaaaatataaaataacttggaactatttttttttaagttctcattgtatatttcctgatgaaatgataggatgttcgggattttcatccaattaataagggtgaatattcagaaacagtatactgaatgaaagaagctgaaagtacacattcacaagaatttctttatacacacatatatatacacacatacgtatatatgtgtgtgtatatatgtgtataaagattctagtcatatggagttctagaacaggtaaaactacagtgaaagaaagcaggtcagtgtctgcctagactgggagttggggaagtggacatgtgcacatggacagaagggaaatttctggggtgatagaaatgttctatatcttgaaatataggatgggagttacatgggtaaatacatctgtcaaaatttgaatggtaatttaaatgagtacattacatgtcatttgtatgtcaatacagttgacttgtaaaaacatatagctaggtataaaaataaatataggtataaatatgcgaacaaataaggaaaggtggaaggaagactggggagcagtaggaagaggctggctctgagttgttagaattgggtgaggagccccaagcagggggggttcataatactgttccatttttgtatatgttaaaatttttccagaaaaaggtttaagatagttttcatttggtttttttaacttaaaatgatctttaggaatcttatccaatcccaggacaatgagctttttctcccacattgctattggctatgagggtttctcaggcttgagggcctatttcccaggctctctcattgcatgggtgtgtggcagtcccatggacacctgccttgtttctcctcgatggaagctggagaacattgtccaggccccagcaaatgtgagcttttggcaggctttttctgttggtgatcaccctcctgtgccctcttccacactcaccgggagggccctggcccccaggcaggccaggaggtcctggaaggtaggtgtttgaggccagcaccttgtcaccagtgatatacttgcccaggtcagctgcattgttggggagcagagcaatctgcaaggagaagaggaagcctcagtcaggaagcaatggcagaagagagcctcggcatttgtcttggtgggagaagctgcaaagccttttcatgagacatatgtatatactttttactagagctagttagagctcagagaaactataaagagcctctttctaaacctagaggcattctagggcaaataacttgtatgacattactcagctagttagtaggtgagcttaaataagctccagatggcctagatatcactagaactcattattaccataattaatgggatctacttatttcatactctcaatttttcaatgacctattttatgtctcaaacatttattgaacacctactatgtgcaggtcctggcttggttctgtggctacagtggtgaccaagacatggttcctgcccttaaagaactctcagccttgggagttaggaccgagaacatggctgacggttccccagcacactcagggctgaccttcagtacaactgggcaatcgtgactgtggtggttgtaaaatgtgtccacaaattctttgacactttgtgatcacgggagtcaattctccttaataaactccctttcatatacacatgtatcccattagttctgtctctctagagatctctaatacaattcccctgtgattgttactcagaattcagtagggatgactgtaagaatcaaaatcttgtgcaatctgaaagccagctttgtacaacttcaagtcagggctcatgattcagagtcaccactgtgtgcctgggatatatttaaaatggtgctgacatcactgtgtcatagcaatagaccaccacaacctgcaggtgggtacctgtggccctggggaggaaaggagtgaacctcttccctcagtgagtgagggaaatgtatcagtaaatctactgcaaccatgaggcagtgggtcaacactggcagctgaagcctgatccaattttatcatctgcttccaactaagaaactgaaatgtgggtcccactcttgggccttggaataaggcagacttacctttaaatctgagccctgccactttctacctgtgggatcttgggtaagctacacaacctggatttcctcatctataaaatggggatggtaacggccacctagaggcactgctggagggttaaagtgatgttgtctttaacgtgcctgactcagtgtccagccattgtcatagaccagcagaaatgctgtctgggggcctgggcactgtggctcatgtctctaatcccagcaatttgggaggccaaggcaggtggatcacttgaggtcaagagttcgagaccagcctggccaacatggtggaacactatctccactaaaaatacaaaaattagctaggcatggtggtgcacgcctgtagtcccggctacttgggaggctaaggcaggagaactgcttggacccaggaagtggaggttgcagtgagccgagatcgcaccactgcactccactccagcctgggcaacagagtgagactctgtccaaaaaaaaaaaaaaaagaaatgctgtctgggggctgctcctgactttgttcctaagtagctgtgtgactttggtaagtcccttcatccttccaagtctacaaaatgtgcagtttcaacacatgatcaagtcttcgtatttaaaattttgtaaacagaacctcaggatgaggcctgcacacagatgggctccagagatgctcccctattccccccagtcctctttgcttgatttggcctcttgaaaaagtgacgaggtaaggtggcaaatgttgacctcagtgtcccggctgacctcctgctgggtggctgcatcctggttcccttcagcccctctgtgtggcagcaggagtgcagaatgaaggcactggcactttagaggcggctgtccagaatctctggccccactttctgcataaacacagcagacgatgggctgtgggatgccaggagtttgggaggaaggttgtagtaatgtaaaaagagtctgcatttctcccagattccagtcaatggaattatgcgtatcatttatctcatattagcctttgtgagagagcttttgcctcaaagagctgttgggatgaatccgtgagatgcatcttgaaggtactttgtaaagagtgctaataaataatatttttacttgctaaacatttgtagagctctttctagatggatggcgctgttctcagtcctttgtaaatattcacatttgattatcataaaatccttaggcagtaggtattaatgttgtcgttttttaaaagtagaactgaggcacagagaggttaggtaacttaccgagagtcacacagccagcagacggtgggtctagaatttaaacttagccagtctgcttccagaatctgtgctcctaaccattaaaccaagcggcaacctacagtcactttttaaattttgttttgagacagaatctcactctatcacccaggctggagtgcagtggtgcaatctcagttcactacaacctctgcctcccaggttcaagtgattctcctgcctcagcctcccgagtagatggagattacaggctcccgccaccacacccaactaatttttctaattttagtagagatggggtttcactatgttggccagactggtctgtatctcttgacctcaagtgatccgcccgccttggcttcccaaagtactgggattacaggcatgagccactgcgcccggcctacagtcagtttaatatggattcccaataatcctgggaagacccattttatagagtagcagaggaaaccacacattattgagaagccatataaccacctgaggcaaaggtgatgctagaccgagcaggtgcagccatcgggttgcaaatgtactcacttgaaatcctaggggcctctaaattctcaggcctgactgttggccccacttcatttggccattgtttgctgatttaacaccgttggcatggtttccccataagacagtaagtttatttcaggcagaatcctctccgtagtgttttgtatttccccatttcccagcccacagtaggtgctcaacgagcacttcctgaatgattatccacacttccctcaactgctcaacgtggggagagtcgctggtttaagagtagagagagaaattctcaactccccaggcagccaccgagggaggccaagcacaccagtcaacccaggacaggctgagtgcaggcttgagtgccagccctctccttctggagtctcccttcccagggaactctctgcagcaatttcactctcaaatccgatagtccctgctgccagaacacaagcaacttaaaaaaaaaaaaaaaaaaaaaaggacaggagagttggctctgaattttaagtgctctcgcgggacagagacccatctaaaagttaaatgacaggcatcgaatctatccccacactctccctttctcaccacatcacttgttttcttcccacaccacagaagaagtggtggaggtggaggcactgaggtctatacaccatttaaaaacatgtttttattgcaaaataaagcaaagaacctggaaacttcacaacacaaatatataacttagcaaattgttataaagcaagcacctcttcagttgcagcaaaccaccatggcacacatttacctgtgtaacaaacccgcccatcctgcatatgtaccccagaaattaaaaataaaaaaagtaagcacccttttaaagaactcccaaatcaatccaacagaactttgccagccaccccagaccccctccttccacgtgccccatcccaatcagtctcctctcttccccaacaagtcaccactttcctttcatagtaataacttcctatgttttaaaaaataatgtattacccacctgtgcatgcctagatattatggtttagtgttgctcatttaaaaagtgataggtcctttaagtttcctgttgcctgcagactgccggaacccagggcatttgacctgtcgtgtttcccatggttggaatgttgccgactggatgtttgtggtgtggttcaaggtgtttaaacaccgtttcatgctgtggggttggccatggtctaggactgctagcatctccttcttggctaatgtttatttgggcagatgtcctatgttcttttgtgaacaaatggcattagcagcagcaagacgacattaaaaaacaactgacaggccaggcacagtggctcatgcctgtaatcccaggcctttgggaggccgaggcgggtggatgatgaggtcaggagttcaagaccatcctggccaacatagagaaaccctgtctccactaaaaatacaaaaaaaattagcgtggcatggtggtaggcacctgtaatcccagctacccgggaggctgaggcagagaattgcttgaacctgggaggcagaggttgcagtgagcagagatcacaccactgcactccagcctgggcgacagagcgagacttcatctcaaaacaaaacaaaaacaacaaaaccaacggacagttcaaacactggcacaggagtagaaatgagaggacctaggttttaggcctgccctctcggacggttattgcacctctctaagaccatcagtatcttttccacggggtcatggtgctaattaaatgtgattctggatataacgctttctgggctgtggaatgcaagacattctaataggaacctttagaaataaattgctcctcataacattccttgaaagtctacattagcttgggattgccacaatgcatttgcagaaagattttggtataaggtagaacgatgctagtccaactcaattgcataagagttactggagtattaagatgacctcgtggatttttatgtagctctccagcagggtctttgagggtgacaagtatttcaatgcaagtttctccacttctttatttttatacatcacaaaaaaacatggcaaggagattaagggaaaaccacactttgatttagcaactgaatttctgaatgacttgcgctatttagccccctgttcctaaagatcatcctggctggaaataaattccctaaggcacacagattacttccagggaaggaaagtgagggtagctttatgccttgagaggtacatctggagatattgatcgactgcctaacccaagcccttctggcttatgaaatgcaaacttacttcttcctcgaacccttctctgggtttgttcaatacaactaacatcaacctaagctcaagctggggatatctgtgttggatgtatttatttatgtctctgtgtttatagtgatagacaaggttttctgcctagtcttcctattaggatcataagctatttagggttaaatctatgttttattcataactatccatcagatatatacatgtttctgttaagcagatcacgtcatcagagtcgtaaaaaaggcctgcaaaccatttctcttctcagcctgttgatctactgaactggtagctgtggttttcattaggggctggctgcatgtttgttgaacatgggaaagagataccatctcaggcttactctcaagccctttagaatcactggatgccaaagttcaacagggaagatacacctctctgatgtgctaagagccttgactggaagccgttaaacaaacaaaacaagaagatgttttatcagtttaagggtgatttctgagtccctgacaaactagcgaattgagcaatcttaggtagaataaatactgtttatctgggtccaggacagttgttcaagaagtcagattgccagacccatcccggggcattactcacagcagaacggtgttactagaaatctgctataccgtcaggcattcggacagccttttataaagtgcattagtcctcatccttggtgacacaaagtacccacagggctgcttttctaggtgcaggaaactcagaaagggcatagactataattttcaaaagtgaaaaagaaagctgctgcacaagttcctcaccagcttatggcagtttatagagacaatattctctataaataatgtacagatcttagataaaatagaattacttaggcacatgtattccctaaggcacatagattatttccataatctatggactttccgatggcatgcctagaaatttgttttgagttggagtttcactcttgttgcccaggctggagtgcaatggagtggtcccagctcactgcaacctctgcctcccaggttcaagcaattctcctgcctcagcctgccaagtagctgggattacaggtgcccaccaccacacccagctaatttttgtattttttagtagagatggggtttaaccatgttagctaggctggtcttgaactcctgacctcaggtgatccacctgcctcagcctcccaaagtgctaggattacaggcgtgagtcaccgcacccggctggaaatttattttatgagaagttgcaatagccgtagctcaccctatctatggctttgccacgtgtcccttacctagtgtccattttaataattgcctctgcaatcccttgccatcattgtgtcctgatgccccttggatggctctgagggtgggcaaaacatcccaagtccatgcaaacctcactggcatcaactgcgtgaatgctcaatgtggatattttcttatttgtaaatatccttccacctggccttggccaagccctccttccatcaggcatcatcgttcccaccccagcggcacgtaccttttgcttcagctgcagcacggtctgcttcatctggtagaactccttgcatgtggcacagcaagttccggctttcaccatgttctcagacttctcatggcctgagaaaggagataggctcagtcctgtctgggaggctggatgcaagccagacccagagagacagcatcgggaagggcggtcccagggacagagtagctgacagcgggacatgcgagggctcaactgtgggtgattttacagctctcaggtcctgccagcatgccccagggtcagggaagaggggaggacagagggagaggggccctgctagaagctgggctcagctgttcctatttagacatgccaggaagaccctgatcttcctttcatgtgtgaaaatgcgtaccatggccttttatcagtgcttttccagaaggcaggctctataaatctgacatgatttatactccccttaaagggctaatgttcacacactgtaaatattccccaagtgcaggcactgggcctcaaagctgcctttatcacctctgctaatccagttcttcaaagggagcacagcagtgggccgggagctgacctcaccgacgcgtgaggccaggatgggaaatgccccagacacttcgccactccatctggggccattcaggacagcactggaaacgcagtcgggcccaaccactgcaaagggtcccaaagccctgctgtagaacactaggtgctccatgggctttttgtaaaaacattctttgctaaaggaaaactgggtgaagtaaatggtgatctggccaagaatacagacagctctcttcttcctggcactggaatggcctacttaagcctgcatgctggggagaccagccacctgggtcaccttgctgctgaggaccttgcacagactgccaaggtctgtgccaaaggtggcagcagtgtgggctgaaagtgctaggttgagggtgttttgttcaggcaggcaggacagtttgacacccagggaagcataaactctcttcgcttagcagccctttggcgttgggccaggtttgctctttgtgtgacataataaccacgactatctagaacgcagactggggaagtcgggtaatgcgtgaccatctcttgttcttcctggcccgtatactttgcttcttactgttcctctcttctgcaaagccctctgttccatctccacttgttgaatcccaccaagatgcacatcaaatgttccatgaagcctgctctctacccacggaagtctgaaaatcaggcagcatttaccgtgtgtccctcccactcacaggctggtcttctaggcctccctggagagcatctcttagggcgcatgccaccaggtaagctgcctaagaaccaggctcacttcttggtatctcacgtaatggatgctcgaaaaatctttgggaaatggatcgttacaggttgaattgtgtcctgattcccagtgctttagaatgtgactttatttggaaacaggatcacttcaaataaaatcagttaagatgaagttatactggagtaagatgggatcctagtccaatatgatgggtgtctttatacaaaggggaaacttgcgcacaggaagaatgctatgtgaagatgaaggcagaggtgagaggcagtggaagccaaggaacaccaaaaattgcccgctgatgaccagatgctggggaaaggcacggaatggattgtcctgcatagctgttagaagaaaccaaccctgctgacatctcagacttctaacctcagaccagaaacaaatttctgtttcagccacttaatttgtggcattttgctatggcaaccctaggaaacagacacttgaatggatggagggagagatgggcatgagggcagcccacatgcaggcaaaacttccttacacagcccgactgcccagtcctcttcctggtgacatatgcagtgaccagggcttctgccctttgggaggtgagcaggcccagaggcagcctggtagctgagctctcagactgtgcaccttcagcacagcagcaggaagtttcagagcttacctgctgcaccaccatccctgcaccatgggagacctggggttggcagcacccgagctaggtacacatttctcaagccagcaggttgacacaaatgatgccatgctgtgtagttgcgtttccacaagtgacagtgtaattgttgaatatacagggtcaacatagctctttaggcaggttttgaatgtgtcatcggagaaaaacacttgaacctctgcaaaagtggcagtttttaaaaatccactttatgtgtaaccaacataacagggccatcttgttaatgcctgctttctaggcgaattcccgtagcttcctcacctgtactcccttcaattggtgcactggagggatggttttgactcactgcagctgtgtgataacgagctgagcagtaagggggaatagggaagggcttgtatcagagatggtagagtgaactgattaccagcacaaacttgagtcccactgttctgggtgcaggtcccatctctgtcactgaataggctcagcgaccttgggcaggttacttggcctccacaaaccccacttgcctcgaccacagccctggaattacaattcccaccacatgtggctgctgtgatgactgggcaaggtaatgcacggaaagctctcagcacacagcttggttgtaggtagatgggaggcgatgcccagcagttttcaggcccaccaaaccccttaaatttcctttgcctgataatcccagaaccctagaataacaggatgaacatgaataacaaaatgagggaactgaggtctggcgacttcctgaaggtcacctagcaagtatctgaggtgggtttagaatggagttgtcctgaaattaagtccaataccttttccacaaatcagatggtttcctttgggttttttacccctgttcaatgtaccaatttataatcctatggagcttgaatactcctgagaaccagaattatttagctcaatctccaacagactaaggcaggcaaatttccatgcaataatatacttagttgtaaagggctgacgccttaactttggttgtgctgactgcaggaaatggtgggctcctgcatgaaaagatgacccaggctccaggtttattatgttaatacctaaggacagatgaatgacatccatctttcccaactagtctttcatccactccatctcatctactggtcaatttacagaataccatcatcaatctagtctgtccatcaatccatccatccatccatccatccatctatccatccatccaaccatccatccatccttccatccatcttcccatccattccatcttcctaaccacttatcaataagtctgtccatccatccaacctttccttcctcttatccatctatggagcatctgctgttagccaggtcctgtgtcaggcactgagaatgcaaagtaagtgaggatatctgtttaacaattttcaattcacctttaagaatctagccctgttggcagagcggggccgccatgaacaaaagttaaaagctcatgtttctgtccacttttacttttacatactcagttaaattttccaagtgttaatgtgattaaccaattcaacagcttcatgataagataaacctctttaccagattctcgactatttcatttagatcatggaatgttagaacgtatctttagttcaatctcttttgtagatgacagtgagatccagagagagacagtaacttgccttaggtctttcagattgctgtgcgaagagaccacgaactcaactgggtcccagctggccgttttggaggagtgggtgcacgcagtgagcctgctattgggaattctgttgagaacacctgagagctatctgtcggccaggctccagggcagaagctctgcggagtgacctgttacatgcaaattcctgggctgttttctgttcctttgtggaactgtcagaacacagtgaaccaagattaacattatccagaagacttgaagctcctctgacgcagaagtacacagcatggtagtaaggagagtaggcgctggtggagttacatgatcagaacttgaatactgatgctgctaactagtaccttttaaattggacaagtcatggtttctgtgaatgcccattctttgaacggtaaaaaggtaacagcacctatcacttggagctgctacgaggagccagtgataagatatgtaggttcccagaacagtgcccagcttatgttaagagctctattcacagtactcatttttatgttatttattgtcggtattactatgattcagttctctacaaaatcagatatgtggggttgggaccttacatcaccttttcaatacagctctcaagggtttaaagataaacaaggactcataccttttgtatatgtagacctggaacataaaacctactctgatgacgggttcacatccaccttgtaatttgtctacaataatgtcaacatggagctacaaataatctcacatatgctacattaacagtttacttagaaattggggtagatgtcgctgcatgttttcaatcctctcaactaatgctgtggtcacacttctgggaaaagcctaggatggtatcacttaacattttttcttcaacttgttcagattttaaaggtgcaatattattgattagccacatgggggcatgaagctctaatttttcctgaagttgaccaggacgtctatcctaagcattagaagttgtaatgccttagatatcttagaaaaaccaaacaatgttcctgaaatattttatatgggcagtgttagaaatgaacaaagcatgtttgtgtttaaaagttgatcgtgcagatttgtgttctggctgtaatatccaaccccggaggcacattacaatcacctggagggcttttaaaatatgaattctgctgcacaccacccgtctggggatggcaaggcaacagtatcagcatttttaaaaaagctccccaggtaattgcaaggttgagaaccgctgatctatggattagtggagcttgaaagtaatatgaaacacctggccatctgacactgacctgtaataagtgatgccaggggtcacggtcacgttatcagaaaataaacaaaagttgaaaaataaagactggcaagctaattactattggagccaacatttccttaatttgtctccctattgaggctacagactccctggggtgactaaactggctccggctacatattttcaaagagaaaatcaaagtgactgaatgtccattagccagacagcttgtctcactgagcctgaagccagtggattgcaacctctcaagcctcagaggcagtcctggggccaccctcccttctctcctcctggattcctaacaaccagctgaggttgtgtttgatttcaaattcctctgattgtaacaatacaggcattagatatgcaaagttaaaaaggaaaaccaaggaggaagagatgatttcagatcacatgtggttatactcaagaatcactctcaattcataacaaaatgaccataacgaaatattgagcttactaattagtccaaaacagatgaaaatgcttatcagcttctgatgttccggaatgtgggactctttttggcctgtgacatttcttattgctgaattgaatgtttggatgtgtaataattcatcttttagatattttgaggaaagtcctctgcttagaaggtgtggaggctgggtatatttcttagatggaggactaagaaatgaggcgtgggccaggagctgtggctcacgcctgtaatcccagcacattgggaggtcaaggcaggcagatcgcctgagatcgggagttcgagaccagcctggccaagatggtgaaaccccatctctaccaaaaatacaaaaaggtttagctgggcatggtggcgcacgtctgtaatcccagctacttgggaggctgagggatgggaatcgcttgaacctgggaggcagaggttgcagtgagcggatatcgcgccactgcactccagcctgggtgacagagggagactctgtctcaaaaataaataaataaataaataaataaataaataataaaataaaaataaaaaaatgaggtcttcacatggaatcacagggcttgtatcacttatgctaagtcataccaaattatgaaaaatgtctgaaagggtgaaagggtcttcaaagctcatgtagttcaaccttctcatttacagataaggcaactgaggcccagagacccgctcattgttgctcagttaatactgaaccaactttggttccgcattacttcaaactgtcaagcctaggaactttccactgcatcacagctgttaaagaaatgatccccttccccgccaccactggcccttgctgggccacactgctgaagagtggaggcacttttttttttttttttttgccagaaccatcaaagccagcccccaccttcccagcagtccaatctcttgaatcatgactttaatgttcagggcatgcaacggcctgtcctttctcataattttaattatgtgtatgaattgcttccctctacccttctctctacccttgagtttctactttcaaatattcctggttactggtgtttcaattttgttttactgaaatataaaatcaaatgctagtcctctgtgcataggtgataaattcagtggagacaaattactgaaaatactgtagaagggtgctgctggagagcacccttagtagagtcatatcaggtttcccttttaagactatttgcaattgctatatttggggaaggatgtcaatggaagagaaagaggagaggattcccagccaggtgtaatctttttttttttttttttttttgagacagagtttcgcccttgttgcccaagccaagtgcaatggtgtgatctcggctcactgcaacctcagcctcctgggttcaagcgattctcctgccttagcttcccaagtagctgggattacaggcgcctgccaccacgcccagctaatgttttgtatttttagtagagacggggtttcaccatgttggccaggctggtcttgaacttctgacctcaggcgttcctaccgcctcagcctcccaaagtgctgggattataggcctgagctaccatccccggctgccaagtgtcatcttttgcaatgagttttgaatgacagtaaagctcaatgatataaccagcagaatgctcttgattaaacaggacatccctcattatagtcacttgtaactgtctctcaatatggcagaatggaaggtagtatcctacttccattcatcagatgccatgcagtctacagaaaacactcctctctggactccggccgcttcatctgctgatatcaacatccttgcctgaacgttgaccagttggcttatcgtttggccccagagctaagatctttgatgctaagttgatattttctaaactgttcttcaggataccatcacttgtgatatgtctgtaggaataattttgggtttaatcaaagtttcttttcttttttttttgagacagggtggagtgcagtggtgcaattataactcactgcagcctcaacctcctgagttcaagtgatcctcccacctcagcctcctgagtagctgggactacaggcatgtaccattatgctcagctaatttttaaacaatttttagtagagatggggtctcactatgttggccaggctggtctcgaacagctcaaacgatcctcccaccctggcctcccaaagtgccgagattacaggtttgacccaccacacctgacctaattttttttttttaaatggcaatctctctgggcttttagtgcattctaattgtgaccccttaggaagtgggtgcagtgaggcacactcctccaaacacctgaacacaggaccttaagaaagatatgcttattgacagctcacaggaacccacaggtctgcagaacatcatgtggggaaatgctgcagtaaacggtggagataaaatatgcctttaacgcaaataatactagagaagataccaaaaaacaatgtaaaatagatcctctaatattactactgctcaggtatttttactgaattcttagccacagaggtcacactggtcatcaactaaaaataattcttgatttcttgtacttatctgaaactttacttgaaaaatatttaagaagtacatttcatttctcagggaaggaaagaggtgcatgtagtcccagtgctgacttagcaagagactgctaatttctgggaacttccttttccttccccctttcccaccctagcctgcccccagccctttctgggcccacactgctgaaggttggaggcacaggtgactgtctctcaccagggcagaccttgtcactgcactctgacccacagcaatcgtagctcactgcagcctagacctcctgggttcaagtgatcctcccatctcagcctcctgagtagctgggactccaggcacgtgccaccacacccagctaacttttttgattttctctgacttacagccaccgccagggcaccacacagcagggccatacacagggcttgctgccttggggactgaagaggaatgtgggtggaggatctaggaattactgcaggaggtggaggctacctgagaccaaagcacaaataaactcagcatttaaaatctgataccagtctctggaaattccatcccgcttctctggtcattgctagtgatggttggtctccccgcaggccactctccctcacaggcaggaactccttgtgggcggggccaggtcctattatttctatatcccaacatcgaatctcaacctaacccccagcagtattgcgtttgttgctggggttcccggtgattatgctcaagcataagccttggttgctggaggctgcccttcatgagcatataagtgggatttcacctgtagataaatctgaggcaaagagacaatggacttgccaggctgggctgtccataacgcatgggctacctggctcagagcatagctgaaaatccaattcccaaaatgaaaaattagaaagctgctttcttgtgactgattctcaagcaggccccacacattcatagatcagtggctaaatagctgcaccctgtttttcagtgagattcctgttttcagtaaaggacatcatctatgaggtaagttacacttgcctgcccctcccccactgtctccaccatgggacaaaactcagtgattttaatttggaacttaaaaagtagtcagggcatggtggctcatgcctgtaatcccagcactgtgggaggctcagaggccggcggatcacctgaggtcaaggagtttgagaccagcctggccaacatggtgaaactactaaaaatacaaaaattagcagggagtggtagcaggcacctgtaatcccagatacttgggaggctgaggcaggagagccccttgaacccgggaggctgaatttgcagtgagctgagattgcaccactgcactccagcactccagcctgggcaacagagcaagactctgtctcaaaaacaaaacaaaacaaaaaagtggtctgtaaatgttacttttctccagtcaacctggatgatcgacaagcccgtttcctctgccctatgaacacccctgggcaggcacatgccacatgcttcaggctttaagaagtgtcaccaagtcctcaaattcactcaaattattcaaatcgcccaatcctaaactggttccaaagacttattttgcatttacttccgacatatggcagcttccttgtgactcagcccagttgcttgtcagaatttcactttgtagttctcccttgccaggcagcggaagctggtcctcagctgtttgctgtcctcagctgatggctgctgccttctagccctttttgaagcttgggctacacccaagaatcaccacctcctgagtgcccaaacagctctggttttttcatctctgcatttctggctatgggtgatttgtcctaggaaccccaaaggaaggttcaggcccagccaacctctcccgacagagctccagccaccttcccttcccgaggtaagtagagaagagctaagccctaggcttggggaagaggacagcagcttcctgggctacaagtagtgggtacaggagctggtggctgtgtggcaccagcctcaggccctctaagtggctgagggctttctccccagggaagtggtcctgccagccattgtcaatggagtccattttgcttcaaagttcacccttgctagaaaggcccttgacatgtaggctaaaatcctacattttcatggctaggctggcactgacaacttggcagggggaccagagctgcttcacacatgcatatggtggtattttgatgacaaggcattgcctggagcattgatattagtttaggggctctctttctcctttctctttcttcttctctctttcctcttcccccatccctccccttttccactctgcctcgttcttcttttttcctccgaactcaaataaggaaataacccgaacttcagctgatcatatgcttgagtgaccagacatctcagttgaatgtcgccgacataatgtaaatcagcttctcagctctgtgctaaaggcccagcttttagaaattttccaactgcctgtggactgatacttctgtgaaacacaaagatgaaccactacaaaaataagatgtaaaatgcaagcataaatttttggatttaaacaaaattcctctgtcagattgatataaaaatttttaaacactctcaatttttgtttttatccaattgtgaatcttgcctgtccctagaccatattttgagtagcatggatacagattgtttaccttacaaggagatgtttcatatttatatttcagcccattttctttgggaaaacacagcgtttctgacctcttctctgctcatcttagtttgtctaaacacatatctaagctctactcatttctctaagagcacaccacttcagcttggtggagagcttcctccagtacacactagcttacaacccttgagctaatgggcatcactcttattctttctctttagaaggagtttgaacttatattctcttccctaggtcccatttacaattcatatatgtgccccttcctgcccacttgcctgcttgtcctctgaggtacctgattgtgctcttaatatataaaaatatatgttatatatattacatataactacatgaatataaaatacatgatatggtttagctgtgtccccacccaaatctcatcttgaattatagctcccataatccccatgtgtcatgggagggacctggtggtgggtaattgaatcatgggggcaggtctttcccatgctattctcatgacagtgtataagtctcagagatctgatggtttatcaatacaaggggcagttctccggtacacgttctcttgcctgcaaccgtgtaagacgtgcctttgctcctcctttgccttccaccgtgattgtgaggcctccccagccatatggaactgtgagttttttaaacctctttttctttataaattacccagtcttgggtatgtctttatcagcagtgtgagaacgaacttatacaataaataattatgtataattacatataggcacttggaaactttagacattaaacataatgtggcatacattgtatataaaattacatagcataattacataaatatatttatatatacaattatataatcatatctatataatatataaacccccaaactggttatatatataatatataaaaatatgtaattagggagatatttagacttgccctacttaccagtgtcattgggatatttgtctcccctggtacatgtcttcccatcatcttcccggatgtagccttcccggcactcgcagcggtagctgcccaaggtattgatgcagatgtgggcacacagcgtcccattgctgctggcacactcatcaatatctggtttgaaccaaatgtagagaatactaagtttctgagaattcacttctaatacaacagatgacattgggctttgcctctctgttaataacaatgaaggacacttgggccgaccttgatcagagcagcctggaataaagtagggagctagaaatgtgggtcatccataaaaacagcacttttggccaagtggccattgttacaggctgatcagtgatggggttcctggctgtggctctgccactcgcaagtcatgtggcttagactgctagccttcagagatctcacttacagaacaataacaatgaagcctgccctaaacacttcagagggctgcttagaaatgacaatgagatcaccagtgacaacactcagagaagcaaacattatagagatgattttttgtgagtgccctactgtgctggggatttttaagtttccctttatggtataggttccaaacagcatgacgatgaccccacaggtcacttaggaatggctccttcccagttaaaagccatgatggcacctgggaaaagatacttctaataaaagaaaatagtcataatgggtctaatggaaagagtcttccccaggaaatttctgcctcatcaagaacccagacagacccctcatgagctgtggaaatgagccatgggaccatcaaacaagtccccatgaagagcccatgttaactatgcacatcatggacttgctcccctgccgcatggtggaaacaaaaacgtttcccaccacgaggacagtgggaggcccaattccatttcctgttcactggttgaagacagtgggtagcagtgggtgggagccgtggcatgcagccccagactgtgcacatgtgctgcgtagacacaggccagccctgaacttgaggatggcaacaacttcccagccactccctgcacaagctgccagtgactcagtccctgtgtacgctgaggggagggtggtcatctggacgctccccggcagtaccaactatgtcacctgtagaccggatgttgcagctgcatcctcctctgcaattcctcaggctcactgcctttccccaggtgtccctgccctaaacctacatgtgatgctgcctgtactgcccagagagagaggagatgaagttgaaatcagagatagaaatagaactcttagtagaagccaagttctgctggtccccaaacccccaaacaaaaagaacagggggctgggtgcggtggctcatgcctgtaatcccagcgctttgggggggccaagacaggaagctgagcccaggagttccaggccagactgagcaacatagtaaaatcccatctctataaaatacgaacaaaattagctgggtgtagtggcgcatgcctgtagctccagctactcaggaggctcaggtgggaggatcacaggagcacgggaggttgaggctgcagtgagccatgatcacgccactgcactccagcctgggcaacagagtgtgaccctgtctcaaaaataaatgcataaagaatagggtacagtagctgctataaagtgaagtaagagccttgtgcctgggacctgagcctcatggaatggcctgtacctttctctgcaggagaggccagagatccctgccccattcacttgggagtcacaatcccattgtctggcattgtggggcaccattcccaaatgccgacagggagcaaccagaggacctacggttagaacttctcagaaatggtgctccctagagcccctgctaggatagagaaagagggatgctcatgacagctggtttatcttccatgtaggtctacctgctagtctctggcagttcatcctccagttgattcttaaatctcaccatgcctaggaatcattagaggcattggtgtaaatatgcacgtctggacccactctcagagttgtgattcattaggtgtggagaaaaggccaggttttttttttttttccccaaacgaggaccccagatgtttcttgggttagttatgaactgaccacactttcagacacatggttccaatggaaaatgagccataaagctgccttagaacctcaaggagtgcacggctgggatagccagttcatgagggtggcagtaaacaggctggtgccgtggatggtgcaggctctgctcagctgcagcccaggtggctggcttcagctccctctgacttcctcccaacctgtctgccatatggctacttccttttttccccaaccatcttctaagagaatgtttattcttgttttgttctgtctgcgtttttacttttctgaccacttatactctgttttacattattctagtttatatttgggcatgttccccttctcctgctcttatgtctcattgccaattaggaccttgctggtaccaaatcccggaagaattccttgggcctaattggttttagtaattgtgatgaagggcagtgataagctatccctaggataatatcaaacacaactccatccaacaagtatgagaactgaagggtccaaccaaggacagaaccatctgaacaaggcacatgttcagaagctggaaacaagcacattcccaacacacccagacagtatggcttctcccgcttccggtgtctctcccggtcatatcggtatcccggataacaagtacacagcactcggccaaagttgtccgtgcactgctgttcacagggagcctcggcacaaacgtcgtaatctgaaaaagcaaagtgagagctcacatcaactacaggaggaggcggagtaacctggccctggcctggaaaggactttctgggctgggctctgctcaagggcacgtgtgaagtgtggacagatatacttggagggacaggaactctttagggctgtgggtcaccttctaagagtactgcaatgggtaacttacatggcatcacatcactcgtgatttttcccctaggtcaccttgtcatcctttggtctttgtcactatccagagagaaaagactcttaagagggccagcctctgcggattccctcggggttgggggtgctgttttgtcttgttcatcaactgctgtagaggcaggtgactccacccagcagaatactaaacaaaggccagctggggtgacaggcactggtgtcatcatgtgggaggaagggctggaagtcaggcaggctcagagaggtaggaagggggctttgtgtatacatgtctagtcttatgctgctgatacagacatacctgagactgggtaatttataaaggaaagaggtttaactggctcacagttccacatagctggggaggcatcacaatcatggctgaaggtgaatgaggagcaaagctgcttcttacatggtatcaggcaagagtgtgtgtgcaagggaactccccatcagatctcgtgagacttattcactgtcatgagaacaccatgggaaagacccaccccatgattcaattacatcccaccaggtccctcccatgacacgagggaattaagggagctacaattcaagatgagatttgggtggggacacagccaaaccatatcactttgtaatagaaatgtgcatgacttataagagggccgatgcttatgtgtgtatactgtataagtgtgcatcctggggggttgatctctcatgctgagaaggggttgggtgagtttgaatggctagaggtctctttccagctctcagcctgtacaaactgaggtggatacactgctactcataaagaattagggcatctgctcctctcagttcctatgaactgatatgtaatgagcctctgaagggactttggctctaattcagtagctcaggcacaacactgactcccggaccggagccagcacctcattaatccttgcactatctcttccaggtgctgacagataaactatacttggacacagagcgagtctggctttgctccaccacatatgaaggtgaacgggtgggctgtcagctcctgatgcagggagggtttgtgtgacaagtattgtgccactctcacgatgacctggaaagctgcccttgtaaaatactccttcccatgattgtgatttcaggcctgctttgcctgcatggtgttctgaccaaccctgcaaactgtctctggctacacgtttcccccacttggcatcgcctctaggcagccaaggttctgtgctctttttgttggagagcgtgatcctggcatgactggctctgagcttccctgttggctgttgccaccattccgcagcagctgggaaggggaagaaggaggcagagaggctgtcgaagtgtttgagttgatcatggtgcctaacaaggcagttccctgtctctcctaccatttctgcttccctgaggaaccgctctcaactcttctgattctttctatactcacttctgcatctctaaatagctgacttgcattgctttatttttattttaaatcctctctattgacttccagtaacagaagagatgcatttaactttttcacggcctcctgtgccctgcagtcacacccataacttcatattccctccatctggccaatacagttatgatgatattttggtgcggtaattgttagtatttgcaccataatgacaacataaaagctattctttgctgagcctggaagtatgcttgaattacttgtaccttcttgaagacctttttgtcttctttggaattaaaagaattaccttgtatatttttggggtgccagttactgagctttccctcttagcttcaaacacccaccttcttcttccatgggctactttgtgacttgggctctggagaccacattattcctgtgtcagttgccagcctcttcatttctgacagtgacacacatagagacacagacagatacagacagggaggctggaagaggaagaaaggatatctgcctttttctggtttgcttcctgggcttcctattcatgaaagcctaatatcagcctttctcttccatcccactagcagactgtttcaatagcagctgcaagccgggcatggtggcatgtgccacctccggaggttgaggtaggaggctggcttgaggccaggagttcaagaccagcctgggcaacatagtgagctcctgtgtctaccaaaaagaaaacagtagcagcaaaatccagcttgtattttttccaacacttgcaaaatcagcctcactatatcccatttcagagacatcagcaccagccagccatctggtagcccctcctcaaaggtctgggtccctgatccactagtaacttcctctgagttctgagaaatagggcttgctagccagtacctcttcctcagagtgctgggtcctccaaacttctaagttttcactggcccagtatcttctctttgtttccctagcctagaggcggtagctgcttcctgcagttgttacctcaatgatacttagttttcctttgcatttttggttctcaattactagttagcaattcttcatattaattgctttctgttaaataagtggtgaaggctctgtttctggacaattcaatctacatattcagttttctacaaattgatcactgattcatcaccagagatcccctcaattttgcgaatctcttcttatagacattttttcaaattaatctcaacttgctctaattaggactctgtaggtctgctgcacagcagctactactcttggtcttgaactcctcaaataatcctcgtctcagcctcccaaagcgctgggattaccagcaccgcgcccagcctacagctgcctccatgaatgtgcattcaccatgaacctagggatgcccatcacctccctctctcttttgttggattcctgtttcctggatctctcatgtattagtctgttctcacgctgctaataaagacatagctgagactaggtaatttataaaggaaagaggtttaactgactcacagatccacatggctggggaggccttacaatcatggaagaaggcaaatgagcaaagtcatgtcttacatggtggcagacaagagagagcttgtgcatgggaactctcatttataaaaccatcagatcttgtgagacttaccaccatgagaacagtatggggaaactgcccccatgattcaattatctccacctggccctgcccttgacacgtggggattattacagttcgatgtgagatttgggtggggacacagccaaaccatatatccatgtctttctctcttccagtttactccctcattttagtggagaatattctccattggcttcctgaaaaatgtcataaaaggggtaaaagttttgagatcatgcatgtctaaaatatactttatcaacccttatgattactactgatagtctgtgtatataattctaggttggaaaactttgcctcagaattttgaaggcattgttccattgtcttccagcttttcaatgctgctgcagggaagtcctgtgagattcaaactcttgagcttttgtatgaatcacatcttttttcctccctaaaaatttttaggacttatatggtaccacttcaatctttggtaaaccctttttataatctggaaattaatatccttcaattctgaagactttttgaattatatctttaagaacttactccctctgtgtggaattttaaattatttggatgttgcatcccctggactttatgtctaatattctcatctttttttttccctattgttaatttctttgatctcttgctctcgtgcttggaaaacttcttcagtatcaccttccaaccctcccactatttccgccctccactactcaccatccaaccctcccactactccccccctactactcaccttccaaccctcccactatttcctcccccactactcaccttccaaccttcccactatttcctccccactactcatcatccaaccctcccactattcccccctactactcaccttccaaccctcccactatttcctcccccgactactcaccttccaaccctcccactatttcctccccctactactagtctgcagtgtcttgttcctatgtttatgtccatgtgtgcacaatgtttagctcccacttataagtgagaacatgtggtacttgtgtttttctcttcctatgttagtttgcttaggattatagcctccagctccatccatgtttttgccaaagatatgatttcattcttttttatgactgtgtagtattccatggtgtatatgtaccacattttctttatccaatccactactatgggcacctaggttgattccatgtctttgctattgtgaatagcacggtgatgaacatagaaatacatgtgtctttttggtgtaatgatctattttcctttgaatatataccactgctgggccaaatggtagtttccctctaatatctgatgatcctgagacggctgctctagtttattcacggtgtatttaaaacagattaatagaatctgtttgcatatagttttatgattttatgacatctgggtatcactgtaagtgatttggccagtgcattacaagttcagtttcttaagaccttttccttgggttgtctagaatgcccacagaagacatttccaaatccttgcctgagagtgaagtcattctggaactcaagtgaagggagaaggctgagggcttcaaaattcaatgtgtgagcatttaccgaaaccctcctttttcagtactgggcattcattttcagctgactggtctccttcagatccttgaacctctggtgtactctcttagaaaatatatcttctgtcttctgtctggttgtggaaaaggcaatatcctgtctgtatggagcagaggacaagatccaggagtctgacttcttcttaaacttttaatcaatcctgttttcacactacttttacccctttttctagtttatttgtagtgttactgattactgtttgttttggtgtaaattggggttgctccttggtttccttaagctggctacaattcaaccttttggattgtgctaagctatttaccacctccctctctgttctccagcttccaaagttttattgctattatctcctcttcccattttgtcctcgtgggtttgtcttttgtgaatctttccagcctcctcctcctgccctgcccattttgtgcattttctggaggaggcaagattaatgaatttattcagtcctccatttttgatgcttgttccccagagcctaccagctttcagtcatgtagcttttatctttacagtgtatctattttctatcctctctgtcctatttcttttggcaccattctaactcagaccttcagaaactcccttgtaaacaagatcttcatcccaagattcttaccatcccaagattaaatccatttgggataacactgccaggctaaccttcccaaagcatagcactgtgtacaccatccccttgtttaaaaacctttacaacttgctactaatcaacatgaaatataaatggttcgctcctgtatttaagttctggcattatatcccttgagacttttctaaccttgagacttatctgtaagttccttatactgcagcaaaactaacttctctttttcttcaccccttattcacatccttgccttctcacctccatacttttgtttattctgtttttacctcttgcaatgtccttttataattgttgatatcttatccagtttttcaagagttgatacaaatgctaccccttcaagaagccttccttgacctcctcaacagagtttagtttgtctaccctctcaccgcccatgggactctatacctcttttattcccatgctctgctatatttatttattatttatttatttttttgagatggagtctcgttctgtcacccaggctggagtgcgctggcacaatttcggctcactgcaacctccacctccctggttcaagcaattctccctgcctcagcctctggagtagctggaattacaggtgccagacaccaggcctggctaatttttgtatttttagtagagtcagggtttcactattttggccagactggttttgaactcctgacctcaggtgatccgcccgccttggcctcccaagtgttgggattacaggcgtgagccactgcggctggctactcttccacatttactgaatgcttactctgtgccaggccctattccaggaagtatgtagctttagggtgcatagtataggttctgggacaaccctcccatctctgccactatctcggtgatcctgggttctttatgcctcagctcctacaaaataaagataataatacccacacttcatggtgcttttatgaagattaaattggatgatgccattaagcactgtgcccgatgcacagtacaagctttacctgctcttctgcttcttttgctgctggttcttatgactgctcagctacctggcagggactgtgtccccttgagaaaccagtactgctcccttcccacagtttatgctgaattaataattgctgaagtagaacaaatgagatcatcctatcacctggccaatcaagacatcacttctagcaggggtcagcaaacttatgttaaggggccagatgatattttggctttgtagatctcttttgcaactactcaactctgctgtaatttgttgtagtgcaaaagaagtcacacataatactgaaataaataggtttgactgtgttccaataaaccttcatttacagaatcagagttagggcacaggccacagttcactgagccctgacttagagcagcaaatacgaggcagcaacgcttaaaaactatagcttccactcattagttaacgtatttctttagacattctagtttctttttgccatctgtgatggttagtgctacatgtcaacttggctaggccatggtacccagctatttagtctggagtcaggttcaccaggaggatatatattctctgaatcagtatccaacatatggtatggtttgtcccataaccaggattcacaggtcccagaatcaaggggtggaagtgggagtggcaccactcactgttatccctactgatccactagcaaaatttttgcttcctgttcctataactttatgttatattggcctagagggcctagtttcaaagggaggaatacttctagcaacagaagcaaaaatgattccattgaactgaaaattaaggtgccacctggctactttggtctcctcatgcctctgcatcagcaggcaaaaaagggagttattgttctagctggggtgactgatcctggctaccaaggggaaattgtactgttactccacaacagagggaaggaagaatgtctggaacaccagaaacaccttaggtggtcccttagtattgtcacaccctgtgattaaaaagtcagcagaagacaacaactcaattcaggcagggctaacgtctcagatccttcaggaatgaaggtgtgggtcacctaaccaggtagagaaagaaccacgatcaggcgaggtgcttgctgagggcaaagggaatatgggttgtgtggtagaaggtggcaggttacatgtatcagctatgaccacgggacaagttacagaaaaaagccctgtaaattgtcatgagtatttcttatctttccatggattatttccatgtctctgtgtgtgtgtgtgtgtgtgtgtgtgtgcacctgcatgccaatctttgttttcttccttcttttatcttcttatcatatgtcataagatgtagtgactttatatcacagtatttaagtactgttaactttacatcacagtatttacattaaagcatatcaaggagatgctggaaaagtccagtgccccaggacttcataccctcttctggggaaagggttagtgtgtttcatgcagcatagttgcagcatgtcagatgaacatacaactttgttattgcctttatctggagattaggtatggtttaagaagatgcatatgggtgccaagttgacaaggcatagatttgtgataattttttgtgacaccttggctaggccaaagtgtccaaatattaggtcaaacattattctacgtgcttctgtgaagatattttttagatgagattaacattgaaatcagtagactttgagtaaatcagatgaccctccataatgcgggtgggcctcatccaatcaggtgaaggtcttaatagaaaaaacctgacctcccctcccacaccccaccaatctaagggggacttctggccagcagattccaactgcaactcctccctggatctcttgcctgcctgcctgcctacaatgaagattttggacttgcatctccacaatctcataagccaatccctttaaaaaagtctcaatctctcactcagtctcagtctctccctctctctcctacatagaaaatcgaaatcaaaattggttctatttctctggagaaccctaatatacaatattttctgaaatactgcatttgtactttgcattctttgatgatagaaacaattatgactaaagatatctttagtaaaagaaacaatcattgactttttcccacagattaaaacaaacatgctatgaaaagtgttctagcaaaaagcaacagagcagataattagctctggcaaaacaactttcagcatgtgtgaccacttttcctgaaaatattcagttctgggttatgttaattataggtgctgtagtctctttaggatgagggagactacttttaaggcctagatgtttgaaaccactaatattgaaagaaactctaagtatgtggtatccatgcaatgtgtttttaattaggttgggcaaggtctttagataagatcttaaaccaaaggggctaaacttaattttctttcgagtctgccaaactgcaacataaaggacacagctggtgactgagaaaagctgttatagaaagaagtgcaattattgtgacttttgtgggtttacccatcatgctataaccaacagaattgagaaattcagcagagagaaattcagcttagagaaacccaacaccacatcaaccatcacacgtggagcgattcccagccagccttcctatggcagctttctcaaaggtcacagctatggttcaatgaactgtcccaaccttccacagaaaacagcgataaatgggagggattcatctgtttctaactgatcaaaaatggtgctctatgagataatgcaacagaattagcttggctgggctctagatcttctatagagatctggcttcttgggcaaaggtgaagaaaactgtttcacattccccacccacctcaccctagccctgaacaagcttaacctcatgcccttcaaacaaatagtctttactgctttctgtgtcagggctctgcctggaaccctctgtagccctctactttctacttgtttaagtcctgggcagtcttccttgataacatggtctcacttctcccctcatttctgagaccctctttgactgccctgggcctctgtgtatatgtcccctctgaacactttctgctttgaatgtctctactgcacatattgcagttattactaacaatgacaacagcagcaataacagcagccaccatttatcaagcatataataagaaacagcctctgttccaagtgcttgacatgtggcaaaattcttaaaaccataatttaacccacatactaatactaccctgtaagaactaaggcttagaaagtaacctgaacttgcccaaggtcaaagctattagtaggacatagaagcatgattaaaatctaggtctctctgattctatctgctccccatcctggcttctcaacttgaatgcatacaacttgagggctgggtccccgccttactttgctctgtatctctatctgagtgctgggttgaacactcaggtactgtttgctgatggtcatgtaaagggacttaaagtttagcaggtgaaaggcaggtaaagaaagcaggtagagaggtcaagggaggagggttggttctaattgtgtgtaaaattacacaaatgggctaattgggggattatagctcattaatcataaaacctgaaatactatataagaatgactcaatgtgtgcaagcacatcatgtaatgattcagacactgcacgctacatataacaaaattggcgtcagaaaaatttgatgccaaaaaatatacacagacagatacacagataatcagacacagataagacctatattccatgaacatctgaagttgatagactttgaatgattagttgtgaataaagtcagacaatatcttttttatattacataccttctgggatgcattgtccaagaacaaatttatatcctttgcagcactttttcctaagagacaaacaaacatttaaaatataataattaggctaaaaataaaattctttccagttattgttgtttgaatgaaataacttgtgcccaggaaacattgaggcataaagcaaagtaggggtgaagtatttttaaggcaatctgagattaaaagaaaaaatatcaataatacatgacattttctaataccgggatattctttctgctacataatatatgaaatcaacattttgaatcctatgaaattaaataattaactccgacttcaagatacttatattaagcaattaaaggagtatagggcataaataggaaaaggacctttaagggtgaccaggcctctcattccacaggccaaagagatacaacttgtttattataacaatgaatcataataacaatacttggctaattataacataatgattgttaattgtaatataacaataattaggtagtcaactattaagaccaagactggaacccaagcattctgattctcatttgagtgatttttttttttaaaacacttgtaccatataagaaactgaaaggtacctaaatgatctgaatttaaaatatagcaaacaggtcattcctaacataaatattcaatacttactccacttcaaccaagctaatttaaccaagttaactacctactagaagaaaaatatttacactctctgaatgaatacagccagatgcaggctctccacaacataacatgtacaaatgtgacccattctcaaagagaagacaatcaatgctgcaatctccaaaataacctatatgttggaattatcagactttaaagtagctatttaactatgttcaactacataaaggaaaatatacctgcaatgaacaaaacagaaaatctcagcagagaaactactaaaagaacaaaacagaaattatagaactgacaaatagatctgaaatttttaaacatgctgctggatgtgcttagcagaagaatgggggaatgatgcaggaaataatttgtgaatttgaaaataaatgaaaattatccaatctgaaggaaagagaaaaaaagacttaaaaaaaggaacagagacgtgtgggctaatatcagagtctaaggtctggtacttggagttgtagagggagaggagacagtaaatggagcagaaaaatatatttgaaaaaacagtggctgaaaacctccaaaattgagtgagagacataaattttcagattaaagaagtttggcaagccccaaacgcctaactacacacatacacaaaatgcctagagatgtcatggtcacgctgctgaaacctaaagagaaaatcctgaaagcagagaaaaattacacatgatatacagggaaaggatgattttaataaccacgaacctctcatcagaaaaccacagtaaccagaagacagtgatatgacatcctttgagtgctgagaaaacaaacttgtgcaacccagaatatccagtgaaaatatccttcaagaatgaagatgcaatgaagacatttcagatttaaaaaaactaaaaattcattaccagcagacctgtgttaaagggagttcttcaggctaacaggagatgacactagagggaaatgtacatttttaggaaggaatgaagagcattataaacagtaaatatctgagtacatatgaagaatttttaagttctggatacatgtgcagcgcgtgcaggttacataggtatacgccatggtggtttgctgcacccatcaacctgtcgtccaggttttaagccctgcatgcgttaggtatttgtcctaatgctctccctccccttgctccccatccctcaacaggccccagtgtatgatgttcctgtccctgtgtccatgtgttctcattgttcaactcccacttacgagtgagaacacgcggttttctgttcctgtgttcgtttgctgagtgatggtttccactttcatccatgtccctgcaaaggacgtgaactcattcttttttatggctgcttagtattccatggtgtatgccagttagaatggcgatcattaaaaagtcaggaaacaacagatgctggagaggatgtggagaaataggaacatttttacactgttggtaggagtgtaaattagttcaaccattgtggaagatagtgtggcaattcctcagggatctagaaccagaaatactgtttgactcagcaatcccattactgtgtatataccctaaggattataaatcattctactataaagatacaggcacacataggtttattgcagcactattcacaatagcaaagacttgctctgaatttcttaaagcaaaaataataacatacattgtcttacaaggtttataatgcatgtagttgcaataaatatgacaactgtaggaaaaaatggcagttggttaaatggacctatatggttataaagtctctacattttatgtaaaatagcacaaccctggcatttctgctggagctaatgttccctttgtctcattgtctcctgctcgcattactttccccattccttgctttcaccacttccatcatcatatatgagaagctgagaattaaccagcttacagtggatctgcaaatctcaagaatataccccaagatattttgactataaaggttaaattaccgtttttaagaagtatttttttttgtaactattaaagacataagattcaaggtcattcctactgcaacatcattctcgctcatttgtgtttgggcatgctttctaggaagagaaactgagttaaacgtggtctaccagctgggaactgcatgtcacctacagcctatcatgtcacctgtgtgaacacaccatttacacatcatggtggagaaaggagcacaaaccactgatttgggaaattagacattatctgtgtcttaaaacaagtttcagctttgtcaaataattagaactttcatgtaggttacataaggtcttctaagaattttggtacactttattttttattaaaatgtgatgaaaaaaattatttaagatcattattttctactcttgcaaattagtataatctgattttattacaggttgagtaaccctcatctgaaatacttgggactagaagtgttcggatttcagattattttggagtttggcatatttgcagaataccagctgagcatccccagtccaaaaatctgaaatctgaaatgtttcaatgagcatttcttttgaaaatgtttcaaaattttggattagggatgctcaacctgtattggtcaaatcaatttgctgcactacaatttggtctgccaggtaaattaacattcctaggagaaacttaagtaatctcctcctgaaacaaaatttataaaaatttcataaaatccctaattagttttatgtgaaatttatgaaaagttcatacaattgttaaaagtcaaatttggtaacagaaattctgaagcataactgggaacagcaactccacttcattcctctccctgtaacatttctcacatgcaatgcagtggtggtagatatcttacttcaaaagcatatgaagtatgctttcaatataaaaacagtggcatttgggatgctatcaaaacagacttgagtgatacagctaaggtccccctgcctgtactggaattcccagcatagattaatttgacattttatgttagaaggaaatcatccatccaatttaccaatatgaatgatgtgtggcagtgtccagagtgctcttattagacataattttccaacctctcaaactaaattataattttacataccaagagaagcccatgaagatataaatttatgatgaggtaccagaagtacagggtccacctttatattgcatgaaacttaaactctgtctagttttccatagtttaaaaaagttcaagctcctaacaaccagaaggaaaactggcttgagtattcactaaaattttacggttattccttactccattacttgaggctgtcctacagaaaactataagaggaagaaaagtgtactagatgatttgaaactccagtgattcatgagaaagttggatacaagggggaaaaacccacgtgtttttgatactcaaatcgaacatcacatttaaacatatggttttatttgtctgtttctattttaatgctgcatttaagatacaacctctgagctgtttgatggcgttttaaagttcatgcaaatcaatatgatcccttacaatctctctttccacatccaagacattaaacttgggcactgtgacctttatgagcatttcaagggcttaggactgtccacgcagtggagtaagaagcaacctgtcatttgccttttcatgaaatcagataatgaagtgatctgatatgctttcaaaaggctatggaactccatcaagagaagatctgagtttcaggatgggcatgcatcatttacatacctgcttagctaagaatttcccctttgcgttttttaattgcataactgaccccagctgtctgctcaagggaaggagttgtgagattccagtgcgcccttctgtcttccctagagttcctgggaatacattattttgcatgtgaaacacccatcaatcataaatcaccatttaaaataaataatgacatattctgaagtattaaaaaaataaacactggttgcacgttatactgtttcaaagattacttacaacattatttacgtacaataaagttgagacagccaaagtgaaatcttgttacgcaagcatgggcacttgttagatctaactacaaacactgctgtgtggtttttatctttagaaaaacaaactaagatggggaaagctcgtgtggattctggggagacaatcattcttaatacccttcacgtgttgtagcttggttttccaaatacaaatacttttctcatttcttggcaaggggaagtgattagatggttgttacatagaaagggtgatatcttgtaatcaagaaagtctgtggagtttccccctgggtgcccctgagtattaacacatgtaaaaaaaataaataaataaaagtcgtgcaggcagaaatacagccctccagccaggagtgtgtgtgagcttttggaaggaaaaactacatcagaaaaatgaagataacagagactgcatcatcagactgtctgctgatcattatgttagagactagaaaagaattttaaaaataacttcctatagtattagaagactaaaagtgaccatgaaaggccaagtgaattagcaaatatttgcacccttgctgcaatgcaagggtacatttttctattatttatttggggttttccttgcatggctgcttattcatgcgccagatatatcagatatttatttatttatttatttatttatttatttatttattttttgagatggagcattgctctgttgcacaggctggaatgcagtggcatgatctcggctccctgcaacctttgcctcccaggtacaagcgattctcctgcatcagtatcctgagtagctgggattacaggcgcctgccaccacgctcagcttattttcggtagacagggtttcgccatgttggccacgctggtctcgaactcctgacctcaggtgatccgcccgcctcggcctcccaaagtgctaggattacaggcatgagccaccgtgcccggccagatttttttttttttaatgagagagaaaactgcatgtttgagagtatttgagagttcttggtgttaaggtaatgtgtaacaaatggagcattggctttggggtcaacaaatgtgggctagaattttggctctgacatttacagagctagggattgcttgcgccttgctccttggccttgctccttaatcttggccttgctccttaatcttgctgagcttcagactcctcatggacaaaacatgaataaatagtatctgccttatgagataattgacagtattacagataatataagaaaggtgcctagcacagggcctggcttgcagtcagaatatgttctagctgcagctttgtaaatacaacaagcaaatggcaaaagcaactcttcccagttgctttcatcttatgactcatctctttctttccacctcttatttaatggctgacaaatcttttcttctaaaaacaaaataggggaagaaatagggggaagacaagtagggggagaaatttttgatttcaagaggccggaaaagaaatgttatattgctttcttcttttacaagttaacctcaaataatgaaaaccagaaataaaaatgcaagccccacaccctatggatttaggaggcttctctaaccctgaaacacaatgtatgaacatggcaagaggattgtgcagggtggaataacttcatacctgggaggctccaggggtggctaccgtggagaagccagccagtcctccctgcagaacctcagcaaggcttagaaaccagaagcaccagctattaaggaaagtggagaccagggtgcagcaagatgatctccaagtctggtgagaaggaagacttccatctttctccccaaccccaaagcaagtagcccctatcattttcctactgcaacaagaagcaagaggtatattcttttggaaaactatacccaaataaaacaaggaaaccccaaacctacctatttatttatttacgtgtaagcttgttattaccaaatctcagtgacaatattaagagaatcataaaaagcatatccaagaaactccagactctgggctaccaagccagagagctgagtagaacctggcctctagtagataatcctggtcaggcacacagaagtcccaaatgtttttaaagaacctcttcaatttaatatttcattccaaagcaacgagctccttctgatgaaggcttctaaaggcacactagatggtggcttcctcgcactgtcaactactcaggcctaaatggagacttccgagacataaaaactggagaacccaatttgcataattttcatcattccagccacactgtggcatgcctaagaagggagtctggaagagatttttttgccagaaagtacagagaacatgatctcctggggctaattttaaaaggctgagggtttaaaagtggtcctgaatttttctgcaaagttctttagtatgaggaatctttcttttcaatgttcttcccttgctgaaatctttattgagctttgcatgactttgtgtgaactactagaattccttttacactacatcccccaagaacagaactgaataaaatcagtctcacatctgagcatgcttggttccagccttttagccagaaagactgctcctcccaggcaaacgttaagagtatcatggtcactacagcaaccactaagataaaactaaaaacaaaatcccctccacccaccaccaccaaaacctgcctatttgttcatctacatgtaagcttgttattaccaaatctctgtggcagtattaagagaatcagaaaaagcttgttaggcataacttgctaacacgtacaattactgatggtcaagatcaaatgagaaaaacaatatagtgacacctgaaaaaaattaaacatagaattaccatataatccagtaactccactaatggatatgtagtcaagagaattgaaagcagggactcaaacagatatttgtacaccaatggtcatagcagcattattcacagtagccagaaggtagacacatcccaatgtccatcaatggatgaacggataaagaggtggtacatacatacaatggaatgtagttcagccttaaaaaggaaattctgatgcatgctacaacatggatgaaccttgaagacattatgctaagtgaaataagcccaacacaaaaggagaaatacggcatgattccacttatacgaggtacctagagtatccaaattcaaagagacagaaagtggaagcgtggttgccagggactgtaaagacggagttagtaggaagttactgggtaacggatacagagtttcagtttgggaagatgaaaaattctggagacggatggtggtgatggatgcagaacaatgtgaaagtatttaatgcccctgaattttacacctaaagtggttaaaatggtaaaatgtacagttatttttgccacacacacatacacgcaacaattaagtgaagaagtaattcagttgaagtcattcctctaatcattaaaaccctggtcatggtatcatctgggttttaactgttcaaattacagaaaagtaaaaggtatatgtgggagagttattaaatggggctaaggtaacaaccagaaggtactcattccaacaaggccgcaagcgatgatcttttcataaattaatcaaatacctcctcaaaaaccagaagacctggaagtctgggcactgggccttgggaatgtactccccaggtgagaatccgggctctgctgcttgccggcttcagtccttagataactgacattaagttcttctaactcaatttcctcatctgtaaaatgggatagtaacactatccactccacaagcttggggtgagggttacatgagtttaaaggcatcaagagcttggtaagcgctggcatgcatcaagcccaacagcacatgtaaaaagacatctgctgtttttcctgttgtgtctcccccaccgagcccacctgaaagacactgagtgctgcaagcagggacatcaggacacaaggagcccctgctatagtctaactcccacaggcctggcttgaagtgaaaagctgccagtcctcagtgacagtaaaacagggaccagggtctcaaccatatgtgttaccacgttcactcctgctcaaagacacaataattttactggctaaaaagagaagtgaaacctcttaggctgctgaagcatttgacttcttatgatcagtgcgatatccatctcaatgattaaaggcatatgattggttctctgtttactgaaagcaggcccagaacttatagatgtcaacagcagcacacactacaaggctgagaacatgcttgctggttctgacagtcctctctatctccctggcatatcagtgtgcttcagacccacagggtcaatgtcctcagcagacacagacactcagatggccagagccccaaggggctttggagacaagaaccctggaatgattaactttcttatttttcttctttttatttatttattttttttgagatggactctcgctctgttacccatgctggagtgcagtggtacaatcgcagctcactgcaacctctacctcctgggttcaagtgattctcctgcctcagtctcccaagtagctgggattactgggatgtgccaccatacccacataattttgtatttttagtagagatggggttttgccatgttggccaggctggtctcgaactcctgacatcaagtgatctgtatgccttggcttcccaaaatgctgggattatagacgtgagccactgcgcccagccctgattaactttctcttggcaactaagtcagtgctacacactccacctctctttgaacccagtcttccctctttatctccctaaatgaattttctaccttgtcaaccctcattatcttgcttgctggctgcctttgccttagttcaaatgagaagaagatcatcactaaaacataaggaaaaaatgtaacaaattaaaaaaggcttgatattacctttgtaaaaaataaaatatgattatattgtatatgtatatacttatatacgcataaggagtttttttttttttttttgagatggagtttccttttgtcgcccaggctggagtgcagtggcgtgatcttggctcactgcaacctccacctcccaggttcaagtgattctcctgccccatcctcctgggtagctgggattacaagtgcccaccatgcccagctaattttttgtatttttagtagagacggggtttcgccatgttgggcaggctcgtctcgaactgctgacctcaggtgatctgcctgcctcggcctcccaaagtgctgggattacaggcgtgagccaccacacccagccgagatacttatttttacgtaacaaaataaaggttagtttggagattcaccaaggtattcacaagtggttctctttatgcaggtgcgagacaggatattccccctttttttttttttgcatattttctgaattttctataatgagcatgaattgattttgtaagaaaaaataaaggaaataataaaataatcattatttttcaaagtcttttggtttatttctaatgccaggcttggcaatggcttcagaaacttctggttttgaaactgggtaaggaatgatgttcatgaatgcatgtttggcacgactacatacaggcatgtctgcgccaatcacgattcacttcgccaacccaaaacagcaacattttaaacaaagtcgttgttgtgaccagctatgttttaaccaaacagcttttgactaagtcacctggagccaccatatggtaattattaagaaactgctttaggaaaccatagtatcatttagtaggatattcattaattttacttttttcacctaaaattactggcttactagaggtttactttacataagattttaatggaacaattttctcctttgtaagacatgtttaaaccaacaaatctctgctctcatttatttccatggtggctaatttttggaagcactgatggctgtgactcttactctggaggtcattgtccggagacagcgcatgaaagactattccttggcagcaatatggttcactgcgaacagtaacaattgtgggatccaacacccaaagacctgggcatttatttattttgattttatccttagctctctgagcattttaggaatacctgaatgactattagtaatgctacaatggcatttatcaagcaaatcatagcttcaagcattagcatgatacatgataaactgaccaatataacaaaaattgttcaccatggttaccaagcatcctggaaagtttctgaactgtccccttgccacctcgccctctcaccctgtaaattttctctgcaagtctgccattgctcccccacctttttcccttcctcacagggtggatccatttgtaggatttataccctcaccttactgttcatggctccctcctaagctgcaaatgtgggcattttaattgccttcatttttcttgcctgtattttctaagtttgtttaaataattattacattattactgttgaaatgagaaaacattatattttgaaactaatagaaaaaataaaaatggccagccgtggtgacttatgcctggaattccagcattttgggaagccaaggcgggcggatcacctgagctcaggagttcaagacctgcctgggcaacatggcaaaatcccatctctaccaaaaatacaaaaattagctgggtgtggtggcatgtgcctgtagtcccagctactcgggaggctgaggcaggagaatcacttgagcccagtaggtggagaatgcagttgagccgagattgcaccactggactccaacctgaacagcagcgtgagactctgtctccaaacaaacaaacaaacaaacaaaaaaaaacgtttcatggtctattccccagctaaggtggaaaagaaaagcattctggagggcactttgggaggccgaggcgagtggattgcctgagctcaggagttcgagaccagcctgggcaacacggtgaaaccctgtctctactaaaatacaaaatttagccaggtatggtggcatgtgcctataatcccagctactcgggagactgaggcagtacaatcatttgaacctggaagggggaggttgcagtgggccaagattgtgccactgcactccagcctgggcaacagagtgagactttgtctcaaaaaaaaaaaaaaaaaaaaaaaagaaaagcattcttggtgtagccagaggtctatggcaaataatccacatgcatattttaaaatattgccttctatttttttttccctctggtagaagccccaaattacctacaacagctgcgttttcaggtcactagtgtgacagagccgttttcccatatctgctattcccttttatctatggtaaccgaaatccaaattacagctgggcacataaccacccagaattaaggtaacatttcccagcctctcatcccaccaggtatggtcttatggattagactgaccaacaggatgtgagtgactgatggtgggcaacttccaggcagtgcccttaaacagatgggacacatgccctccctccctccttccccttctccttcccatgagtgtgaatgtgattgcggaggtgatgagccattttggacaatgtgacgtcaatgccctagtgatgtagatcaatacacaagaaacctgtatccgtgacaccactcggttgtgcataagagaaaaatatttccatcttatttaagctgttgtttttggtttcaattacagaagcccaatacacatccaaagccaaaatgacagaaggaaatggaagaaaggccactgaaatgcagagtcagtgcacctaaagaggcccagagaagatgtggcctttattttgccccagtaacaactgtgcatggagcccttgacccttacagaatgctgacccttgaagtgtaaatgtctagagccttccttgtaaattacccaatgtgaaaggaggctctgcttggacagggctgtgatccttcctcccaccacactgtgggcagttccagtggcgctcggcctttctgctgcagttcactgtataaatgtggcatttccagggagatagatcagtacaggaatctgtaaatacaatttgctgattccaagtttcgtctgcaggtcagtcacttgagaaattaatgggacagtcttaaaggagagagtttcacttgtaatgactttgagaagacaaaaagggaagtgatctgagatagtctttcttaggttaataaatcatgatgtgacagatcccattcctcacatgcataaaatcctcaaggacaatgaaatacaatggacattaattcaggcctaagtcactggaaggagaaattcatgtaacaccgaaagtaggatttctactttaaatcatttacagatgagaggaggaaccttctatttgttttaaattctgaacttcacagtgacccaatatcacagtaaaaatttctattccgatcagttaaaaactggaaatattaagtttgacttaaagaagaacttactatataccaagataagcattttccatagattatttaattctcataaaaacttttttttttttaacaggtgagaagctggagcatagagcacttcacttgttaaaattagtagctaagccaggacatgagcccaggctgctgggctccagagcccacctcttccctgaactgcgtgttacaggagacacagattagtaagatttacatttggtaaacgagcaatgtgggagaaatggatatgcttagtggtatggtttgactgtgtccccatccaaatctcatctcaaattgcatctcccacaattcccacatgtcataggaggaacccagtaagagctaattgaatcatgagggtaggtctttcccatgctattatagtaatagtgaataaatcccatgagatctgatgattttttaaaaacaggagtttccctgcacaagctctctctctttgcctgccaccatccatgtaagatgtgacttgttcctccttgccttccaccatgattgtgaggcctccccagccatgtggaactgtaagtccatcaaacctctttcttcccagtctcaggaagcagcatgaaaatggactaacacacctggctagggacacacaagacagagcaatacaagcttcgtaacagaagtgtaatgtgtcctctcagtacagaggataaactcaatttcaggagccagggaaatacataggttggagttgcctctgccctagaaagatatacataaggggcacccatcctcattcactaccagccctgcccctccagggtggcccaaatccactttctctgttgtgcaagctcagctttcctctggggaataattttctccatccttggttcagatgatccttagacaacctttaggatgtctctcccaaacctgaacctaatttaatctgtagggcataagaggctggaaataaaagactacagacagagtcgttaaaaaggctactaaaatatttcagcctagagataagagcatggagttgaaaaatgaggacagatttttttttttttaatgttggggttaaaatctgtaggacttcctaacacactggatatacagaataaaaaaatcagagaagtccaagactagagatttatttttgtagagctgcctgggggatgaggttgccatgaatgaatatgaattaaatcagaagagagctaattacaaaagatttttacagcacagagttggggatgactagaaggtattacattcagtttgaacatgctgcttaatatgttttaggctataggcagctccagggcaaggcagggcatggagctctagcgacgacctgcagcatggcagatgaagccaacaatggataaatgcacccagggagggaccaggtgctgtggctcacgcctgtaatcctagcactttgggaggccaaggcaggcagatcacttgaggccaggagtctgagaccagcctggccaacatggtaaaaccctgtctctactaaaaatacaaaaaattagcgaggcatgttgtcccagttacttgtggggctgaggcaggataattgcttgaaactgggaggcgaaggttgcagtgagcccgagatcacaccactgcactccagcctggggcaacaggtaagatctgtcttaaaataattccttctagctcatgtttctttttttcccctgaggatggaggtgtactttttttgacctatactttttctctgaaaaaaaaatagccattcatggaacatttcacactttcatataacaattacgtaactgtgattaacatggttaatcaccgtttatgtactttggataatcggtttggataattattcagacccagagaattcttgagcaaggggagaccttaacagtcaagtccagggcctctttttttttttttttttccagagcgggaaacagaggttcaaaataggaaagtgatttgttcaggttcagacagccagtttgttggcatccttgacatcacttccctgactagctcttccctttttaactctctggcttctttactgtgcccagttaggccacgtggacatctccccagccatgtccttggcccacgccatccctgggtgcttgccttttttttttttttttaagaaacttgtcttggtcattccacacattggtatatgtgagcagctatgacttggaagtgtttttgcaaacacgtggaaaaggaagatgaccctctgaccctctgatgtgcctttagatgtggcacgcacagtaagttcggtatgacagcccaagatgtacgagggggcactgcggccgccctggttctccaggcaactgccgctctcgggtggtaatgacctctggacaaacctacacaagtggtggttctcaaagagtagatcacacgctggtcaacacgtgactaaactcaaccaggacttccaaggcccaagaagagatgttcctggtgtagggtatactcttttaaaacaacttaggctctttgatagtggaagcattgtttaattagaagagagaaactaccccatctctatattgagtcctatggagtttgtcacttatcataattttttttcctttttgcaaattttaagagatagtgccttggtgtcttaagtctgatccctgacaattacagcttcagtctctgtgataagggtggctctgtagagaatatcttacgggttacaggaggctatacagatgtctaccattgtacatccacactgtgtctcctctaattgaccatgaacacctagaaggcaggggttgagtctccactatcttgagcacttagcccagtgtctgacaaatcacacatgctcaacatgtttttcctgaagttggcaagaattctctccttgggaagaacctatccaagatattatttataaaaataagtgtcataattttctctttgtatcttctccagtctctcattcttcctgcctgtctcctttgctgtattacagggtatagaaggaattagggattgacaggagcaaaggacagactcaaaacagtgcctggcatgtggtgtaacctcagtcatgtttcttgtataaaatagtgacagatccatcacctttaccatcttctgcctaatgggactgaaaatattcaactttatttggagtaaataccattcactctgtttgtgatgaagaactcggagactcaggcagtccaggcaagctgtccaagatccagaatccaggggctgctcggcaactcagccaccttgtccagctaagcagccgacctaggacattcattttgtatccctgctgagtggtcacataagcctctatgttcaagaggcctgactgaatcagaattattaacaagtataaaatgtggagacgtcacatggtatggtggttataggcagctgttttaaagacaggcagacctgagtttagggcttgattctaccacttgctcattttgatgaattgatgtaaattatatatgagcttacattttaattttttcttcggcaaaatggtatctcaatatgtaccttgtggagttattttgaacattaaatgagatacgtaaagtacctagtatagcacctactatataatacatgtccactaaagagtagtaatgatagtaatagtagctattattatcatctcctgtcttcgctcaatacaggggtttaagtatatattaaatgaatgtttataatagttacgatgaagctctgtgaaatactcggaagccaaacagaatcaagtgataattgaatgctgaccctgagcaactcactgatagatgccgtgggggaagtacaaagagttataaggtaagaagaactcatggtatcactgagcacagatcatactgagtaatatactgagcaaagaacataagtgtctaacaacatcacgccctttaaaaagaaaatacccaagacatcaaaaagcactcagcccatcaaaaattaccatagaatagagcagggccagcttggcctggtttgaggcatctttgtacagtgtgatttggatttcacagaatagataaggccacttagggcagagagaaggccacagaaaagcatgcagaggcgctggttatctcagcctagggacaccgcactattcaatctttttgttatgtggtgacaaacaccagtgctttattaactagaacctccaaccacccaggtacccctcaaaccagtggtgtccatcacttcctatggtccacaggcccttcctaaggaaaactgcccagcccgcagtcctcctgatggggtcactgggatggtccgactttgtaccatgaggcaacgctcctgcccctccaggttaaaaagacagagaggggtatctcccagccaatccagccgcctctgtctgccaggacaaatccatgtgccagaccaattacaaatcctgtccagggctctaaacaaacatgaaccccgtggatcatgctggctgactggtcgttaagatagggtctggagagaccagagtaagccaacaatgcgagtgagaagaggacatcagcactggtgattctcccgagaggagatgccatgagggaggcaccacgcctaggactgcctcattttctgccatctcctcacgttctaactccaggtatcccaattaccacttccttcactatggagattcatgtggcatttctgttctttgcaaccaagatcttttttttttgtccagttatactggtgacaaaagatacaattttgaaacaattgcattaatttgataaattatacaatttgataaattgataaaatttgatacaattttgagaaataataatagtagaaagggctttgatttgggtgttaatcagagtttccgtgagtgtgttttatcaaaagctcaaatttctgtttcgcagacagaagtccttcataaatggttcaaatgtaaacttttttactaccctgtagattcagtccataccatattgagacttgcattctaacagtaacagctgaatttctatgcattttatggaattagtgaattatttactggtaaccttaaagagttagagcttgagtttaagcaacaagaaaccatctgtaccagacagagcaaagcaggcaagagtaagaaaatgtttcataaacatgagtttgctctaaatagcagaagttttagtgttgtaggcaacgttagtgcataattcattttccgtgccttgttgctttctgtctggctggctttttctgaggtctgtgcccagccaaaaaaagagaaatccatttgtgggttccatgagagagaagtgataagattgataaacagatgcatttctatttcatgtggttggccattcctttcagttatattattaactgacccacctccctcagatctttgaaatgctttttaatctggtctcctgataaaccctaaggccaagtggctctcggaatttggagagaacagtttttcctccctgtcctgactatggcatttaagataaagagcaaatagtgccatgtgattaaacgatatatgtaaccttgaaaacttgccatagtggtttcagtgtcatttactcatacatcctaagcactgctagaaagtccagtgataaaggattccttcatttaattctagggaacagtcaagcaagagcccacaaaagaaatggacaccataagaagataccattatgttagtgcattgactgtaaaaaggatggcattcaactaagaggagcaacattttgatggaatttcaggcactataataaagtgaagaatcctgacattgtggtgggagtgacacttttgtggtgggagtgatgctttcgtggtgagggaagggaggtaggggggctttctgaagtccaataaatgacaccaggtgtattagtccgttttcacactactgatagagacatacctgagactaagtaatttatacaggaaaaaggtttaatggactcacagttccacatggctcgggaggcctcacaatcatggcagaaggcaaggaggagcaagtcatgtcttacatggacggcaacaggcaaagagagagagagcttgtgtagggaaactcccccttataaaaccatcagatcctgtgagacgtattcactatcatgagaacagcacgggaaagaactgccctcgtgattcaattacctcccaccaggttcctcccacaacacgtgggaattcaagatgagatttgggtgcggacacagccaaaccatatcgctaggtaagcactgtcttctctaggcacaacaatggcctgctggacctcagataccactttgacagtgggcagactttgagatctctccagggcctaaagcctgtttgtgtgtggtggtgggagtccagctgtgaacaagaagggtcttccaaaggagccagctgtggtagaagcttcccttttaggccagtatcttcctagggattggagttcagggggctttggacaactgtggaaaaaactgtcggggagtatgtattatgcaatcagggtccacttctggaagacccagttccacaatgtagggcttagctcttcagcaggggctgcctgagtcaaaagataagtcccagaggaaggtagcaagactatcctgaggacctcttaggccacccgcaggtccagagatatcccactggtgctggccagagcatggttctactctgcagttgtgttgatatatgctgatcagccagacacacagcaggatgctttcccacacatcctaggagactggtttcccaccctgggactcaggtctgggagacctctgttaataaaactcttcatgatcctttctctatttgcactgttacagaaaagttgaccctcaaagcagtgggaatgaagtcttcggaggaagggcaggcaggtcttggcagtttccctttggcttgttggtgtctttctgctgaagcgtgtgctgaactgtgggccatgctctcctgggtatctttctagtagaagcctcccagcaggttcaggcccaggactgaagccaggggtaacagctggcttcatccagaactgtcaatgacaccctccaaagtccccatggcaccttcttaatgaggagctctgcctagacccacagtttgataaaacctggaaatccagcagggaggggcctgtccctggagggtttgtggtagaaacagcaatggcagtggacagcatttactgctcactccctgtgcacctgagtttgtaaccatcgtggccttcagcagagagaggcagagaagcccaagggaaaccacacactcaggacctgctgcccttcttccaaagactgttcctactgctgttggatccctcctccctgtaacaatggaaacacaggaaggtggggaagggttttgctactgatggtcccccagagctgagtcacaggcaagaaactgccacctcatacagagctcctctgaatccccacaaccacccacacattggttctgtgattacacccagtttacaggtggacaaagggagtgtcagacagtgcaagaatctgccaaggtcataaggtgaagatgggttacacctaggatttcaatccccaaagtgtgaagcacagtgtctagcaaaggatagctgctcattgaagagatctgaatgagaagaaatgcagacatggatgtggtgatgccatccttagcagagcccactctaagccagaagcgtcaaggctgccggctgggacgtcaagtcgatggtgattttggggaccctgtcctggggctgcttcgtcctccatagggacagcacatctccttttacttacccccatggctttagaggggaagcaccaggcttgtggttcccaaactgggaaagaaaagtggagaaagccagttcctccttcctaagatatagatcaggactgtggggcagttaacaaaactgagtgagtggccaggctggaagtgagagtggagtcactaacaacctgacaagctgtgtggaagggaacgtcttcaagtctttatctgttgaactaagtgtcgacactcctcccctgctgaaccccaaacacatctaacctgcttcctcctcctcctggaagcctttcctgaattcctatccaccaagaagggatttccactttctctgagcacccacattcctactacctgtgctggtctcaggatattttaggaaaactaaagatctttggttctcaatcctggctgcaggctagagtccactagagaaatgctcatttaatgaaaagtacttatgctcaggcaaaccacagaacaactaagtcagaatctctgaggcattcattccttcatttattttgagacagggtctcactctgtcgcccaggctggagtgcagtggtacaatcgtagcttaatgcagccttgaccttctggactcccctcacctcagccttccaagtagctgcaactacaggcgtgcaccatcacgcctggctaatttttgtatttttagcacagacagcgtctccatatgttgctcaggctgatcttaaactcctgaactcaagtgatcctcccacctcggcctcccaccaagtgctgggattacaggcatgagccagcacacctggcctacgagtcagcatttttaaaaggcagccaagattgagagcattggctgtgtcaccttggggtctgagcatgtccttttctcccaccttgctgagctgcccaagggtaaggtccagctgtgggcagtgctcagcaccgagcccaggcctgcacaatgtcagggctcatcaaacctatgctgagcaactgcaccctcgccttgaaacctaaacaatccctggtgggacacaggcacgggttttgcttttttgtgtgtgaggtaagagtcatatgtgtgtcatcctctgatttgggcaacccaagaacatgagtgccaaagaaaataatccacccccactacccctaacatcccaagggaggaacaggtatccattatctcctgcttttaattaaggagccgtcagccagattcttttgtgtgactgagtcccaagccttgtacatggcacactttcaattatttatctaaacaaaggtgagccagagggcagcattaaacactcgcctggtaaacttgagcccaactctgagcccttggaattctcaagctaacatgttttggctttgtggatctaatttcctccccctccccccgcaaaaaaaaaggcacagcagatacaaagtcataaattccattgcagaaaggcaaagcatgtcagagcggagctttaagagcgctgtgcttgtcgactgatggtgattctgttgctaggccacttaaatcaaacagtcctcactcactggcaaggagggaggcctgctgcaacccttctagttttgcagtctctcctatcaaaggatgcatacgttctagatcactaacgcataataaatccccttacaaaggaacagtgaccaacaaacggcaatccacgatcatggccagaggaaaggctgtctcctattcaaagacaggcttcctggcatgcaatcacacaaatgtgctcaactgtttttcttcttcctgggggtgggcctgtgcctgttccctcaaaggacaggcctgtgatgcagatgtgacacagcccactgtgacatgaggacagctggaggccagggagtgagcaatgaaaactgttcatgtggaaatccagtccccattccctagccattaagtgtcttaggcagcgagctagaaatctggggacagttccgctggacatcaggatacctgggtgtaacagcagctaccatttacgtagtgcatgttatggagccgatcaacctgccgagtgctctgaactgtggtatcacagagggcattatgctactttacagaccaggaaactgaggtttagagaggttaggcaacatggcctggtcacacaacctgtaagtgacagggttgaaattggaggccagatctgccttactccaagcctgggttcctaattatgctatatgtacaacctctttagtcccaggactgacacttggaaatgtttccagtctgcctcccttctccatccctgctacaacctaccttcgttcagacctctaaatggctcatcctcaccatttttatggcttcctaatttacttttctgcctccaatcttgtttcctattccatcaagtgcagatatttaaaatatatatgtattttctatcctattaatataatttcttggctcccatcacctctaagtcaagttcaaattcttttgcaaagtacaacaggccccacttcacttcttcaggactttatcttcccatcatgacccagtcacataccaaatgtctacatgttcctggacaggccctcatcttcacaccttactctccacctatgggtacaactcagaagatccctttgtaagacattgctgtctcctcctttagcccatttgtttacgtgtttgtctttccatcccggctgtgaactcctagaaggcaggaggcttgccttgttcatctttatcatttccccaggatctggccgaaagtgagcgctgaatgtgttaatcgccaactcactcactgcctgagtgaacagaatctcaaaactggaggaaaaaatgatcaaacatcattgagtttttgacaactaaatatacatacatagggtctctgtgtaagtcatctcatcttcacaatctccatgctatagctttatatcttctattaatctttgtgataatccccaagaaaatagattttttaaattacactctagctatacacattttcttgacattgtaatctaggtttattccacccaaaagtattttcctcagtaaagatttactattattgttagtagtatctgatcctagaatgtcttcctttttttttttttttttaaagcccagatgcaattttcttgagtaactgaaaattctggttgaccacaagtgtccttatttgtttaaattaagagcttgtgcctatatttatacacatcctggatttaggatagatgctaaatccactgacagtgtctttgtgagagacagaaaaggacatggaaaaggctgagaaataaagatgggggcagagatcggagcaatgcacctataaataagtgaccaacaaattaaagtggatgtgccttagaagtcctagacagtacattttgcatggcaaatgctctcatgttaacctgctggagtctgcgatgtcctcctgcctccacatgtgaaatgaaacttatctaaattctgcccacccttcagattttatattgatttcctcctcctctttgatgccttctctggctctctaagccaagcacacagcgacctcctctccccctgaacttccatggcatttgctttctgtgccatttggcctcatgaaggtcacaggtagcaaatcacagcagagaggacactgccatgggaggcaaaaaaaccccaagagtccaaacctgggccatacccctgccatcacacaaatgcatcatggggccctgggtggtggattcacttctctgcacccttgcttccttactgcaaagtgagggagttagactacttggatttcatggcctctaagcttccaactctaaaatttgataaaaatgataaatatcttgataacatttgaaagctccccagtggggtggagggaggagtggaaaagtatagaactttgggccacattcaaaccatttatagttgaaaacagtgactactgtgttcctcttcctttgccaaaggaccacatgatggcatcctcaaacttaacatgaaaccaagagataccccagcaggaccagggacgccatccttgagcctgaggccacaggcttattaactaacctgtgaaatgttcatcatgataaagttgggtgattgcaattgtatacacagaattacacacagaggaaaaccacttaaacattccattctgtcataatcaacccatatgaattcagattagccactgaatatcccccagaatgtaaaaaatagatgctaaaatttgattcctctaaggatgagctttaaactccaagcaatttggcaagagaaagggagacttggagaaccagcacttttcttactgtgttacacaatttcatatcttctaaaataatttataaagacatgttaaaattggaacaaaatagtcatttagtataaaagataaatatagcagaaatttaggctaaagagcttctacagttaaacactacatttagggctcattttcctggcagctaagcccaaagagggagataagataagttcatgcttacacaggtttgtatagggggtaagaaacttactaaagggatgttcaccagtcagaatcttaaacagaaatagaaggcacactaaaattagggtaatttaaagaagggttgtttacaagggaactaaagtacaaatatgtgggcagggtgttgggaaccatggcggcaggtgcaggaactcagggctgaccacagcggagctgggtgggttgaacagtgtctccccattcacatatacccaggaacctcagaatgtggtcttatttgggaatagcgtctttgaagatgtaaataagaattgggatgagataattattggattaggatggaccctaaatcaataacagtgtctttgtgagagacaaagaaaggacacagagacatggagaaggtggtcacgtaaagatggaggcagagattggagtgacacatctgcaagcaaagaaatgccaaggattgtcacaaccatggcaagctaggacagaggcatggaccagtttctccctctggagcctccagaaggaaccaaccctgaggatacctaggtttcagatttgtggtctcctggcctgtaagagagagcaggcttttgttattttaagtcactcagtttgtggccatttgttatagaagcccaagaaaactaagacaccacttcacttgctaaaggaatgaagggagggagaggtaaccaaccccagcagaagaaaacactgtgctgggcagaccactttcagatgagcaaagaccttcggtcaaaggatagagcccatctgtaagaaccttgtaaaaatggagcctgatatacctgtgtcccaacctcaatctctttccttcctctctccagtctccacctatgggtccctcactggctactcccaacaggaagccaggggcaggggagccctactgacatggtgcacccagaccagcctcctggggtggagaggagcagatagaagagtggaaagtgtgtttctatctggatggagcaaacaaaagattaaatttacaactatcacctctgggacaataaaactggaaagtatcaacctaaatttttgcttcccataaagtgactattagtctccccagatatagaagatgttgaagtcccattctctgtcctgtactgggtcttcttttcctccaatcttaagcctctctttcagcccctctactctttccttctgtctccatgctcagccttcatggtggcatttactgtaagtgccagttcccacatctactgtagcctaacctcttactccagcccaagtcccattttccaatgacccctggaaatattcaccaagatacctcacactgttcaaagtcaaaacatctgaaaatcaaccatatcttctttccaaaaccaacatcctccttgcaattgctcatctcattcccctaaaccatccaggattcagccctccatttcattcactctaccaaagatcaagccctgtcagttttaacatgctgcttctcacctatgtctctccatttctacaactgccactacctgtgtcgaggtcacatcccatccatgcccagaataatggcaaataagctctgagctggtggtctcactggagcttcccagctctcccaactttgccatagccaaggcaatatgaccttcctcatgccatgcccagggtgacattgttcaatgattccttctgcctcatgttcttccttgtcagatccgccaccctctgtctggcttctgaggatcttcagcttctgactctgtacttgtccaacccacttccagaaagtgttgatgagaattgtgctgtggctgtttcctttgctgtccccatcctcatgctgtgcttatgcctgtccctttgtcacatgagagtagttacctaaatctcaggtaccagggtccaccatgaaaccaaatgaactgaaagcatttgttaaaaatctcaccttctaacaatatatgcagtcaacatttcctttgtgattaacagtaagtatatacctgatcataaacctttacatctttccctgtatccttattttcaagattaatttgcaagcagtgtgttatgttaattaggtttttttcctctttcttttccttttttttttttgagatggcatctccctctgtcaccaggctgaagggcagtggcacgatctcacctcactgcaaccttcgcctcccgggttcaagtgattcccctgcctcagcctcttgagtagctgggagtacagggaagcaagcaccacacccagctaaattttttatattttagtagagatggggtttcaccgtgtcggccaggatgatctcaatctctggacctcatgatccgcccgcctcggcctcccaaagtgctgggattacaggcatgagccactgcgccccgccgttaattagtacttctcttggacaaagacaatatagtacagtgactaagagctttggctttggagtcagaccagagttagaattccagttttatcatctgctaaatggcaatttgaaacttgcctcactgggtgtggtggctcacgcctgtaatcccagaactttgggaggccgaggcaggtggataatttgaggtcaggagtgagaccagcccagccaaaatggtgaaaccctgtctctactaaaaatacaaaaaattagccagatatggtggcacatgcctgtagtcccagttacccaggaggctgaggcaggaggatgacttgagtccgggaggcagaggttgcagtgtactgagattacaccactatactctagcctgggcaaaagagtgagactctgtctcacaaaaaaaagaaaagtaaaaaaagaaaaagaaactaccccataatgttcttgtaaaagcatgaagagataacttatgtaaaatggtttagcacagtacacacatagagttacgcttttttttttttttttttttttgaggcagggtcttactctgtttcccaaggctgaagtgcagtagggccatcatggctcactgcagcctcgacctcctgggatcaagcaatcctctcacctcagcctcctgagtagctgggactattggcatgtgccaccacatacacggctcttaatataaacaatgaacggcaaggtcatgcaacttatattcaaggccaataagtgagtgcagtttttaatagtatgcagcccacagataagcagtttgttgctgggttgcattctatggtccctattctcatttaccttgtcttcttaaaggcaacatttttacttaatcatgctggttctgagagcaagcagaaataagctttgagactacagtttttcttaataaccaaacctggaatcagtgcttctgtggtcctcaaactctaatgtcctcgacagacagactgagaaactggccacagaaggcagtggctgccacaatatttccctatttatcaacattggtagttaactcctgggcattgcctaacaaagtcaaaagctaacaaaaggtctatgtaaaaatgcagatatgaataaaaatcatatatatacacataaatatatatatatacacacacacagtagctacaatggatagcaatctagtctgatcaagaattttaatgatactatctataaactgctatcatttaaccacaaaacaaaatcctggaaattatatttttattctgattgttgtgcattcatagatgcatgataaatactaggaaaatgttcatattgctattttgaatgtaatacaaggggataaaaaaggaaaaacaagaaacttggtccttaaccagaaaccctcaggggcacacactgaaacacaaattttggccacattttgaatctagcacatgtcttaagttgacagcagcacaccacataaaagaagaacttcagtgcccggtggaaacaagccatcttcatacaggagggaactggaaaacaactatttcatgtgcgccctgcactgaccttgaaatccagagggcttcttccctctaaaaagtatttttagatcgggctgatttactaaattactaaattactcattattaatgagctgggtgagaaaaggaataactatttaagcgacccaacatgttttcaaagcgatgtcatggggatggtctaaggggaaggccagggaggggagtggctgtgcacattttgttgtacaaggacaccaggctgccagaggcgagaagccagccaaaaaaacatcacggaacccaaacaccaagctgcactggtgctgggagttcaaattgtgaaatgtgagctatcatcatggcagatccaaataccgccaacactgggaaggccagctgcaaagaggaggaaacatcttttcctttgattgtgagagacaaatctatctgggtatctatttttcctgcaagtccattgatccttgctgctgtgtgaatggcagaggatgctggggccattagccatatttcactgtgtgcatgagttctgacagagggagcagggtgctatgtttattaggatttaatgatatttgcagttcagaattctgccacctctactgttgttatggaagctcattaactgagacattatcaattgtaagatgcaccattagtctttataatatgaataatttttaagttgcaaattgaacttttttttttttgagatggagttttgcccttgtcacccagactggagggcaatggcgtgatctcagctcactgcaacctctgcctcccaggttcaagtgattctcctgtctcagcgtctcaagtagctgggattataggtgcccgccaccacacccagctaatttttgtatttttagtagagacggggtttcaccatgttggccaggctggtcctgaactcctgacctcaggtgatccacctgcctcggcctcccaaagtgctgggattacaggcaggagccaccacacccggccagttgccaattcaactttcataaatgcttccttatcactaaaattcttccatattgattaaaatacattttttcctgattattgtatattgcatgcatgcataaagaaacatagactagttaagatggtcttaaaatgtctttgcatatggattctgattctcctgaatctctcttactgtcatcagctcctgagctttatcacaaaacactgtcctttataccatcaggagcatcggtggtgagagctaccagtcattagtaccagccccattcagctggctctggaaggacctagagcctatgtctgacccctgctctgagaatactgctgaagacaagggattcaccactccctaccagagtcctgtgtcttcaggactttctttccagcagctgaaaccctgacttcgtttttatgctgctatgtttgctgtttgtgcacttgcaagtactggcaactataccctaactggtgcctaactaactgccaataaaaacacattccaacttcagagatacaaagatacagaagacagagaagttcaagacgagcagtggagcactgatgatggcactaattgatggcatttaatcagaatgataacgattatgttctagttctagagaacttgacatattcagagctcctgaaaggcccttgcccacatcacactttagaacctcttgctccatcatcagtgaacaccagccttgaagagatccatttacagttgggctgagccaatcaaatttgcttaggaggtttgaaagttattttatggatacacagcagatgtacatattttcttacattcatataatgtgtaaagattaaatctgggtaagtgggatatccatcaccttaaacatttatctttccacgaggaacattcaaattattctgttctagcttctttgaaatgtacaatcgattattgctaattatagtcaccctgctgatctgtcaaacattaggtcttatttcttctaactgcatatttgtaaccattaaccaacctctcttcataagagattgatgtcatcagcaggctgttgtgagcacaactctacccactctatagctgatgtagccatttgggggaatccatgtaagttgaaaagcacaggaacatgatcaaaaagaggcaaaatggaacagactcggaatccatcgagagacagaacaggcatttcatgagacggagaaaatgaccttagcccttgatttccatttcttgttcacatgaggctcatgtatccttcattttttgtttttgggcttaatagttcctctgtagccatatgataaatcttctttttcacctgaggtagtttacacaagtttctacttccagcaatcgttaagagctacagtagcggtgtgatatggaaggaaggcaggaagggaagtgctgggaaaggtgtggtccctttaaatgataccaaagaagcgaagtgctgggtagagaagggtgtggtccctggctagggctccatccctgggcctgtgcccagggtctaattgacctggttaacacaagccacctatagatggcaaaactgaaagagcacatgatagcacatgcccactggggcttcaggagctgtaaacatctacccctagacacagccgtggggttggagccccacaacctgcccatctgtatgctcccctcaaggtttgagcagtggggcactgaagcaaagagcaacagtgcctgctgcatgccctgcaagggggtacaagggaacctttctaatttcagcaggagttagaaaccccactgccctcaactcatccattagaggaacagaattaaagaatgtgctggccacgtgccattccctgtatgacagacagagaggcacgaagtgctgagcgccttcctgtggtgctggcaggcccagggcaggaaagaccccatagtggggagtctccactctcagggactttctcagggtcctgctcttagaaacagcacactgtctgctagatgacatggagctggctggctgttgatgaggaaaagggtattattgagatatgtgtttagggaacaaatcccgggtaagacaaagagcaggcccacggctctcactggagggtgaagatgtgggaacatcagcacccctttcctcttacctcccactcagagcccatcctgcacccacagcctgagaaacctgggcaggagacatcagagcacctctacgacaggagggaaaaaagaaaatgagacttctttggaggatgtgtggttttcttaaagcagagggtgaggtttgtccatttaagaaaattgaaagagcccaggagcagtggctcatgcctgtaatcccagcactttgggaggcgggtggatcacttgaggtcaggagctcgagaccagcccagccaacatggcaaaaccccatctccactaaaaatacaaaaattagctgggtgtggtggcaggcacctgtagtcccagctactcgggaggctgaggcatgagaatcgcttgaaccggggaagcagagattgtagtgagcggagattgtgccactgcactctaacctgggtgacagagagactgtctcaaaaaaacaaaacaaaacaaaaaaattcaagaaagggcacaggtgcaggtgttgggaagaattagcgggaaagtaatccaggccccaaaggagggacaagtccaggtactgaggtgtctctcttgtctggctgtccaggaaaggacgcttttcaactgtatacttcctttgtggcaatttctcaggctgctcaggcctaacttcagtgtggaacttccgacaccacagtcaggtaagtctggaggcaggtggcaggacaggtggccagctcctagttccatcaaggaagacaggggtgatctgctgggtgggaacttttggtggcagagatagcccatgaatctcgaggtgacagagaagatagcttctggctatcctgaaaattagcaatggctacactttagagaaaacggggacgggcctggcaatggtaacattagagggcttatctcaagtagtgctttgtacctcatattagagacatggaaatgggggctcagtgctggagttcagactcatgtctgactggctccaagcctgtgctccttctgttatgcccggctgtctcccaggaagcagggggagagaagaccccctatgccacacttgggccatcacgggctagctactggaggaacaggggacttgcacagctctgctgatatgcagttcagcctgcagggaccccagtagccacaacgagaacagcagtatcatcaccatcttgcatggggccgtggctttactatcctttccaatgaaccctcatatacaccacaccatatgcctatcgcaaatttgtaaagtcagttcataagcccttcaagggagggaccaattctgcatcttttacatagcaacatttagattacaaagcctcatcccaaacagttacggatcccatattaccgatacgaaaattgaggctcaaagatgctggacctgaatcttttaccgtatccaatacactgatgctaaatcagtggcgtttaataagtgctgactgccatgcctggactcttggtagcgcccctgacacggctcctccatccgcacgtggccctcccagtgagtcattttgagagcggctgtcactctgctttaatctggcactttgttttcctgcagttcagccttccatgcagccaacaccagcaatctcacaagctagtctgacttggaaagccaccctgacattttcggctggcccagactccgaggttggagccctgtgcgtgtgagggtagctgctggcggggtgtttgttttctatggaatacagacttcctttggggaatttaggcatgctctcctgtttttttttttttctttcctttccttgaaaaaaaaaaaaaaaaggaggctacaattctaatctaagcggcatctgctgactttaaagagcaaacacttcatccttgccccagagtaccctttgccacgacacagaatgcctttccaatcactaaaacatcaaggagaagtcatcagtttcagcagacacattttaagtttttttttggccacaattccttaggtttttcagtggtcatcaataaacctctataattccgatttctgagtttcctgatcctagctcactttacgcctagaattacaataacccaaggggccaggttccgacacacatggttttacttttatgtttgcaaagctgagaagcaggaagctctgatgtttattttactttttaaatttatgcatgtttagctatctccaaagatgatataaggatatgtaaagtaatacataaaacacaagggaacagaagtaagaagtgcagaggtgcaacaacaagaagggtaggaagaaagaggagaactagaatgaggcccagagtagaaaatgtacacggttgcaacctacacgttctttgcgctgagccacacatctgtctgtaaagtttgctagctggcattgtagctacacaaataacagtcatgttttatttgaagagcaattgttcaggcataaacacaatgagtcttaaaaatagcatctatttattaaatgcctactatgtgccaggcatgtactaagcactgtctctacacccaggaggggggccacttctcctaagcatggccttcagctgcaatgtgtccataaatggtatcatttccaaatctgggttgagattctcctctgctcatgtcttctcagagttactatgttccaagtttctgagacctgaaacgcacgatattttgagtctatctttgagcagcagttcacctggattgtcacaagtccaaagtaatccttaagtttgatgaaaattaattaaatagtaagaaaaattattttggggcaataaacactaccttaaaagctctgctggctctatgttgctcccctctaactctcataaagtcatctttagagataggcaggggaggaggcagcagaggagacaggctgaggtgtcaggctaccttggttcatttcctgcctctgccactttccagctatgacttcaagaagttaatctccccgaacctcagttttcttatctgcaaaatgggcatagtaagaggatctactttacaggtttgaggagaggacaaaaggggtaatccaagtaaagctgaagaactgtgcttgccctattttgatgctcaagcaacatttgtgcttttacttttatttttttgagatggagtctcactctgtcgccaggctggagtgcagtggtgcgatctctgctcactgaaacctccgcctcctgggttcaagcgattcttttgctccagcctcctgaataactgggattgcatgcatgtcccaccacgcccagctaacttttgtatttttagtagagatggggtcttgccatgttggccagtctggtctcaaactcctgacctcaagtgatccacccgcctcagcctcccaaagtgctgggattacagtttgtttttttttttcttatcaactctggagagcaaagttgtccttatacatagataccatgatgccaaggaaaggggacaaggacacagactttcctcttcaaaaagacctctactttttcttccttgctaggaatgcaagtatctgcaacttttcattaaggctgggggataagaaagagccagtgaaaatgagaagggccagcaaatatgtcaagtggccgatagtagctgccagtgtttgttgttgcaacaggacctcgtggatggacgtgagtcattaacattccactgataggggcaaaacaatctgtgctgaaaaggaaagtccagggggtcactgcagtttatctttgtttacctcctgttatgactcatcttcagggtctgtttctcttcttaggagatgatttggctcattaccacggaccttcctggcttgctaactaagtttctatttaattggtttttacaacatgacctagttcctgagacttcagactcttggaaggcagaatgtggcaggagtgtaagatcacctgcacagcggccagaacatcacagcaaacacacaacacacaggtgagtgtctgcaagctgtccacaccactctctgccaggatagatagagcctttgtccaaattcaactttccactcagctcttccttggaaaacaccgggtaacctttcttatcactatctccagttcaggttatcttaaaataaaccaaatactgattaagctccccagggccagccagatcacttgtatatcacttcttcttccttgcagtttcccttaaaccacacaatatagaagcatggaagctaagagtgcacacttcttagtgtggcacagcaggtgggacaggtcattggaggtggaattctggtactacacaagttatttttgacttctgtgcttctattttctcatttttgaaaaatgggtgtagacaacattgctaaagcccttttgagaaaaagaagctaagaacagggcatcaaactggcttttattgattcacccatgaacaagttgtgcctttacactgttgttatttgtaaggaatcctgggtatttggcattcctggaatattctatttagctaccttggggtccaagttccctttaactgggggagaagaacttttcacctgtttctatgcatgctcacaaggataagcctccatgatggcaattttggctctgtttcagataaaaattcatttagtaacatataaaggatatcaagtcatgaaggcactacataaatgtaagtacagcttaagccagagctcactgactctccatctcattttcatctgccagcatcattggacccgaagtcatatggaagccacattttaagcctaagggtgtctaaattgatttgacaaagccatcagtcagttctatccctttcttcctagactcatttataagcaccacttaaaaccagatgccactagcagtgaggacacaaagcagcaagttttcagagcaccgagtttctccactggccattagcagttaggctggaagggggttcagagccacaactactgaaagtctcactccttgagtttggaagagataatgaacattttcctgaacattcaacaaacatggtcaagggggctggggattcccaagatcaaaagagggatctgtcacaagatcattatgtccagaattgttgggcacaggggtgtgctgtctcctatgtcactgtccgtggttctgaacccagctgggcaattctctgggaagttgggggcggaggaaacttgcacccattcctaggcccttggtgagtgtcctgagaaagaaggagatgatacattgtggactggggcataaaacagtgttaatcaacactttgtttccacccccatagcaggcacagtattcagtcagtttttacacacattttgatgttaaagtaatgattaagagaacaaagctggctgggcacagtggctcactcctgtaatcccaacactctgggaggccgaggctggcagatcacttgaagttaggagttcaagaccagcctggccaacctggtgaaaccccatctctactaaaattacaaaaattagccgggtgtgacgacgcacgtgcctgtaattctagctacttgggaggctgtggccgaaggatcacttgaacttgggaggcagaggttgcagtgagccaagaacaagccattcataaaataactataaacagaattctaaatcaattgtttgttaatggatcttctcttgtcatcatattcactgctgtcttcagctataactcatgttggctgtatgttaaacttggctattttctaatcagtgggcagatcaggaaaaggtagctccccttaaaatggcacagaagagtacatgcgacacgtggatgaagtggacattaagttacaaggagatgcttgcagcagacactattgggaacccacccacatcccctctgtcctcacactttccatgtttgtggggccaactgcccacagctggcctctgcatcactttgcctgaaggctttctctggctaccagagtctgcacacccgctggcagcctaaagtgagaaacaggaaagtgcctgggaactaatacctccctgggaacagccctgaaccaatgactgacagctcccttgccccaggctctaactttatatgattcccagagttcccagctggattaagctccagaaacccacagaagtaacttgcttctgaccactctactggctgacttccctgccttgtctcactttcccccaagtgctccttgggataacctcccaaataaacttcatgaacttaagtcgttgtctcagggtggtttccagggaaacccaaactaaaacccactaccgagtacacccatattataagccagctctgagagcaggccagtggcagacaaaatgggaccaggtaggctgttcctgggtctcagctgtggtccagctttttagcccctccacctttttagcccactcctggagtttcaccacagatcaaaaccagcttggaggttcctggacttacttagaaaagagcagtgctaagaagaataaaataaaagaggggggagaaaatgtttaggtactatgaggttgcacactaatatcacactaaatatgagaatgattgagccctctggatgccaagttacaactaatggaaattctgaatgagctagaaaattgtatcctgccacaaacatatggctttccagagtctttgttttaaaacttaaaaaaaatagcactcatttgcttgtcaaattgttagaatggtgtgaaaggatctctatcctttgtcagatgaatagattgcagaaattttctctcattttgtaggttgcctgttcactctgatgatagtttcttttgctgtgcagaagctctttagtttaattagatcccatttgtcaattttggcttttgttgccattgcttttggtgttttagacatgaagtatttgcccatgcctatgttctgaatggtattgcctaggttttcttctaggatttttatggttttaggtcttacatttaagtctgtagtccatcttgaattaatttttgtataaggtgtaaggaaggggttcagtttcagttttctgcatatagctagccagttttttccaactccatttattaaatagggaatcatttccctattgcttgtttttgtcaggcttgtcaaagatcggatggttgtagatgtgtggtgttatttctgaggcctctgctctgttccatttgtctatatatctgttttggtaccagtaccatgctgttttggttactgtagccttgtagtatagtttgaagtcaggcagcatgatgcctccagctttgttctttttgcttaggattgtcttggctatacaggctcttttttggttccgtatgaaatttaaagtagtttttttctaattctgtgaagaaagtcaatggtagcttggtagggatagcattgaatgtataaattactttgggcaatatggccattttcatgatattgattcttcctatccatgaggatggaatgtttttccatttgtttgtgttcttatttccttaagcattggtttgtagttcttcttgaagacgttcctttgcatcccttggtccgtcaacagagatgagttcttgggttaagttgaattcagcataggttatgttgacctctttgatttgacaatgaagcaatggtagtttttaagaaaaaaacccatctgttcagatgtttgctaagcaacttcttgcatggtgaacttttcaaatgaatgtcaaggtatgcatacaggaaaaggaaacgtgttgcagttttacatgctcatgtgcgcctgcacacacacatgccaattagctgacaaaacctacagaaggcaacaaagttgactctaagattcagaatatctgaagtcatgtttcctgacagtatatcatccatctgaaccatgtatatccaatttccataatgattttgagttgagctgaatttggctgattgccaaaatgagcattgttttcttctctgaaacatgttttttcaaaatcataagatcctgacactaaagacagacacaaattaacccaatttggcacaatgcctcctacctgcagcagtggatgtaattgggtgctgtgttgatacagtgatttttaaaaagttaatacatttttgttggttttcatcagtcacaaaataactataaagctatttattggaatgatattctctgaatgctgaaattctccagttacttaatccatctgtcctcatccctcagccagaagtgcagattttacagtcctaactggaatcattaaccctcactgccaataatctcttgtattatatatttgcattcaaatattgctttaacagtcgagatggctattttaagcaaacaagaatttttacaaagttgaaaattaagagccaaattctaaaaagcattacacccataaaaatcccccaactctgacacggagatttatcacaacagattttggatttatttcatgatttcaacacaactgtgttttcagtacagacttccctggttcttggttgtggtgacaataaagaaatgtatccatgagttacgtggattgcaggtgattctggattgaacacattctttgtttgttttttgtttttttttctttcttcaggaagcatttcccaaaacactgagcagagaattccagaaggactctgagaaaacacatggcctctgcagtcagcagcagatccaaggcctcttctgtggagtctgttccctcttcccacccacacatctctggatacttctgccagccatagattttccttctgtgtttacctcgtttgaggctcaggtgaaaaaccagatgacttacaaaggaatcagatatcgccattggccttttctcacaagccaaaacatcatgccactcgatctgtttttgtttgctttttaacatgaaaaaaatgcaggctgtgtagaatggaaaatttgtgagaaattctattgaaagagaaattcattgaacttggtggacatcgacaaaaaagtttagtcatacttattttctaaataataaactatactttggttgggtaagtttggaaaatgtaaagcatgaataaatgacacacattccttaatcctaattctcatatatgctgtttacattttattgtataatgcctatacacaataaacaaaatccaggctgtattctttatacgattttattccttgctttaatttgaattataaatcttttctattaaatattttgtgaacacaggaaattcattggctacattatattccatcagagggacaaaccatggcttaacttttctttttttttttttgtacatttgtataatctaaatttctatgctaatacatacaatcctttagtggacattgtttacatgaatcttggtaatttctttagtatatatcgtaagtcctcacttcacatcattgatgggttcttggaaatgacaacattaagtgaaacaacgtaagatgaaaccaattttaccatcggctaattgacataaagaagaggtaagtttctatagcatgtttctggtcacaaaaacatcaaacttctaagtaaagacctgaaatacttctaacattaaacattgaaataaatgtcagctatagacacatttaagaaaagttaataaaaacaagtaagataatcatgtacacaatttttggagaattagtgcgtgactgggatcatagtggtggtgggttaaatcaaggaataaatgtttgcaaagtaaaatttaaggagtgcctcctaccacaatacagttcaaaaacagtaacaaatactggaatacctgaagaaaccccatgaagacatggggagaatatgcagattctcacagtagccccagctgggaattaaatttttttcttggccgggcgcagtggctcacgcctgtaatcccagcactttgggaggccgaggcgggcgtatcatgaggtcaggagatcaagaccatcctggctaatatggtgaaacctcgtctctactaagaaaaatacaaaaaattagccgggcgtggtggcgggcgcctgtagtcccagctactcgggaggctgcaggaggagagtggtgtgaacccaggaggcggagcttgcagtgagcagagatcgcgccactgcactccagcctgggcaacagagtgagagactctgtttcaaaaaaaaaaaaaaaaaaaattctcaatgttataacgaaatgacattgaacaaaatgatattcaaaaacctgctgtactcctgaacaggacttagaagcttttgattgccaaatcactctccagaaagttccaccaatgactactcctataagcatgatgtaagcgtgtgtatcctcatgagcaatgagtgctgacttaaacatggacagttgaagaggggtgtattgagacttggtgcaggtacagaggtgggggtgagctacatttccagcttagagacaatggttgggcagagcccagtggtgggcaagctactgtgacagagagacagtgtgtgggttgatagggatacagcctttgaagtcaggcattctagattcaaaacctgggtctgtttcttactgggtaggtagtcttagacaagatgtttaatctttctgtatctcaatttcttcaactgtataacagtacctatctcaagatgtgaagttaaattagataatgcatataagatgcttaacagtgtctggctcacagcagtgagccagtgtctggttcactaaatagcagctatcattctattattgttgctataaaatataaattgtaataaccttataacgaattagcacttgattgtcaaggttatttcatgtaaatttatttcactttattttgaagacaatcatgagtaggtcagggttggataatgttaaacgcttggagattgagaaactgaagctaaaagaagtgaagcattctatggttcacaaagggtgagccaggataaagtttcagatcctgcatctcctccccctgggccctctgcactgcacaatgtcacatgtttgtgcagcacagccttctgcattggtgatgtgatactatgataagccctaagatatttgtacttctagatgtatttgatttaaagaaatctttctgtgactatctgaacttctccacccaggagcaaggtaacaatagtccagctcctttaccgaaacaagcctttatggctacaaacttttaaagcattattcaggccgggcttattgtctcacgcctgtaatcccagcactttgggaggccgaggcaggcagattgcttgaggtcaggagttcgagaccagcctgaccaacatcatgaaactgcgtttccactaaaaatataaaaattgccagacatggtggtacatgcccgtaatcccagttactagggaggctgaagcaggagaatcgcttgaacctaggaggcgaagtttgcagtgagccaagattgcgccactgcactacagcctgggtaacagagcaagatcctgtctcaaaaacaaaacaaaacaaaacgaaaaaccctattattcaaaagactatttatatttattttgcactttgttttgtgaaatttggaaaataaaattttaatttattgtaataaacatctgcaagatgtttcttgtaataaacctttgcattctatccttcaaccagaaggatagaaacaagaatttttcaaaacttgcaaagttcaataagtgtaaaagaaacatagataagtaaccttaaaattagggtaaccttgaaatttgcatttacttatttttttcattaccttttttaaagttccaagatacatgtgcgagatgtgcaggtttgttacataggtaaatgtgtgccatggtggtttgctgcacctattaacccatcacctaggtattaagacttgcatgcattagctatttatcctgatgctctcccacacccctcgataggccccagtatgtgctgttctcctccctgtgtccatgtgttctcactattcagctcctacttgtaagtgagaacatgtggtgtttggttttctgttcctgtgttagtttgctgaggataatggcttccagctccatccatgtccctgcaaactacatgatctcgttccttttaatggctgtatagtgtttcacagtggtatatgtaccacattttcttcatccagggttgattctgtgtctttgctattgtgaatggtgctgtaatgaacatacatgtgcatgtatctttataagagaatgatttatattcctttgggtacatacaccataatgggattgctaggtcaaatggtatttctggttctaggtctttgaggaatcatttcactgtcttccacaatggttgacctaatttacattcccaccaacagtgtgaaagcattcctctctttccacatccttgccagcatctgttatttcttgactttttaataattgctattctgactggcatgaaatggtatctcattgcggttttgatttgcctttctctaatgaccagtgatgttgagcttttgctcatatacttgttggccacataaatgtcttctgaaaagtgtctgtttcatgtctttgccaactttttaattagattttttttcctgtagattctggatattagatctttgtcagatggataggttgcaaaagttcctcgtagattctgaatattagaacttcgttagatggacagattgcaaaaattttctcctattctgtagattgtttattcactcatagttttgctgtgcagaaactccttagtttaattagatcccatttgtcaatttttgcttctgttgcagatgcttttgacatttttgtcatgaaatattttcctgtgcctatgtcctgaatggtattgctttgattttcttctagggtttttatagttttggggtttacatttaactctttaatccatcttgagttaatttttgtttaaggtgtaatgaaggggtccagtttcgattttctgcatatgactagccagttctctgaacaccattaattaaatagggaatcttttccccattgcttttgccagttttgtccaggagcagatggttgtagatgtgtggtcttatttctgagttttctattctgttccattggtctatgtgtctgtttttgtaccagtaccatgctgttttggttaatgtagccttgtagtatagtttgaagttgggtagtgtgatgcctccaagctttgttctttttgcttaagattgtcctggctatatgggattttggttctatatgaattttaaagtagtttttctggttctgtgaagaatgtcaatggtagcttgatgggaatagcattgaatttataaattgattttttgaagggtttttcgtgtatctatctccttcagttccactctgatcttgtttattttttgtcttctgctagctttggggtttgtttgcttttggtttcctagttcttttagttgtgatgttaggatgctgatttgagatttttttttttttttttggagatggaatctcactctgtcggcacggctggagtgcagtggcaccatctcggctcactgcaacctccgcctcctgggttcaagcaactctcctgcctcagcctcccaagtagctgggattacaggcacccaccactatgcctagctaattttctttatttttagtagagatgggatttcgccacattggccaggctggtctcgaactcctgacctcgtgattcacctgcctcagcctcccaaagtgctgggattacaggtgtgagccaccatgcccggccaattggagatctttttagccttttgatgtgggcatttagtgctataaaatttcctcttaacattactttagctgcattccagagattctggtatgttgtctgtttgttctcattggtttcaaagaacttctcgatttctgctttaatttcattatttacccaggagtcattcaggagcaggtttttcagtttccacttagttttgtggttttgagtgagtttcttactcttgagttctaatttgattgccctgtgatctgagagaatgtttttatgatttcagttcttttgcatttgccaaggagtgttttacttctgattatgtgatcaattttagaataagtaccaagtggtgctaagaagaatgcatattctattgttatggggtggagagttctgtagctatctaataggctcacttgatccagagctgagttcaagtccagaatctttgttaattttctctcgatgatctaatattgacagtggggtgttaaagtctcccactattattgtgtggaagtataagtctccttgtagttctctaagaacttgttttatgaatctgagtgctcctgtactgggtgcatatatatttaggatagcttttcttgttgaattgaaccctttaccattatgtaatgccctttgtctttttttctttttttatctctgttggtttgaagtctgttttatcagaaactaggattgcaaccctgttcttttcttctttccatttgcttggtaaatttttctccattattttgagcctacatgtgtctttgcacaggagatggatctcttgaacacagcacactaatgggtcttgactctctacccagcttgccattctgtgtctttttattggggcatttagctcatttacatttagggttaatattatgtgtgaatttgatcctgtcatgatgctagctggttattttgcagacttgttgacgtagttgcttcacagtgtcattggtctttgtacttcagtgtgattttgtagtaatgttttttcctttccatatttaatgcatccttcaggagctcttgcaagacaggccttgtggtgacaaattctctcaggatttgcttatctaaaaaatactttatttctccttccagtatgaagcttagtttggctggatatgaaaatctgggttggaaattcttttaaaaaggttgaatactggcccctaatctcttctggcttgtagggtttctgctgagagatccgctgttactctgatgggcttctcctgtaggtgacctagtgtttctctctggctcccctaacatttttttcctgcatttcaaccttggagaatctgtgattgtgtgtcgtggggttgatcttctcatggagtattttactggagttctctggatttcctgaattagaatgttggcctatcttgctaggttgaggaaattctcctggatgatatcctggagtatgttttccaacttggctctgttctccccttctctttcaggtaccccaatcagttgtaggttcagtcttttcacataatcccatagttcttagaggttgtgttcattccttttcattcttttctgtctgatcttgtctacctgtcttacttcaacaagatagtcttcaagctctaaaattctttcctctgtttggtctatttggctactgatacttgtgaagttctcatgttgtttttcagctccatcagatcatttatgttcccactaaactgcttattctggttaacagcttgtttaatgttttatcagggttcttagcttctttgcattgggttagaagatgctcctttagctcagtgaagttcgttattacccaccttctgaagcctacttctgtcagttcatccatctcagcctcagcccagttctgtgcccttgctggagaggagttgcaatcatttaaaggagaagaggcactctggatttttgttttcagcgtttttttgttgattttttctcaattttcatgagttcatcgagctttgatctttgaggctgctgacctttggatggggttcttgtggggacttttgttgatgctactgttgttattgctgtttgtttttaacagtcaagcccctcttccatagggatgctgacatttgctgggggttcactccagaccctatttgcctgggttcctcctgcacctggaggcatcaccaatgcaggctgcagaacagcaaagatggctgcttgctccttcctctgggagctccatcccagaggggcactgacctgatgccagtgggaatgctcctgtataaagtatcttgtgacctctgttgggggaggggttctcacccagtcaggagtcatgagatcagggacctgcttaacgaagcactctggctgcctcttggcggagggggtgtgctgcgctgaaggaaatctcacttgtctggactgcccagattcctcagagacagcaaggggaagagactaagtctgctgatccacaaagaccacggctgttccttcgcccaggggcatcgtcccagggagatcagagttctgtccgtaaacccctggctggagttgctgaaatccccacagggaggccctgcccggtgaggagagatgggtcagggtccagcccaaagaggcagtctggtcatgatctgccacagctgctgtgctgtgctgtggggaattcctcccaggtccaaaccacccaatctcccaggcactggcaggggaaaatggcagactggagctcagttgccttaggcagcaggcagtcgcaattatgatggccacctctctccccgggaacttgtagtcttaggcagtctacagccaagtggctatggagaatctgcacagctctgtgcttgggacccaaggccctggtggtgtgggctcatgaagggaactcctgatccacaggttgcacagatctgtggaaaaagcatggtttcctggggagggtagcaatgtcactcactgcctcccttggctgggggtggggtgggagctccccttgccctgtgtggctcctgagtgggtggtctctccaccctgttttcactcttcatgggtcacaccaaccacctagtcagtcccagtgagagaacctggtacctcagttgctggtgcaggattcactcacagttttagttcttctcagtgggagcctccaactgcagctgtttctggtcattgatcttggcccctcctagcccctggtggcattgaaatatctaaagtttttcaagcttaaaaccatatggatcttttggaaaaaactgtgctctcaaacctatactgtcttgaatgcatagggtcttgttctgaagttctcagacattagcaagtatcagaacaacttgaagggctcattaaaacaaagttctaggccccaatcccagagtttctgagttagtggctatacagtaaggatcaagaatctgcatttctatgacgttcccaggtgatgctgatgctgctgttctagtttgagaatcacaggtctacagccaccctttccccttgtggattctgtgtgtttataatctagtaagttgagatggatgggcctgactgaggcccactggcagagaagaggcaccaggtggccaaagaagacagccccatggggagaggaagtctggagtcaaggtgggtgttggcagcactcagaactttctgttcattatggctcatgagttctcaactgaaaaaaaaaatgctaaaagatggcaggatctataacattgagttgtgaagtaggtgatgccacttataattcctttaatatttagatcgcctcaatacccatgtataattctgggttggtcacatcactgcttttctgacatttttacactctcctcctgccttcttgaacctcactctaaagttcatcatcttcattcattcacttttaattccatggcacctacaggacatgccattatctctcagaaactgagcactctttccctcctgtacactgataagatatctgctcccctttatatgatcccaactgttctgaaaaaggcacaagcattcacatgtgactatgtaaagatgttcataaaattgacagagcttctgtaattctctggaaaatctggctttagctatgatttaaggcataataaaggaacaaacaacaaaaacagtgataaacacatacaaatgaatttccttacacaccacatccccattgttctcagatagttttcttaaatatcttattaatcaatactattaggaaagctatcgtcttcaacaataactattttgacatcttaatactggatctatactatttcttaaattatttatgatgttttttcaaatataatatttaataggatgttttatgacaatgagcaaacttttccatttagaccaagtcagttatctaagtggtggccctgaattgaggagtttaaacttgctaaagtaaaataccaaaaactcagttggagcatcccctagaaagggctgtattttcaaatacatctgagtactccatgtttttccagcataacaatggatcacagagtgagctgaatgatctgatattccccaaatcagcttgttggccatgcgattaccaaaactgaatgagaactcccaacattgagaagaaatgacccagacactggaaatcctgcctcatcaataccccaagccagtgtgaaagatgagaagagacacatacaagataaaaacacaaaccaaatttactttcaaccacatgtgatctttttttcctcttctccaacagtcttatgggctatcaaagcaagtctcttattagaaagaataacagaaacaaatgtgagagaggagccaaaaaaaattttgtccccaggaacaaaaattatgagacacctactatgaatttcagaagcactttgggaggctgaggcaggaggattgcttgagcccaagaattcaagaccagcctgggcaacacagcgagatcctatctctacaaaaaatttaaaaattagcttggcatggaggtacatgtctttcgtcccagataattgagaggctgaggcggatcacttgagcccaggaagttgaggctgcagtgagctgtggtcctgccactgcactccagcctgggcgacaaagaaaccctgtctcaaaaacaaaacatatacacatatgctcctgcaagcctacagatcattcactcaactgtaggggattctaggaataagtgctttctagaatctacaaatgggggtgggaaaggtactcaagaccgaaacaagtagaagcatcaactattgtgaagatcagcctcaatttaaagggacccaaggcatcgcttttcaccttggtccctaaaatgaccatgtatcacaacaattgagtttacttgcaacacgtatttccctatcatttccatgtccactggacaccaaataaacatactcatgaccgtctatgtatctctacatttaatgttcttactttttttttgagacacagtctcactctgttgcccaggctggagggcaatggcatgatctctgttcactgcaacctctgtctcctggattcaagcaatcctcctgcctcagcttcccaaaatagctggaaatacagctgatttttgtatttttagtagagatggggttttgtcatgttgccaggctgatctcgaacttctaacttaggtgatctgcctgtctcagcctcccaaaatgctgggattataggcatgagccactgcacccagccacattgcctctttatatggagaatgtctagaaggcaggacctgtgttgataaacgtggtttgcctcgcattaaactgactccttccagccacagcactaggcaatgtggacctgtaccaatagcttgcttcacctacaaggccgctggctgtgaaggctactggtgttatgctttgaagactagcttgggcaggaagagacaggaattaacatttactgagtatcaataatttgcctcccattttctcatatgttgtcccatgtcatcctcaaaatcctatgatgttacccactccacagactgaagaaacattcttgcagatgttacagctaattaacttggattaattataatgatgacaatctcccttccatgcctgctatctgattccaaagttcatgttctttctaccacgtgaagtcactttggaattcaaaatacggagatttcaaattaatctttcctcctgaaaacaattatatacaataaaattgttctggaggctatctaggccttgtccttttttactgaatcccatcaatggtacacaggactgctgcatctgcctgggaattgtgacctcctgcctggcagttcaccaatggccacaggctttagaacctctcacggagtatggagagtgaggaaccagaatgagaaggtcaacataaaagcaaagtattgcatttgattatttccttttcataatattttgaaaccttgatcctaagttctcttttttccccctcttcaagctattcttggcttttatttcattatagttaatatatgttcaaacaaaatctttagaaacaaaacaaagtagatcgcaactagaaatcacatttattctgaacacaaaagttcaagacttcatgttagaattttgttagtttaaaattaaatgctagtgatattagaggtaagtgtaaacaattttccatcactcccgattatgaatctgcatttgtcttttgaaatagacgaaaattgaaacttaagccaaggtaaactttgttagaaaacttaaaatagcttcactaaattctcccataaaaggccagttatttataaaaatagagattataaagagaacactttttcttgtatttttagtgcatacttttcaaaattttatattcacatatacataccaactttgactatgtataactcttatgttagaaatatgtaaagaaaataatgtaaatagttttaactttattcatatataaagcattttattgtgaataaaatacacatagaaactagcacagaagctatatattcattataacaaacgtttatcaagacctgtgtaagtatcatccacgttaaaaacagaccttcatgagcaccccaaaattcctcccctgtaccatgcattaattcacaattgttattttctttaaattgttttgcttatacagaaagatcatcttggttgtgatatccaagttactcaggtgatccacatatatcaatgctgtatgtgcatataatttatatattcatatgtatacaatatgcgtgaaaacacatttatccgtttatctaaataagcacaaatgtacttcataatggcaatcaccaagtgtttctactatcatatgtcctgtgctctgtgtttccataaacctgagatgacccatttcattgagagattccaaagaaaaaaattgacttggagaatccccataaccaccctgttcctccttttcaaaagtgttcgattccgccttagtgatctatacatggaagactatagattactaagatgttggctaatgataatgttggctaatgataaatgaatgtttgactctatcttagaaatagtttggttagtcatacattcctagaagtctaccgacctcaaaataacacacctataacttcggtatcatgtactaaaacctttgctagaattttaaaagttgaaaatcaaagtaaaaatgtattgaatcccaaatctgtaaggccctgaggtttttgtcttgtccttaatattttaaaacacatgctgactttaaaataagtgggatattattaaaagcatgaagaatatagaagtcagccatacacctaaccagccaggcctttgggctgtaatattacataacaacctgcatctgaatttgatcctctgtctgagaggggcttcctggtccagtgcctcccctacttttgggtacattgcttcaaagcagtgattctcacagtgtggtctctagcatcagcatcatctggaaacttgttagaaatgcaaaagttttggctccacccaagacctatgagatcaggaactctggaggtggggccagcaggctgtgttttcacaagctgtccaggtcatttctgatgtccactgtagagaatgaggctccatctagattgtttggttccagaaggagaacttctggccccagatctagagctgcgtagcctggaattcacagcctgtacattttctgtctcccaataacagaccatgcatatagaaatgctctcttgagcatgaggagggaaggataaaagtagtaataagtaatggtgccaaggcttagaagaaaaaacagaacaaaactcattttccctcatttttaattcccaaattgaaaactatcattactgacttttagagaggcaaataaaatgttacacgatagctccttcacaccagtttcgaatccccaatttccccaaataatatctcaagtctatataacagaaagacttgtgaaaactgcactaaaatgtctttgatcttagacgaggcattcagcatgctgtagttctgccttcagcagtaatgagattgacagcatcatgaagccttgatgctggaaagataaacgttgagactgtcaacgctggtgagctgagactgtgctggaggcttgacaagaagatggtattcagtaagcatggacttactgaaggggaggcactttttgataatttcctcagtagtaattatagaaatccaaattaaaaacacagtgaattatttcacaccaagactggcagaaatgtaaaagcccggcattaccgggtgttagtgaacgtagagaggaacagaaattctcatactctgctgttgcaagtgaaaattagcataatcaccatgaaaagtaacatgcaatgcatagccaaggtcaaagtgtgcacactacccctggcagctccagtctgaagtatgggaggggatgggaaaactgagaaattcaagtatatgagtgtaaggtcactgtagcaatgctcttaatagctgaaaaatttggaagcaacccaaatgttcaacagaatatgtaaattatgacatactcatacagagaaatattacatgtattaaacaatgtaaagcattaaaatgttgtacaagaataggtacagtcatgataccatttatgtcaaagattaaatacttgaaaaacagtatttattgctaagaaaaacgtacatatataaggacatttatcagaaataataaaatcaagatttaggatagtgtgtactctttttttcctaaggaaaagtctatgttgcccaagctggtcttgaacagctgagctcaagcaatcctcccgccttggcttcccaaagtgtttggattacaggcacaagccacggtgcctggctggtgtgtaattctatgaggaggagaaagaaacaaaggcttcaattttgtttgtaatgtttcattttcttttcagatgaatataaagtatttttatgatattctttaacatttgtaaaggtctgaaataattcattaaaaaaccataataggttttgagtctagagagataggaatctcaattctagctcttactaatagtgaaactttgatcaaatcgatctttatgagcttccgtcttctcatctggtgtgcaagagtctgacggtgtgccatctgcgaggtgcccagcatccgcatagagcctggacagctcatggcaggcactcaggccatctgcatatcatttccctgggctctctctcctcctcctctcctttttccacaccatgagcaccaccctccagctcttccttcaatgactcactcctccaaattctgcagcatgtgcatgagacgggcttgtatttggaaataccgaagacaatttcaaaaagatttctatgttcaaaggaagagaaggttgtcttgggctgggaaaatgtcgactttcccagaaaaacaaaagtaagaataagaaagtgccaggggaactgcaacttggcaatggtcatagtgtacatgacaaataagaacgaccaatgcaacagccatgaaaacaacacgtattcaacaggcatctccatttcttgacactaagtcaagaaaataaaggaacatttggctgggcgcaatggctgacatctgtaatctctgcactctaggaggccgaggtgggcagatcacgagggtaggagatggagaccatcctggccaacatggtgaaaccccatctctactaaaaatgcaaaaaaacattagctgggcttggtggcatgcaccagtaatcccagctactcgggaggctgaggcaggagaatcgcttgatcttgggaggcagaggttgcagtgagcagagattgtgccactgcactccagactggcaacagagtgagactctgtctcaaaaaaaaaaaaaaaaaatggatgtttttcatgtttctgctcacatataaactagaaaaagcaaagttaatgcttagcatacagcccctgggtatattcaggagacctctgatcttatcagctaaagacttaagaactatcttttgggctggggtttttcaatccattttatgatagttctgatctgttttcaagactaccactttctaatcttgtctctaaatttcaaactcagattctggagtcgtctatcatatttacagtctctgtagaataatgccagccaaagcaaggtgacatatactcaaagtgtggctgatatggtttggctgtgtccccacccagaactcatcttgaattgtagctctcataattcccacgtgttgtgggaaggacctggtgaaagataattgaatcacgggggcagtttcccccatactgttcccattgtagtgaataagtctcatgagacctgatggttttataagaggaaaaccctttcgcttggctctcattttcttgtctgctgccatgtaagatgtgccttttgccttccaccatgattgtgaggcctcttcagccacgtggaactgtgagttcattaaaactctttttccttataaattacccagtcttgggtatgtcttcatcagcagtgtgaaaatggactaatacagtggctgacaagtttcttacttcagcaagtatataaagtgtacagccttcaatgtgtcacctcaaaaggaatttggtgactcctccttctgtttaacacatttttccatctcattcaaacttgaatgcgtgatatacctcaatagaatctggttcacagctccgtcctctcccagcagtgtgcccttgagcaagtcacttaacctcttgcatgtcactttcctgtttgtaaagtagagataataacagtgcttattttccaggggtattatggggactaaacgagttactttaaaactccttgaagagtacatagcacatagtaaatgaaaaatctattttttggaatatgcttaaaaacaggctacattgtcaaaacaaggtggtacttaagcaaaacagcttgtcactaaatacgtccaataagataatgcacctaaagacttatggtcccataaatcaaggatgtcaagaacaacatgagtatatttaactctattattgaatagctacagtaaaagctatagagcgggtgagttcattctcaaaaactccatagtaaattcccaatgtatcccaaacttcaaagaacttcaaagatatgttcatcttcagttgccaaaatatacatgcacatttgtttcctcttaatttccatttctaaatgtctctgataaagttatttttccttggaacagctgagctccattaaacagttttgtatctattattgggatactttgaaaaggcgcgatgcaatgccaagaagcaaatcaatcagctgatgtctcccaaacttgccctgtccatagagcatacatattttcttggccatctgattaagtaacacaaatttgtcaaaggacagcttaatggcattgaaatatatgtatttcactgtgggaattactcaccaaagggtgctacacatgacatcctggggaaaaaaaaatgcctgacgtgaggagggacaagagtaaacagtcaaaagtgggccataagttctaaaaatgctggtgacatttataggcaacttcttaagttggatgagcctgacagaatttagaggtctgtgataggcagacatctacaatgatctcaatgattctggcttcctggtatttatgtccctgtgtcatcttctcccattggagggtagggacttatttctaaccagcagatatggcaaggtgacaagaagtcacttccatgattaagttataaaagactaggctgggttcgtggctcccacctgtaatcccagcactttgggaggctgagacaggaggaccgcttgaggccaggagtttgagaccagcctgggcaacatatcaagataccatctctagaaaagtaaaaaactagccaggcacagtagcatgcacctacagtcccagttactcaggaggctgaagcaggaggaccgcttgagcccaagaggtcaagggtgcatggacctatgattgtgccactgcactccatcctgggctatagggcaggactctgctatatttaaaaaacacacacacacacacaaaaaacaaaaaaaaacagcaagaaaataatgacagaccgtgactgccatcttgctggctctccctggggccttgtggcttgcatgcttcgatgaagaacactgccacactgaagaggcacatttcaaggaactgagagtgggcaacagtcagcgaagaactgaggcccttgtccaacgccccatgagaaactgaatcctgccaataaccatatgagcctggaagcaaatccttcaaacttagaacagctatggttcagctgacacctgattgtagcctatgagggactctgaagtagaggactcagctaaacagggcccaaattgctcaccaacagaaacgaagggcaagaaacatgtgttattttaagctgctaagttttggagcattttgttatgcagcaatagataactaacacaaatgacaaaaatcagacaaggcataaggctattggcagtaacatcatcatgattctctaaggctggatgaatctgaccttatcttctggttccttaaaactcccatttaaattaaaatgaaaaattccttttctcccaaaatttacattgcatgaatatgctccaaaactcacataagaatcaaccaaaattttcaattggtcatgtttttccagactaatatttttaattttactttctatagtttacattttaaacacagagtcttgtttgcttttgaaaaataatttataataaataagcttttttcaaattctatatgttcttgccccatggagaattctatttggtaagttctccctacccattaatctccagaattctctttgatgaatttagttgacttgaagatcagtgtataatcttggacccataaaattttgagttccaaaataaacctttcatttcctttaataagaaataggaagcatttataaatgattagaatatatttaattcactaatactatctctgaaaaattgataaacttattataagtactccttaacatttcctccattgagagaaataaattatagaaggcaattaaacattagacttttttttgttggtttttagtattcataatggatcaaacccaagaagccaacagcttaattttcatccattatctgagaaaattacatatagaaatattacataggacccagaaagacagtacaatttacatcccttgtaaataaattgaaataattcagagtcaaatatgttccagtgaagctgagcccatgtgtccatgttctagctgaactgtggccaaccttggtatgaagtgtgtgtggtaatagggaggagggaaatagggggtgttgctgtcattctattttttgtttttgttccttttggacttcctacagtttcaaactgcagtggtttagtcctcttctccccactgattttcttaacatggctgcttccacaaatgaacccaatctttttgtgttgcaagattttatgtcttcccaaatgaattcatgttctaaaacaggtgttggcaaactggctttctgttttgtttggaacacagacatgccctttatttccatatcatttacctcctctcaggtcacaacagcagagttaagtactcataacagattacagaaccggtaaaccctgaaatatttaatgtcttgtctttacagaagaagttcatcaattcctgccccaaaaatcatgatagagaccctaagaaactaacagtgtctgtccagccagtgctttagaagaaagtagttgggctgctggaaaaatatcaactcaaagacctagtccctagaggcaggaagaatcacataagaatctttccttcattccttctcacgtgggaacattgggcaattcatttaagctgtctgagattgttcttcacttatacaatgagatcatcatgtcattaatcggttagagtagccataatgacattataatttatatatggtagctttgcaaaacactcaccttttcattgtttagtaggatgatgtttactattacacttgaattaagtagaattgttttgagagactttgttcacttaaattctattcagtactctaagtcagagaagaagggaaaatcatgacaaatgttctgatgatgggaaactaaaaacaaggacaaacaggagaatttcaacaccatatgtcagggaggtttataccaaacataggcaaaaaattctacattaaataatttaagtagagccttgtaataatgaggcagagatacagggatcatttggaatcaaaatggattcactaaggacaggcacttcaaataacctcaccatctttttggagagggtcattagcctggtggctactccagtagatatgtgcagtttccagaaaaggggggtatagttctgaatgctgttattcagatcttccgagaaacaggagtcagtcctaggtgtccatatttaagggtcactgatagctggagccatcccatggagatcagcaggaggagtgaggaagccacaaaactgggccattggaggaagagttgaagggaaagatttcggaaaaggaagacacaagataacacactctgtgttcaaattggtgaggggatgtgatggagaagacagattagccttcttccagctgctatcaccaagcaaggttagaattaaagagtccagatgctaggagacatttctgcttaattaaaaaaaaaaatctttgtggccaagcatggtggctcatgcctacaatcctagcactttgggaggctgaagtgggtggatagcttgagcccaggagttcaagactggcttgggcaacatggtgagaccctgttttacaacaaatacaaaaattagccgggtatggtagcacgtctgtagtcccagctacaccggaggctgaggtgggaggatcacctgagcccaggaggtcgaggctgcagtgagctgtgagtgtgccactgcaccccagcctaagtgacagagtgagatcctgtctcaaaaaaaaaaaaaaaattccctacaattagagctaaccttaaaagaactatgctttctcagtgctgcctgggtgccctattgctagagatattcaggtagaaatcttaataaattcttgaatttaaggggtatccagacagtatgaaatctaatgaccttttacaacacgagattctagaatttttatgaacacgtggcatgataaattacattccacaaaggcagaattctgtttctcaaagcaaagctaaagcatcaaggatgagaaattatataaaatgaaagcaacagatttttaaaattataaaaacagacacttaaaaagaattcctgtaatagatcagaagaagtgatactatcagcttaatagggctgataagaaagtcatccttaatgttctattgcaccatatgcatctgaaaaaatggaatatatcaaaaaaggcaagcactgttttaaagaatttatataatagtgctgggaaactagtaccactgctaaaatgtgcctggccaagagtccaagaaagtacgggactgagggtgctttggaatgcctctgaagtgccatttcccacacatcctttcctccccgcaggcagtaattctaggttactctccccttctggtgccactgcagaagtgcctcatagagctgaaccttctctgaagctctcacccaccaacatccctctttctcatggccggccacacatggcttcccccatgactactgaactctcgaaccccactagggatgaaggctgatgcctccaagatctcgccaaacccaggccacccagaaagttgccttttccctctttttaaaaattcttaaaaatttttaaagtaacaagccaacaagtataacttagattctcctccaaattttggcttccttctcgggaagccttggattgctctagttggatcccaatgctttccatattttacacaaaaagttacctggggaactggtgaagatgcagagtccagggccccacccttgactcccaggggcctaggattctgcacaaatgacctcctcctggacttaatgtaggtgatccccgcaccatacctgaagaaatcctgctaacgaatctagaattctgtgccaggcctctgcaaacattcattaaatattatttagggaaagttttcagtgaaatatacagtattaaagtatttttattgttttcctcccagaaaaagacttaaaattttctatatggctaatatttaggattaaaaagagtctgattatgtacatatgattttcaggtaagctgtgcaacttagaaaaaatgatgctggttaagttgaagacaaggattgtatccataaaactaatgcgagaggccgcgagaggccccgagaggccgggcgcggtggctcacgtctgaaatcccagcactttgagaggccgaggcgggcagatcacgaggtcaggagatcgagaacatcctggctaacagggtgaaaccccgtctctactaaaaatacagaaaattagccgggtgtggtggcgggcgcctgtagtcccagctattcaggaggctgaggcaggagaatggcgtgaacccgggaggtggagcttgcagtgagccaagatcgcgccactgcactccaggctgggagatagagcgagactccgtctcaaaaaaaaaaaaaaaaaaaaaaaacagaaaacactaatgcgagaatcagaaagcaatgagagggacactcgcagttctgggattctgtttgtgtttaaacgagcatcaccacctttcatgcaaaatgtcaaatttcaaacacacgtattctggaagcaggggtttattatgtttggtttttgtagtctatgaaaacagactttccttagaaagtaaaatattaagtgctctatttaaattttatctacattcattctgtaacacacaaaaactaaaataatttataaaatatctatcagaagataacaaataagcagccgatttcaaagcactacaggaatattttaattgtatcagccacatagtaggtgatttttctaactcccagaaaggagagctgatttactatgctcctttttggcctccttgaagcttaactgatcctttccatggaaccataaagcaaaatagaatcactaactgtatttgtctgctaaaaatccattgctgtaggctttttattaagaaattttaaaattaaccctcaccattatgaaataaaaactctgtatttctgaacaattgctttttccttacaaaaaggacatgattttataccatcctgcaaatgatcttttcaaactacataagatgtacttttgcagctcacatgcacccatgtattgcaggtgctctaaactagaagaggaatgtttttctctcaggtccttccctttccctttcgaggtcctcttttccattggtatggtttcaagagcttcacagcacaaaatgaaaagttagtaacgttgtctttcttagtaaggagatgagggaaagagggaaagaggtgggaaaatggatgacaaagattcatctgtatgacaaagaaagggcattttaaaagggctggttcagacttatatcacagaaattcacctgggtctctttttccattataccttttaagaggaaaccctgatttgatttatacctatttctatattagtgttagggaatgcaatgagtagttgataacgaattggaacatttagcacaatatcaggtagagtcctgacttttgaaaaccttcacatctaatatgaagtttagttccagacattgacaaaacagaatatatgaagctttatgttaatacaatcaatatacaattgaaagagctcaaaactaggtcataagatatgccttttatttaaattactagttattcacaggccttaatttttccagaatagaaaataagctgaagagagcctagagggcataaagagaaaggttccatgagcagatcttcaggtatccacggaccttcctggactctcttatacggtatctcgctgtaaatatatgcatctctatatatgtgtgtatatatccatatacaaacattttaaaggagacttcagttctccccctataatgacagtaaatacctattataaaagactccaaatattcagaagtacgtaaaaaactcagtatgcactctcaacacaatttcacttctcattcagacccttttctctatatcggtgtgagcacccacaacatttttgttttcatggaaatggtcacacataatgcatattattccactcaaaatatttgggataccattccacgtcagtatatacagatttaactcatcttattatggcttctaagtatttactagtatagatttatcatttacccattccctgactcgtggactttcatgttctagtttattgcaattacaaataatgaaataccaatgataaggtttggctgtgtccacacccaaatctcatcttgaattgtactcctataattcccatgtgttgtgggagggacccagtgggagataatttgaatcatgagggcagtttctcccttactgttctcatggtagtgaataagtctcatgagatctgacggttttatcagggggttccccttttacatcttcctcattttctcttgctgctgccatgtaagaagtgcctttcacctcctgccatgattctgaggactccccagccatgtggaactgtaagtccaattaaacctctttttcttctgagtctcaggtacgtctctttgtcagcagcgtgaaaatgaactaatacaatcaacatccctatataatgcattctagggagcttataggaatacctgtatatgtagaagtggaattggcccagtcatgaactttttctcttttgaaatgcattgacaaccctttaaaagggtcaatctattctctcaccaaaacgtatgacattcttctataagcttaacactagatatgaactatatgctgaatatttgtagattttccaatgaaaatagcctttcgttttcatttgcatttctttgactaatgaagttgtgtattttttgtgtttatgagtcatccccatttcatcaataaactgcctgttcgtatctgtagtagactgttacacgggggcttcccatgaatcacccctcatattcacactctaatgttatcacctcctacattggctctgggcttggccatgtaacttctttctggtcaacagtgaattagtcatcatagcccaagctgaggcttgataagggtttgtacagtggggtttttatctttgtgtagctccctcttagaaccctatgccatttcacagaggcccagtcccctgcaggaaaggccatatgaagaaagagctgaacaaccatttgaacaaactatttgaagtggtttgttcaacagcaatagataaaagaaacaaaatccttgatctatttttgtattttcttactaatttgtagaaacctgttatagttaagaaatccaaatcccttcccacattatatctggtaaatattttccttagtctgttctttgcattttaaacatgttaatcttctatatggcaaaagtgacatagtcaaatatgttacttctaggctttgtgtctatagtaatttaaaacaatcttttatctaaatcaacagaactttgagttatccatagcaatctcatccaatctgtggagcttggccattctttttctgtttttctagcagtaaaacagattaaaagaagaaaggtaggtgaatttgttagtaaaatattgtaaaagcccaggtgagaattacatggggtttaaagcaggaccatcagggctgtggttagaggaatgggagagagaaagagagggggagagagggggagagagggggagagagggggagagaaagggagagagagggaggtagggagagggaggggaagagaggaaaggagagagaggggagagagagggagggagagggaaaaggagagggagagagaggcacaatggctcacgcctgtaatcccagcactttgggaggctaaggcgggcagatcacctgaggtcaggtgaggggagggttatctgaggggagcagggaggtggaaaaaataagacagagcagtcatagatctggagttcgagttgaccttagagaaaacagtagagctcctggcagaaattaaaactgggcaagttaagttgatttgggggataagacaaagagccctgttttcaagatgtcaactagcagttgacatgtccagaaggcaatagcagacagaaaattggccccagggagagggcagctttgaagattctgattagggcatcatcagccacaagaacagagcaatttaaattagcacaaaaaactgaaggtgacagatgaccaacatctcacagctcattaaaagcactcctgggacgtggatcacacacctgataaagatttcaacacacaaaatatttgctttgagctgaagacaattttggtctaatgagtgctgacagtacttctggctacacttcatgaaatggtcgagacaaaggaaatgtatgcaaacagtgagacctccagtggtgtgggctacgtctgggcggcccagaagcatgctgacagaagcagagtgctggggcactaggaaggctcttcctgcttggctgccacagctgattcagcaggagaaaaccgagatcatcctgttctcacaggaaagtgcaacctgaccgaaataagaacacacgggcattttggccaggattttgaagaattttactttcacacactgcacttttattctccttgtggttggaatgaagaaatagacactcagtgaattgaagtgctttaaagaaccgaaaatgtggtcacagtgccatcacgtgatgtgaactatctgctggatgaaatgttcaagagtgctggagagagaccaagagtttatccaagacagtctcgtcttatgagtaagacaactgaggtccgagatcatatcactggccagtggtttgttggggccaagactatgccccttcactctcactcagtggtctttcctttaaaagaaagatatctttgttaggagagcaggtgggaacatttgtactgacatgaagacaataaaattatatggatactttctgatttctctggtttccattatttaaagatagtgagttatatctaaaggaaaacttaagaggatggctttgatcttccagcctatgaaggaggtgggttagggtgaatagagattgcagggtgtggctaggtcatcaggattcctttcaagaacaagaacagagcaacttaaatttcctgtgatctgacaagacgcaatcatataaaaaagaaatctaggaagccctcctgagagaccctacatagggaaaatcagctgctgtcatgcaaatgaaatcaccaactgaccaacccattgcagaaagcccttacaaccaagaacaccacaagcaaagaaatacactttgggccaggcacagtggctcatgcctgtaatcccagcactttgggaggctgaggcaggcagattacctgaggtgttcaaatagcctaccatacatgtaggctatatggtgtggcctatgctctcaggctacaaacctgtacatgtgactaatgaatactgtatgcaattgtaacacaatggtaagtatttgtgcatctaaacataggaaagttacacctgaggccaggagttcaagaccagcctggccaacatggcaaaaccccctatgtattaaaaatacaaaaattagccgggcatggtggcgcattcctgaaaccccaactactcgggaggctgaggcaggagaatcacttgaacctgggaggcagaggttgcagtgagccaagatcatgccactgcactccagcctgggcaacagaataagactccgtctcaaaaaaaaaaaaaaaaaaattcactttgcatggtgagggtcttcttttcacttggatatatagaccacaccgtgtttcacatgtgatcaagtataaaatattccacactgcaaaatagcaaggtatgattcaaatatagcagtgttctagaaatgtaacattggtaaaaaataatgcatcaggatgaatgcaaattttagctaagccattcttcttattcttctgtttttcttattatgccatctcctaaagaatttcaggtcaaactccagtttgaaggagcaaatgatacaaatgagcaccccaccaagggctataaaaacaggtcccccaacgccaaccgaattaagagcgtctaatattttattgcagtaattgaagctgatttttaaaataaactccatctggtgcaccggggctcaggaaggtaacctctgtcagtcaggtgattaagaccttgggaacagcaaagaccttactccaagtcccactgacttctgttaatacctgagcaactgtcaggagggagatgccagaacacaccaattattatatgatgaacaggcaggcccagcagtcaaatgtgctgcagtgatatagtacccagttgggcaattaacttgtccctagcaaaatttgtggacaacaaagcacttataatctacagctgctatccacattggtcagtgattgcactgaaattgattcttctcaataggcatggggtaaagagtacagcaatgtgacattagtggcccactcattttgcagagtctgcccattatcctccccatcatgcagataagcaagctgagactcagagtaatttgcccaaggatacaatagaggaccttgtgccagatggttgttggactgctgcctggctttctctggagccaacgggcaaggacattattggaatgggcactttcaggaatccttaaagcatctctgggtccaatccggtttgctttgtttatccccagctttagcttgtttacacaaaagttacctggagactgtgtcatcattcaaaccctatagatacccaagccagcaaaaccaccacaagctctggagcagcctcttggtgggcaagcttcctctaattcagggattggcaaactatgacccatggaccaaatccagtccactgcctgttttatgaataaaatgtgctggaacacagccatactcatttgtttccacattgcctatggctgatttcgagtgacaacagcagagctgagtggttgtgacagaggcaatctagcctcaaaagcctaaaataactatctggcctttagagagttttctggatcctaactggtggcgtcgctgctcagaagggccttcatctgcactcagaagccttcacaacaccaccctccgcagtgggctgactccctggtcaatcttttccttcctcaagtggactggactcaaaagtactcataggttccctcaggaaaggaaaagctgcacctcagacaagttaggcctgcccaaaccgtgagccctgtgacgttagaacattagcagctcaagaatcctaatgcaaaccccaaacagcaggtgccattctctgaaggtgttttggaaaacattttccaactcatggagacagaaaaatacagtcatgtgggctgggtgcggtggctcacgcctgtaatcccagcactgtgggaggcggaggcaggaggatcacgaagtcaggagatcaaaacccagtctctactaaaaatacaaaaaattaaccgggcgtggtggtgggcggctgtagtctcagctactctagaggctgaggcaggagaatggcatgaacccaggaggcggagcttgcactgagctgagatcgcgccactgcactccagcctgggcaacacagcgagactcaaaaaaaaaaaaaaaaaaaaaaaaaaaaaaagaaaagaaaagaaaagaaaaaaaagaaaaaagaaaaataaaaatacagtcatgcattataagttctaaacaatgcatcattaggtaacttcatcattgtgtatacatcagagcatacttacacaaacctagatggcatagcctgctatacatgtaggctgtatgctgtggcctatgctctcaggctacaaacctgtacaacacgtgataataaatactgtatgcaattgtaacacaatggtaagtatttgtgcaacatagaaaaggtacagtaaacatataaaaaatgatatacctattacctatagaggatactaaccataagtacagcctgcagaaccggaagaatctctggatgggtgagtgaggaatgaatgtgaaggcctgggacattactgtacaatgctgtagactttatgaacactctacacttaggctgcactaaattaaaaagtaaagcacaccacgatgccaccatggctatatcatcactagcttgataggaattttttcagctacattataaccttacaggaccccctgtcctatatgcggtccatccttgacagaaacaccattgtgtagcacatgactaaatactaattattttttcactactgttggtcaccatctgtttataagagactagtcctttaaaaaactattaacatttccagtgattcaggacttctttgttgaagtggaatacttttgacatggacaaacgaaggggaattcaaagtcagaaagacttacttagttcaaatcttgactgtcatctatggcctctagaaccctggagcaagttatttagtcttcctagtgctcagtttcttcgtctgcaatatgcattaggtatcgattgctgtgtaactgactaccccaaaactcagtggctgaaaaccagcacccattatttgctcattgcactccatgtggcctaagctcagctgggcaacgcacgccttggccactcatggctgtaactggctcacagctggcctggggatggagggtataagatggcctcaattcacacaactggtaccttggtgccagctaccgtctggcccttctccatgggcctctcatcactcagtagtctggcctggacttcctcaaatgagggcagggacattccaaaaagtggtaaggctctttgtggctcaggccctggacctcacacaacatcgcttcgggcacattctaccagtcaatgaaagccacaaggagttaagaaatggactctccctcttaaaggcctgcaaattattgtgagcatttttcccccaggatgttcacgcctttgtgtattatgaagtaacacacgtagagtgtttcgtcagagggtcagttcatgaacttatatggggcacacacaaaaagaacttctcttgtctccatccagcttttgtcaagattatatgtcttaacaaagactttcctcccactagcctacatctaggttttggcagcacctggagccaacccaacatctctttatgcttccactcgccaagtatccatttgctgacttaatcatccaaaagaagagtatttcaaagttggcaatagttcccacatcgtttttctatcagtaaacctggtttggaaagatcactttactgtgggaagtagtctaaataaaaaagggaaatacctggtcaaattcatttatcataatgtgaagaggcagctgatggaagatgtgtctggagtattttcacttgcctctctagtgaaaggaacaaatgtaaccaatcactttgaaaaacaaaatcaccatacacttatgtctttgaaatgaatgtttcgatttggttaaggagggagtttcctccttgaattgatgctaaacttcctctgatctataatgtagctgtcccacctgtccagccatacaaagatataaaacagtaacactgaggagataaggcagagatggaatggtagtctcctctagttgcattgctacacttacaccttcttttatggtgtaagaggaggaggatctcctcctccatgtgttgggatgcaccaccactagccacgctggttatagcctgtgtacagaaggttgcccatcctaatcttgagatcattaggacagcaaacctctggccaaattaatgtgacataattttaagaagtccctgttctactcagccagtctaccctggagaaagagtttaccctcatttcatcacagtcattaatttaatgatcttgcattatagctcaattgatgcaacacagtctcattcaagcatgagcacatgtaacagacttcaaaagcacaggggacattcttactgaaccaaagaggaaactgagaccctgagaggttgttacagtcatgcacaaccaaagattgctacacacacacaaccattgaactggccaggcatatgtaacccagatgcagttaacagccctgccttggaaatcaacagatgggctgctggtccctgaatggatatggagtcgtagctgctgggaaatgttgatagtgccttttcaatagcatcataaactcaagccattaaaatccttcctgttcctgtgttgaaggaaagaggatgaagttttgtacatgatccagaccagtcgcagtgccactcctatttgggaaacatacactttaggtgctctgtaggcagccttctgctactgagccaaaaactgacaagtggtactgaaatgtcactgctgttttcagctacccgggtcagccacagattccaaagtgttcctccaacactgcagcctctgccaccactatggcgacccggaggccagaggaagagcaatccttttagttctgcaagtgtaattaaaataaatttgtgtattacaaagcatggccaatagctttccctttcctttcagattttagagaagtcactgctgtggacataacatctggaagacaggtctggttaatgatcaatgttcgaattaatgaagatagagtgtactttttgtttttttagagataaggtctcactctgttgtctaggctggagagcagtggtgcgatcacaactcactgcaaccagtaattcccgggctcaagccgtccttctgtgtagggaggtctgcaggcactccccacaatgcccagctaactttattttttgttgagatggagtctcgctatgtttcccagacttgtcttgaactcaagcgatcctctcacctcagcttcccaaagtgctgagattacagacatgagccaccatgcccagactggaaccagagcatacttctgtccaggtcaaaagcttgaatctggagtaatggcttcagggagaggagctggctctctttcatgattttctaccttttgtttctgattttaagaccatgtgcatgcatcccatgttacacacagtctttctacatgatggtatgacttaaaactagattatgcagcacagacaaggtgtttcttgattttgccattaagccaaaggtcctctgagtaaccaaaatagctatattgtattgactggttatgttgtccccattcgcctttgagtcactagtcccaagaagcagggaggccagaggacttgagataaaaggatgaactctagtatagaacaggccaacactggctaactcttaaggactcaaaaggcagatctgttgaatgttcatgggctacttgactctcttctctccctattacatgagagattttatgtgagaaggtggttgagaaagggtcccatagtccagcaggggttaccagcctcctccagccagacaggacaaccccgtggagacaaaagaaggggtaggttccagagtgcaggtcatggcccttctccccttgcctagccactacctgcaaatgtactcagaatgtagtcagaccgcaggtctctgacagaatgctccattttctggagagaataaagcagcagacctgaagtaagccaagaactggttttgccacttagttgtcaggggacatgattccttagatttctctcattctaacattcattgtattcttcccccaacaacttgctagacaggcatgtatgtgtccttcatgtttcaacatgtaaattgaaaatgtgacccattccacatgaataatgagacatatggtggtaaataatctcagaatttggaacacttttttcttgaaattacattttaaaaacactttgacaaggagaaacacagattgctcagtgctcaaatgactaaaagtttaaaagaccatatgggtccttagctctcttgggagggaaggagttgaatttgatggcacattttaatagatacattatagtcaaggctatgaaactgccccaagacctacatctttggcttttgctgtctcttccagttgtgtttgtgaacaggtgtcatgttccatctctgctccataagcccaggtccagtgtcataattcaggaatttggttgtgttagagccttagatttctatttcaggaaaattaagacaatgacttgaagaaagccatgcagtttccttagaaaaaaatggttatggagatattatacagtggaagtcttcagtgctgctcagaacgtgcagaagtttaaaataaatgctgccatatcacataagaatgccaacaaccctggggtctttacattgcataaaagagggtcaatgttacagtcacagttgaaacatcctgaagaaacagaccgattccatttcataaatctaagaggtttaaaataaatgctgccataccacataagaatgccaacagccctggggtctttatattgcataaaagaaggtcaatgttacagtcacagttgaaacatcctgaagaaacagaccaattctgtttgttataaatgaagtctcaccttggcactaaacccacagctcaggagattgggggtgtcacagaaagtgccggagggaagctgtgctatatgtagctttgataacaaagcacactttacagatctcagagctttcagattctcatctttttcaggattcgtgcagaagagggtatctaggtctcagctctgcaagctcccatgtcagccttaacggggcccaggacctctgttcctccttcctgatatccagcctccagcttggttcctgccgtgcatgacaccttggctgacctacctgctgtggcattgtcatgggctgctttgggaaatgcatgaaatacagacaaggtgtcttgtcctcaatgagcccctgagatctcagcagagccaaattggagttgtagacaaatcctggggttctcagggcccagctgtgttttgtcttccaggagtgattaaagtggaggccatgattgagtacagagtgcgaggaggactccaatcagcaggacaggggaaagtgacctgcagtaacatatgcctcctcagcattctttcctgcagatgactaatgaacgctctgggagtgaccttaatcagatgtgctgtaattacttattgaatgtgatccagctgcagaagacaaagggttatgcaatattaaaggcagctggaagcagagtccccgcagcagggcacaagtagaagggcaggcaatgacctgtgtgaccgaatttaattaaaagggtgcttttctgctcagagaaccaggtattattagtaggataaaatcagttctgaaattaacaattatttggaaaaaaaatcaatacattgtcatagtaactcttccaacccacactgaggttttttgttcccactgaagtggaaatgtccaaggaaagaggtattccgtacaagtcaattttatgaatagtttaaggttaaaatagacaaagctgtttgcattgtttatgggaatatttatacattttcaaactctgctgcatttgtgctgcatcagcccagctaagctggaattgtatttctcagaattcccagccctgccatgtttcacattagtgctggccaccaggggtatcttgtgtgtgatttggaagatgatatacagcagcaacctggtttgcaccctctcaaggtcagtgtagggcaccaggtgcagctcacaggccagcagctgggccccaatccctctaactcccactgagctcaacttctctgcatcccaggccagcatgtgaagctcccagcagaggactccagcttcccatgcatgtcacaggcaatgtggaagttagaggcctagagcctctgggagactggcatggatgctagcttgtcctccagatttgagctcatccttgattttccccactgtgagttcatctttcttctccaaataccagccctgctgatttgagggtcggcacccacacaactgcatgagcatccctcatcactcagtttctgcttgtctgattccctaactgatacacatactgaggcagggaacttcaggccgattctcactgacttcctagaactgagtcaaaaggaaaaccccacctctccacacccaagtaacagaaggatcaggggctactccctttgcaatccccccatttccactgtgttgcagatgagaaatacgaagtacctctgattggtcccctcctgcaaccagtcagacgtttgcatagggtgtagtaactttttaacttcacttcagcctctgtttgatcataggccactacttcatttatatggggtataaccaagtaaccaatggggaacttctaggggggatttaaaccccagaaaagtctgtaaccagtgctcaagccacttgcttgagcctgctcccactctgtggagtgtactttcttttcaataaatctatgctttcgctgcttcgttctttcattgctttgtgcgttttgtccaattctttgttcaaaacaccaagaacctggaccactcttagtcaagaccctccgctggtaacaatacctttattaaactacgcatggatataaagttttgtttttgatgaccatgtcactatcataaccactcctgcatttcaaagacataacatggtaagtgtggggaagagaaacccctaaaactccccggaggtggagccgaagactgctttctatttggtgactcacgtgtatcttatgtctcctttctaagggattgtcaaggcccctttcttaacatcattcgcaattcgctagctgaagtaaagcaagatcacttggcttatggaatcagggaacataattttacacagaaactgaagtccactttgaaataaagcatgaacacagtttctctcaattcagcagtcttctagttagttgaggttgttgaaagtgtgacttcagaagaacaggactccttgcacaatgctattcagctgcacaaaatggtgaaagtcaaagaatgcagagactagattatgagagctttcagattcactcatgaatgcttaaatctgtaaagtaccataaggtacatggatgtactttggtcaaggaataggctgaggcagatgtccagccagagtgactcagtgagtttagagcacatgtgtataactccacttgttatcacagccatgtagccacaacatgggaggaccatctcttggttctacaccactattgcctgtaaaaggtataactgccctgctgatgctgtacaggggctcttggggcttggcttggctcaatatggtttgacatggcgggcatgctggtgcccagagaacgagagagccaaagctgtccatcttgcaaatggagaggaaggagccaggatacagcttagcttgcttgtgcccagagaaagagttaagctgctgaccctgaaggcaaggaagagctgactgcacagctgtgtatgggggtggccagctccagcagccaagacagggtggacagtgggagagtaaactggtgatgagaaagctagtttgagaaagctgttgaagagagctactgctgaataaaatcacgtttcacctgcctacggccccctaagtgctctttctgttcatccactcactcccctcggacttcagcatgggctggacctggaccccgggatctgacaattggtgatgaggatgggatgaggtgagtgggtcttcagtccctgagggctcctaggttagctgtgtggctgcagcatgggctatggtactcagtggcagtggtgctgcttggatgagccccagtggaaatatgggaggcagtagatggggtctcctgcaagtgtggagatggcgctgaagcatctggaagtgcacagcaacaagctgcgtttactggctgagttggatgggtgtttctgactgcactgtgggaagtgcatgtccagtccctgcaggacgcagcacagggaagaagaaaaacctctgttgcaggcttacccagtgatctgtcagaaaatagagcataagcagctcttgggccccacaggtggacccagaggccccctactgtggtggagcatacttcctgtggtgcccgtgccccgccaagttgtgggagttaagcaagtaatgtcggcagtcatgtacagagttagtgcaagtcattcggaagaaggacattgctgcgcaacccagtcccatccaagcattccggttcaaagaatacctgttacagctggcggaagcataaagcctcttgtgtttaataacagaactggccaaggtccttggcttgggggactccaaataaccaaagaccacgtgtggacttgggaatctactggtccctgaacctagataagtttctgggcagagctgcatttattaacagctatgaaggccagtcagtggaagtgaaacctgtgtctctgcgtcttggcatcagccatttagttctctgcctatgcactgtgcatgtctctcccatgcctgaagatattctgggggtggatgtttcacacggcttggcagctgtactctctgtcatggacttgatggaccgctggacaatgcaaccgggacagtccaccaagagccaggaacggtttgccttcatgggagggtgacaatggactttcacagtgttgctgcagggctatatgcatagccctaccatatgtcatggtcttactgatattatgctaacctctgattctcttgcaggtttagaagcagcagtgcccctcttgcctgggagttgggatgacaaggctggaacagcctttctggtagccagactatatagcaggcacaagccctacaggtagttagccagggatgcccatttgaagtggatgtgcatgtaaccacagatagttttggctagggcctattgcagtgcatgggtatgcccataggcttttggtcccacctgtggaagggagctgaactccagtattccttaataaaaaagcagttagcatcattctcagcaaactaacacgggaacaggaaactaaacaccgcatgttctcactcataagtgggagttgaacaataagaacacacggacacaggaaggggaacatcacacaccggggcctgtcagtgggtgggagacaaggggagggagagcattaggacaaatacctaatgcatgcggggcttaaaacctagatgatgggttgaggggtgcagcaaaccaccatggcacatgtatacctatgtaacaaacctgcacgttctgcacacgtatcccataacttaaaaagaaaaaaagacctacatgggattaaacaaaacaaaaacaaaagcagggtgtgttcatgagtaaccactccctggactggaaaagcagttagtaactgcatatgctgcccttctggctcataagagtgtggcagggcgggttacagttgtcacgtggacaacttacccaatagcaggatgggtgtgttgatggataacgactccccggacagggacggcacagacatccacttcagtgaagtggggcacctacttagagcagtgaagcatactaaagtacaagtcccttagcagcagagttacaaaaagtcttgagacctgtagtcctaatgcaagataaggccatggggcctaaggcactcctagaccctgagccttcactgataggaagagcgtccccccattccaaatgggacatggtgcacagatgggcctgctggtgtggtccagcctagtactgacaccatatggtttaaaaccaagtggaaacagagtactgaatgagctaagctcagggcagtgtaaatgataatcaccaaaagggtaactcctatggtaatctgcgccaatagctgggcagtttatcaaagctcatgtatgtaatgggcctgtgtacccaaaagcttagttatgtatcaggcctgcatgcccaaagcttatgtgtcaggtttatatgtcaagcctatgtgtatgtattgggcctgcatgcccaaaattacgtcaggcctgtgtgcaaaacctgtatatcaaacctgtgtgtccaaaccctatgtctccctcagcctagggggtggagtgtaagttacatggacgtgctttggtcaaggaatagaccgaggcagacatccggccacagtgactcagtgagtttagagtgcaggcgtgtaactccacttgttatcacagccatgtagccataacatgggaaggccatcccttagccctatgccactattgtctgtaaaaggtataactgccctgctgacactgtacaggtgctcttgggctcttggggcttggcttggctcagctaaacatggtttggcatggcgggcatgctagcgcccagagtaagagagtggaatggaaggtacatctgcaagactgacaggagggagcaaggacacagcttggcttgctcatgcccagagaaagagttaagctgctgaccctgaaggcaagggagagccggctgtgcagctgtgtgtgagggcggccagctcaagcagccgagacagggtggatggtgtgagagtaagctcctgctgagaaagctactttgagaaagctgttgaagagagctgctgctggataatatcatgttttacctgcctattgccccctgaggtgttctttctgctcacccaccctctcccctcagacttcagcaggagctggatctgaatccccagatctaacaagtacgtaggcagagaagataggtctaggtttaagccaaggtcatgatttgtaaacttgagttatttattgactgctttaaataatacttacacataaagataagttaaaacagtgaaattctatcaaaaatccattacctcccttagtccttttagtatggtctttcatgcatgtgtgtatatacatacatgcaaacacacaagctgactggctaggcatgaacacctgacccacagaaaaaccaatccattggtaaaccaggaaccaatcagaacctatctttttagattattaactaagaaatttagcaatgtgaatcagaattaaagaggagggtaatcctctcccaccacagacaaactggtacacttcagagactagaaaatcaaccagctgcacagagagaggcagagacaacagaccttgtggctccagagaggtggagaaatgacataatgtgggcccacatgggaactgatttcctacactccatctccatgtcagtcccctgatcttttcaataataaacctgctttctacccgagttactttgaggggatgtgcacacgcgtacgttctggccggaatccaggtgtttttcccatccacacagtacacttttgttacctgttactccctggcccatcctagttctggctggggtcaagactacctcatgaactactggcacaccccctcatctggggtcactgaaaattccctgagcactcagctgtccctaattcagtggccttcatgcagggggtgtggaaagcctccctcacatgttgtggccacatgtgtctctatgtcctctgtgccatcactgagcctgtggccaggccgccttagaggtttcgatctcgtttgtttcagttctcttgtttgtttcccagtttgagtggtggtgttcagggaatggactcttccatataagtcacggattgcttaagcccaaaacagagacaagactgttggcatgtttatgagtttatgtatttttgttctctgatgaaatctgtatccacgattagactaggacgacagaagagagcaatgcaacccttacaaccccaccaggtgggtgagctgcccagaacatcaaatggcaactgcagaggtaaaggtacaggtccaggcatggactgagcgagagacacaagatggaatgttgtcttgtttccaatataaaaccccaactctgcttgttagaatacatgtggatgggggttggggggaagaatagaacaaatctgctaaaaataagcacaattagtttttcttgattttttaaaatactatttgtttgctacttgtgcattcatttggccatctggccaacatttggaagcagactatcagtagcaagcatccagggtatttacgaaattatagaaaaattgaagtaaaaattcagccatatttttttctgtgaatcaggaagataacatcactatttgattctggctgtgggcctactcagacaggctcaaagggcaccagaggctgagaagcagtagaccctacagggcaaggcccctgctggtataagtggatcagcttcagtggacgcctggaagctcagcaccagggctatgattccagtcaccaagtctttgttgaatgcctactagcaacacagaattctcatgccactgaggtcataaaagatgatcagaagccagttcttcccaacaaaggaacttaggatttacaagtcagtaaaacatgtgcaacatttccagaaatgtaccagagttgttcgtgatcataaccccaaatcattggtacctcgatgtttagaggggaaacagcattggctgggcaagctggggcagggaacgtgatgaacagtgggctggaataagttaactggaggaggggaggcgtctcaggaagggagaatagcatgaacagcagcatagacgtgagaataaccatctggagtgatgaacctatgctgagtagaaagttccagaaggctgcataagggaggtgtgtgaacagcagaagcaggacaaacctgagatggtgagacattcttcccagggcaatctgactctaggagccacataaagacaatctttataactatcagcagcttaaagcctgatttcctcttaactctaaaactttcctttcgaaagtgtttcatttatatttacaagtttaatacaaagttacacaaaattcatattttatagaaatgcataaagaatgaagggtaaattcctctttaatcctatctagacaatcgtcatttgacataattctctcaactttatacttcctatgcactaattatataaatgagatcacaaaatgagatactatatatatacacacacacatataaacactgtgtttttactttgtatattgaatattttccattgtcagtacatagagctgcatattatttcatcatatgactagatcatggtcattaaaccatttctatactagtatatttaatgagaaaactagaaacaacctaaatatatgacaatgtcttcagtactttctttgtacccttcagaaggtatctattactaactggcttgtatttcactgatcttaccaactattttatgaagtctttgggattcgtgtgaaacatctatgtctttcatagcatctggcacagtcttccggacagagggtgtgttcaaatactgcagctggaatgaagacgatgaacactgaggccatatgaggttggctggggaaaggagaaactgaagaccattgagaaaggctgatcatttgctaatgcagggtcaaagtgatgacagcctggccttggtccatggtggtagaagtagaacataaagaatagatctaggagggatttaaaggccatcaacagggggactgcaaagtatatgttcaagcatcagtcacatgaatctcagctaaaacccataaacatgatggcttggaaaatccagcgtgatcactgcaacagaactgagtagtcagccttgttcccttgctcatgatgggcttggctaacacaagcccctgagggagaaaggtgagcacaggggagaacagacagtgaggtagaggcaagggccacccttcaggggagcacgaggagtccactctggagtctgtcatgcttgtggtcttcttggttaactctgagtgtcaaaaatgtaggtaggtagaggagggagggaggaaggggagtagaaaagagaatgaccagggctggggtttagtcagatgaaggctgtcagagttctaggaagtgttttgttcagaacagggctccaaccaatggcacaggactggggatcaaggtctggccctcaatgaagagcatcagagaagggctgcaaagggctgtgttgggtccacagcaagaaagatgtggtacgaggtagacaaagggctgtcactcaggctgggtaaccaggggcgaggggcaggctgggccacaatgtccataactcactctctacagcccagccccacacctggccccactgaggcctactgcacatagtgcctgaccttagaattaggaccagctttgtaatttgcctggcccagtgcaagatgaacctatgggacacctcatttaaaaaattaagaattttcaagatggcgacagcaaagcattaaactaagcatagggcccttttaagtaagcatcaggccctgtgcaaaaacccagaccctgtagctaagaggggaagacgggttgtcactagattttttttttttctttttttaagaacagtacagataaacagcctgttctcttctgaaacacactgctgggttttcaagcttttttctccccaaagaaaatcgaatgcaaaactcaacctaatgcataaaatagtctcaggtgcatcttctcaggctgttacgtcagggctcctgaactcccccatcccccaaatgcattgccaaagaccccgagtcactacctctgaccttggagacccaaaaggcagtgttaaagctcactgcagtaggctctattatcttgcataagagaacagtgaataagaaaaagccatatctggtaactgagagtgaaatacccaggacacacactgcaacagcaaccgtggctaccagggtgccccgcaggcagcaggtcaggaaatcaatcagatgcatggtttccacatcattctaccacagtatcattttctttccacccacagggtgacacacaatgtctcttccagggccattcataacataaccattttcattatttaaataaagtccctgggtcagtcacttgtctcttgtgaccatctttgagagaaaatttccagcaaggaaacaatatggagcaggcttgcttaataggctcatatgcataatctaccactcaccctaattaaaactacctttagaaaagctataaaatggaagcaaaaataaaaaaaaaattaaaagtcaacctaagatgatggaagtaccatgacatgaaacaactgtaactttaaatcgccagatttatccttaatacatggttttcaggcatttgtttggaaaaggcactgataaagtaggaaagaagtactcaactgtcttgagaaaggaactgagctgttctgttctggtgtagattgccaaagatcatgtttgcaaatgctgctaatcttatctgaacatattaataaagtccctaaatcctcctattaagaaatactaccactgacagtgcagctggctaacatttgcttcttaaatgctatcaccactctctttttttgtccaacccccacccgctgctgccccaacccccaagaaaaaaaatgatggctgcttcctggaatgtttagctaccaaaaaaatctctaaagcctcagaagacattgtgagagaacgatgatgaaagtcggggtgaaatgaacaattaagataaactatgcagaattctttttaaagaacgagcctcataaagctaccatgttaggaccacaaatcattctgcagattatttcccctctatctgtaagcaaagaggtgagaggattaggtcatttctaaggtctcctctcatcatgatgtcctggatttattgaaagaggttttaaacgcattttttcttttcttttctttttttttgaaatggagattagctctggttgccaaggctggagtgcagtggtgtgatctcggctcactgtaacctctgcttcccaggttcaagcgattctcctgcttcagcctcccaagtagctgggaggctaccatacccagctaccctacccaccaccatacccagctaattttttgtatttttagtagagatggggtttcgccatgttggccaggctggtctcaaactcctgacctcaggtgatccatccgccttggcctcccaaagtgttgggattacaggcgtgagccactgcgcctggctgcattttcttttatttactctatttcattagacatttcttgcttgtgtgcctaagttagctaatggggaaatccagcagacagcgatgggaagcaaatgattgcagtcatgctttttccttgactccatctcaagacccatcccacgctgcaacccaagtggatcgggttttaatgtagcaattctatcagtgacccatgctctgctggtcactgacaccccttctgtgtgtcattttccagggctgatgatatcctacgttctgcctaaaattgtctgaaactctattcatgacttgccaactacgtgactttgctcactaccaccaccacactgttctgttactgacagggaaaaagatgatcgtacttaaaagtcattgccaacagtgtgcagatttaaagcaggcccaacaactccttccaggttttatcagcagacacatatcacatacagaagcatccatccctttcctaatgctatttttaaattgttgtattttaaaattttcttcatttgtttttgaactttcttcttgctcatagatttttagaaatcgctgtggtagctattctttttctatttttttaagtccgaattcatatagagagaaccacggttaggagaatccttttcagggcaagagtgggtttctgcaggggttcttctggcactttccaaacctgaatgtctccaagtcctgatatctcaaattatctggcagaaataagaggcctatttttttttttttggcagaatgtgaggttctgccctgttgtaacaatgctgtcttctcacaaactactcatgtgccctataagaagataacccacaatccctgattctgctttattcaatgactagctactgcacagaccgtgtaaatggacaggacagccagagaggtgagtgggaagtttagtacagatgtgactgaaaacacttggtattacttctccccaagacttctcgaaaggagctagcacagagtattggtgaacagacttctgagcacctttttctatgtggcctccaagaagaaaccaatggactatttacttttctacttagcaaggtttcaagagactctctaataacataagtcttctgattactccctttcttgatcatgagaactagggagaagatggctaaactgaagcaacttggagctagaagataggctgcatctgctcagttcacctgcgcagaccaaaaacagtgcacgctgtaggcggcccagtccagctgaatttcatcagatgggcatgtgtttccttccccaactgctggcctcagcttctcagaaggtaatgtattgagccaaggtgagccctgcaggtgatcacctggacacctctgcccatctgtgagagtgaacagcatgcttactactgtggtaggctgcagtgccacagcaagctgattcacacgtaaaggacatgggcaggccatgagttctctctatccagggacatcttgccaactaaacctcccacctgccacctccaccttagtcctgcctgagtgtgctctcacccactaccttcacggatgtctctgcgtctctgttcactggctgtttccactctcaaacctacttccttttcctctctgcagaggggtgcatctcgggttatctccaaacgatgttcgattccactctctccttttattcaaacaattctcctcacatgagtggctacccagcaagtctggctctccctccagcaacccaatctagaaagctatagcatctgtctcataagggctgggttggctgtggttcattaagaaggtattaagcactttattgtaccagcttgccagaaaccgaagactccttctaaatctgttgcttcacctgatgccgattttactagcagtctgtcctaaaaatggtatatctggtaataaaaacagatattttgagcacctattagatttcagatgccatgaactattcactagttgatttatcttttgcatctattcatcaattcctttattttttgcactagcactgcaagccagatacaaactcccaatttacagataagaaaacagaatgtcaaagaggaagtagctgaaataacacagctagtaaattagagtcaaaatgaggcacaaagcccaaattcttttttacacaatgttgaacacagatgttatttttagcaattcatctccccccgcccttttaaaaaaaaaaaaagagacagggtcttgctctgtggctcaggatagagtacagcagcacaatcaatcatagcctactgcagcttcaaactcccaggctcaagccatcctcccacctcagtctcctaagtagctgagattacaggtgctcaacaccatgcctagctaattttgtttttgtagagatggagtcttgctctgttacccaggctggtcttaaactcctggcctcaagtgatcctcctgtctgggcctcccaaaacactgggattagaggagtgaaccactgcacccggcctcagctcccttttcttaggcaagtatcactacccagataatgccagattctacaacttctttctctcattcttaaacagaatatcaaaggcattttctacttttgaagatctgttactcttcatttgcctgtcatttgacaagctcttcctgaacacacgctccacattgttttagatgtggtgagaaatagcaaagggtaaagaatattcatttcctttaggagcttaggatctagcctgggagagggagtttctgctagatcactctgatatgaataattaagtaggaagctgcacaccactgaccaatgctgtcatcaagcacaacccacaagggagaggaacaataaggtggtgctggggaacatgaacccacacaaaagagacacaaaacgtttagtgaggtcaagcagggccaccctcagaccatctgctctgtggggaggggctttgaaagccaggcctcaaagccagtacttaagatagtcagccaccagtttttgatgaggggcatcaatcatgtctaaggagtgcctgtctctggtctgctggctgtaacacttctggattctgcgagactttgcatacattctcttggatttgacgtaagctccagacagcagtgagcaagacttgttaccaggatccctgagatcacagtgaggggaaggagagtattctgcgacactgccagggcagtgacctctcaagaaaatgaaagggaagtcatccttggagatgtgctggcgggggtggggcaggacctcccaagggcctcaggcagctcattaacgtgatattaaattgctctgtgtgtgaggttttcagaaaggacaaaggacagaactgctgctgagccaaggaatcagagcagaatcccagcacactggctccaggagagccggacgtcccctaggctgcccaccaaccaggatgaaaatcgagacatcagagcctctgtcatttatatggtcccctagcagtgccctgggcctgaatcctacaaagctggtccttcagctgggagccatattgcttcaatttcatgctccatcacaagagtaagtcgactgctgagttgtaacgtatgaacttcagccagaaattcaccctcccacttctgagtataatagcagtcagtccctaggagtgaaatgtgctccttttttgggtcaacagtagagcaagccagaattaacgcagcccttttagaagtcatcttgctaatgacatcaggaaaggttgaagcatttggcaagtaatcgtatattattgctttacattattatgtaacttttccttatgtgtttcttcttgcttttaaaaaaattagatcttaaggtcttcgataatagtgattttaaaaaatctatccttgagttcatgtcctttgtagggacatggatgaagctggaaaccatcattctcagcacactatcgcaaggacagaaaaccaaacaccgcatgttctcactcataggtgggaattgaacaatgagaacacttggacacagggtggggaacatcacacaccggggacttttgtggaatggggggaggggggagggagagcattaggagatatatctaatgtaaatgatgaataatgggtgcagcacaccacatggcacatatatacatatgtaacaaacctgcacgttgtgcgcatgtaccctagaacttaaagtatcattaaaaaacaaaatctatccttatagtagtcccattaagtactaaaatgaataaatgaataaacatatggatgaaatggaaaatctgtacatatatggagggcttataatgaggttgatttaatctcttaatatgttttatctcatacgtacagaagagtcattctctcaaagtatgatccttactttggaattagaaatgcaagttctcaggcctcacccaagacctactgaatctgcaactctaggggaggggctcatcaatctggattttaacgagagctggtggcaaatgttgtttagacacagttcaccctttagactactggaaattctagtctagtctttaatctctggagaaatccaagaacagcctacatccttttcagaatgatcaaagattgacaccaaagtgggtttttattgtggttgttttggcagacatggtatctggagaagaaaacaaaaaatgaaaagaatttttttacttgacatttgctggcattttcatagttactgagcatgaaaagaaataaaccatgaagcccatgacagtgagtgaacacacgttttttcaaaatgtcttgcactatcaaatcaatccctcaatcagcttgcttttgagtttaatcgagccaaggcagtattattgtagctgtcacaaattttatgggtttttttcccccttgccctgtgaagctggaaccaattgttgttataaagagactaaataaaaaaggtcctggatttcctgttattacagatcgattttttgagattctagaatatcatatgggttttttataacataattaaaaccatgtgaaatggcacaacatagactttaccagagattgatatgatcatgcttccaaatgaaatacttcaagaaaatcactagataatagttttccttaatatcctctatcacagttttatatcacattgttcaaaaaatctgctttatgagaaatgtcaaaatatataaatcagtcaggataatttctattggttggttagccttattccctttcaaagtttagcaaatagagatatgtttgcttaatagggaggcagggacagtcttcagagggcaggcagctgaaactgaatcccagaaccattttcacaagaataaactatgacttctcagaacatttgtgcttcattgaggacgcaatgtcttgaagacattaaagagtatacgtgtgtgcccctaagatggttttagtttatgtgtcaatccggttagaccaaggtgtccagttgcttggacaaacactagtctaggtgttgctgtaaagatattttaagatgtgataaacatccagtatcagtagactttgagtaaagtatactgcctttaatactgtgcataaggctgggcacagtggctcacacctgtaatccctgcactttgggatatcaaggagggtggatcacttgaggccaggagttccaggaccaggcaggccagcatggtaaaaccctgtctctactaaaaatacaaaaataagccaggtaaggtggtgcgcacctgtaatcctagctactcgggaggctgaggcaccagaatcgcttgaacctgggaggcagaggctgcagtgagccgggattgtgccagtgcactccagcctgggcaatatagtgagactccgtctaatatatatatatatatatgtatgtatgtgataggcctcatccaatcagttgaagaccttaagagcaaacactgaggcttactgaggaaaaactcctacctccagacggcaacacaaaatctgcctgtgtttccagtcttcagactcaagactgcagcatcagctcttacctcaatctccagcttacactgttttaacttacgaagcaccaccaattgtgtgagccaatttcttaaaataaacttctctgtttctctgaggactcctgaccaacatatagtccccaaccctaatttttaacccagagtctccaagacattcacactcttttctcaccattttagttgaaataacttggttcaaagtgcagagaaaaaaaaaaatcagggaacttacaagaattatcttaaatcctactgcctacaccttcacaagcagaaaatggagttattgctgtactatcattactacaagttagagtcactgccttaaacatccagaatcctacagaacttaacctatgcttccatgattccatttggtatattaaatgattcagctatttacatgcttagctttcccatttcatcaggagcatctcaaggacaggaaatgtcagttttaaaaatagtttcatgtaataggtatgaaatatatttttcctaaatgaatgaactgtcaaaatcttcaaaataattaccattctaaatgctcttctggttcttcagttttccctcatttcaaacaggacatgttctatctgtgctacgaggcataaatggaatagcagctgggactaaaaaaggctacacccaggtgcccagtaactcctgacataactcagagtttaggcatcactggttcacactagtgcctcccatgtgatctgattataataatgttagatggctttttcactgagtctagattagaccacagtgattctgaaactgaccacagtgcaatattttcaaagaatttatagtacggttagttgcccaaaaagtgtctttagtttagaacttccaataatttagttgaaagaaactgaagatgtgaaatgtaagctcacagttgtaccataaaacatcttacttaataagccacacttacaggaaatgaatggccaatggggtgtattagagaaacggggtctatatctacaacactgtagtagaaattatattggcctaacatgacttgttataaattgagtcaaaaccacgagctgatttcacaaacttcctcccaaaagttatttcatcttaactctacacatatattccacaaaaatataactttaaacttctatactctatttttgaggaagaaagtagaaataaaaaatgtgctggttaatgtaactttcatgaagcagatttgcagggatattctctgttatactgtagcctggcaaggtgtttagctttgttacataggtcttgtggcatccatgtgtttgcctggggtgaggacagacttcagcttatacctctaggtagatgactcttcctcctgttaaaaagaattaacacactccattatgggttgaatcgtgtccctctaaaattcatatatgtggaagtcctaacccccaggacttcagaatgtgaggtttgaaaagtagggttgttgcagatgtaattagtaagacgaagtcatactgaagaagggtgggtctctaatccaatccatataaaaaggggaaatttggatgcagagacacacacacagggaaaacaccatgtgaggataaaggcagaggatcggggcgattctcctgcacaccaaggaacaccagagatggctagcagacctccagaaggtggaggacagacctggaacagaatcttccaggcagttctctgaaggaaccaaccctgctgatgccttgatctcagacttcagcctctagaactatgagacaataaatctctcctctatgagccagccagttggtggcactttttaatggcagccctagcaaactaatccacactcctacctaccacagaattcatgggaaacaggcaaggaggcagactgcaccaggtgtggatcacagggcaaaaggtgaaagagcagaacaaggtcaaggggaaagtgcacttttctaggttatccacaaagctgccagccagcatttgggacaaacctacaggaataatgatgagatattttaataaaagcatcctcagactgagaatgttcaaattatagtcaggattttgatactagaaattaatatctaatacagactaacacaatatgatcaatgctgacaaaggatggcagaatttgagagaggagcaagagaataaagaccagttgacccttgtagagtcttgtgaatattatgcttaagttcgctgcaaagttctcatttcatgcagtctttcctcagtctttcttaaccaatcatttgaccatcattgatagggtcctaagttgcagtggctagaggtaatcatctggaagactggtcataatccacattggcagctacaattctcatgcccagagcaggtcatactgggtaagagcccctcccacctcgccaattttgcatagatggagttctgctggaatcgataagtatacagccagtaactaccatcacaatgtagatacagaacatcaccctaatcccacatgtccctttagttaaccccttcccctccagctccaggcaaacattgattgcttttctctagtttttcctgtgtaagaaaagttactaatctttttgcatttggcctttttcacttggcatcatgtatttaagatccattcacgttcttgcatttaagatccattcatgagtgtatgttcctttttattgcccagttagtgttcacgttgtggatataccacaacagcacgcatgaaaggcatttggcttgtttccaggttttggaggttacaggtaaagctgctataaatatttgcatacaagttttgtgagtgtgtgtgaacaaatgttttcatttcacttgggtactcaagaacagagctgccaggtcacttgatgagtgtgaaattgaacttcataagagaatatcagtgttttccgaaatggctgtaccattcagatggctgtttttaaagtagctcattacacttgacattcaggaaaatattcaagtctgtaaatatttttgtcaataaacagctttagtagaaatatcaatgttaaatggggacaatgcctaagacttgtgaaaaacctaggtgtttatgactggggcaaagctgtagtggacaaaggcataagactaaaagttgcctctgtctgcccttattttgattgtgacaaaatgtggaattaaattgcttttgctgcctcccctacaacaatgagctgtgagtgaggcttgcatgtggtttctttacccagccatgccccgtctacttgctctgccaacctgccactccctccaatgcttctgtcttggtgtgaaacaaatgacttcagaaacacagaggagctgaaatgcatccgtgtgtctggaatccatgcatgtctcgctcagactgtgcctttccctaaagatctgtttgctgtcttttgaagtgagaataccagcaagtctgcatagtgggttttgcctacctgaaagagatgttttttctgactcctccctaatcccttctctctctgaacttgactctagacacagatatgcctataaatgctcaggaccaaaagaaaacatggtactaagctaaaggccagctggctggcacataaaagaaatccaatactttatttccttctccgaagggtcctcatgtaaacttgtgttcgtggagacgcagaagtgtttgcggtgggtctgtttctgagagtgtttagctgtcttggatgtggaagaaaataggaaagggatggcgaaggttgagagagaaaaggctgagcattgaacatatgattggggccatgcgaacttaggcagaaaagcatttgtggggtcaccagatggcagctcaacctcagaggctgctctaggtctccaggcagcagttccagctggagttggttttctctccaacaaaaaccaagtctggcagtgcagcgggggtttgaagattaatttaataaaaggaaagccccctggaaagacacaagggactagcttaagctgcccctgattgatggcacttctgctattccccagtttcttaagctgaatcataaagtctaccccagacatatgagatcacatttgatgaaaatatgctcaaatttgtctgccagtagaaagaggtgttaataagaatttgtggatttttaagaatcaattccatatgtatccatgaataaatgagcagaggtataaaagacaaaccgatgcctgtacataggcacacaccccatgtgtgttagcggttcaacaaacgaggtagttgtagtgttactgtatgaaattttgaacagatgtaaatagagaaaaataaatcaataacatggattgaccaaagtgaattagtcacaaaggaaagccaatctacagagctaaaatagcttcaatagaagatgcctgtttttcataaggcccaaaaccataaaaaccctagaagaaaatctaggcaataccaaccaggacatagacatgggcaaagacttcatgactaaaacaccaaaagcaatggcaacaaaagccaaaattgacaaatgggatctaattaaactaaagagcttctgcacagcaaaggaaagtatcatcagagtgaagaggcaacctacagaatgggagaaaagttttacaatctatctatctgacaaagggctaatatttagaatctacaaggaactgaaatgtacaagaaaaaaaaccccatcaaaaagtgggtgaaggatatgaacagacacttcttaaaagaagacatttatgcagccaacaaacatgagaaaaagctcatcatcactggtcattagagagatgcaaatcaaaaccacagtgagataccatctcactccagttagaatggcgatcattaacaagtcaggaaacagatgctggagaggatgtggagaaatagaaatgtttttacactgttggtgggagtgtaaattagctcaaccactgtggaagacagtgtggcaattcctcaaggatctagaaccagaaataccatttgacccagcaatcccattactgggtatatacccaaaggattataaatcattctactataaaggcacatacacacgtacgtttactgcggctctgttcacaatagcaaagacttggaaccaacccaaatgcccatcaatgacagactggataaagaaaatatggcacatatacaccgtagaatactatgcacccataaaaaaggatgagttcacgtcctttgcagggacatgaagctggaaaccatcattctcagcaaactgacacaggaacagaaaaccactgaaaacactgcatgttttcacttataagtgggagttgaacaatgagaacacatggacacaaggaggggagtatcacacaccagggcccgtcagggctgggggtggctaggggagggatagcattaggagaaatacctaatgtagatgacaggttgatgggtgcagcaaaccaccatggcacgagtttacctatgtaacgaacctgcacattctgcacatgtatcccaggacttaaggtataataattttttaaaaaagatactttttatcagaaaaaaaatgtaaagacataaaagtcacagtacaaacatagatgcttgtcaaattactggcttaaagacagatttcagccccagtgaagtctaaatcactgagttttgcgctctcagaatactagatgatttcttatccaacttctcctaaaactcaataatcccctcaacaaagccttgacaggtgagttatcttttttgacaactactgtaattgtgtatttgataaatgcacctgtttgcctctagatttgctaaaagtagctgggaaaacaaaagaaatactgcaggaaaatgaaaaaagcaacaattcacagttccatatatgtgcagacaggacgtggatcatgcacctgacaaacatttcctatgaacagctattctcaatctcagctgaccactagaatcacatggggatctttaaaaaaaaaaaaaaagattcctacgtcccagccccagacactctcattcagaggtcccggtatgtcacctaagcattgggcacttaaaaagcttttcaatgtgctctaagattggaaactactatcattattctggttccaaccaaggacaattttaatcagattttattttgtaatgcatttgtccacatttatgacaacggttctacatcagacaacacacaattccagagggccctcggcggttcctacatgctctatggtggcagccacctgcctggagcatgccaacagaacggaatgttaggctcttactgcgttagtgtctctgtccctgagatctgtcctggactgtccctgaacagcagcattcaattccttgtctcaggatttctatttactttactggcacatgctgacctgacttccccgactgagacagaacacacctcgaacatactgagccaccacctttacccctagaacaactgctgctgctgagcacatgaaaaaaaagatgcctctgggatctgaagaacagcattaagaataaatcaccctgaagctcctctcttttccataatttgagaagagcaaatcacatctgattcgaataggatggatcttctgtgaaagccagagagggaaaagtttgggtctaagggtaaaggcagttgttgctctattgtagtatgaaaggaaaatactggggccccgaattactaagctaaagggaaaatttaagctgggaactgcttagggcaagcctgcctcttgttctctttaaagtcacccctctgctgaaataaacacatatctgatcgcctcctttggagatgctaatcagaaactcaaaataatgcaaccgttggcctcttatctacctaataacctggaagccccctccctgcttcaagttgtcccgctttactttgagttgtcctgccttttccagaccgaaacaatgttcatgttgcatatgttgattgatgtctcatgtgcccccaaaatgtagaaaaccaaattatgctctgaccacctggagcacatgtcgtcaggacctcctgaggatgtgtcatgggcatgagtcctcagccttggcaaaatacactttctaaattaactgagacttgtctcagatattcagggatcagaatcgaaggtctcagggttagaaaatcttgggaataatctagttcaacattcttatctgtgatatcaggcaagggagtccccaaaatgtaaagcgacttgcccaaagtaggagctggtgtctggacgagggtgggggatcctgacccagttcttttttccatgggactgtttgctcacttccaacattttacattaagtcaaattttttaaaaacaaaataaaaggggaaaaaaacttcctgtggaagaagtctagcccatatgttgatgccacacatctgtgggtgactagagaatgctgaagtggccatgacatgctggccacactggggggcctggcttgcgactttaatccacctctgtgtgctttccattagaagccatctctcccgtggatgaggagaggcaccagagctctgtgctgccgcttttgattagtttatttcctttaacttgagcatcagtcgccaacacatctgaaactgaagtgacaacttttcataccgcttgacactgaggggaggctgagtagaatatacattgacaagagaaatataaacttatcagacagagttttattcttgtggacaatgttcaaggcactcccactcatgtggcctcggctctcttgaaaagaaaagcccactgggaggctgaggtaggcggatcacgaggtcaggagttcaagaccatcctgaccaacatggtgaaaccccatctctactaaaaatacaaaaattagctgggtgtggtggtgcatgcctgtaatcccagctactcaggaggctgaggcaggagaatggcttgaacctgggaggtggaaatctcagtgagccgagatcacgccactgcactccagcctggtgacagaatgagactccatctcaaaaaaaaaaaaagccccaaaataacagatattggataccaggaataggagctatgcccaagggtaactaacagaccctagtttggaaatacccagatccactgggtaataaagcacattctcatcttccaatgcttagaaatagctcatggttcctaacattttcagtaacctaaggaaaagaagaataaaagggggctttctggtttctccaaatacaccaaccactacagcattgtctacttctgtattacttacgttggggccagatacttcttccctggggaattggaaaggctgttctaagcactgtaggatggttagcagcattcctggtatccacctactaaatgtcagtagcatttattatagttgtgacaaccaaaaatgtctcagacattgcccaaagcccccacctccccgctgagaaccactgcactcaagtgtcttatccaaccacagcagcagttccatttagtgttttgggttctctgccttgtcttgttgctgacaatcctaaccctccttaggaatcatgggctaagtgtgaagattaaaggggagaactggaggttagcacctgacccctaagacaccccccaggtacagggctcctgttcttctcacaaaacctgtggacccacttgactggtctgccactgtgcctcatagtagggtgctcctgtaccctccggaaagctctcttccttcgtcttcaccaggctaaatcctacccattgtttaaggttcgagtcaaaagcaacttctcctatgaagtcttcaccgccacctctcccccgtcagttaactttcttatactttctcctgaactcatatacttgtgacaaaagagaaaactgcatggtgacctgaaaccatgccacttccactgatttcttctagggtcttagacttcagaggtgatgttgtccaagcctgaggctttactcagctgagcaggtaccagtctaatcataatcaccagaccacaccatgaatgccaagtacgtgacaagaaaaagctgaaacttaaatgttttgtgcaaacagactaagattttatttggagacttttgccagagactgaggcaagagactcttggcttaagaactcaggctcttcaactcctcatcatacacaccctggagtagtgatgggggaagggagcccttgctgagcctgacagcagcaagatcagccccaatagctcagggtggctggcagccaccccccagtccacacccaacctctttcagttactatctaccctgctcccaaactctttttttaactaggtaaaaaactaatactcaatttgctaactgtgaagagattatgtaattttacaaaggaaaaagtcaaactttcggagacatggtaactttttcttccttaaggcaggttgtctgtcacccaggctgaagtgcagtggcactatcatagctcactgcagcctccagctcctgggctcgagcaatccttccacctctgcctcctaagtagctgtgactgaccacaggcatgtaccaccatgcccaactaaataaaaaaaattttctttttgtagagatgggatctatgttgcccaggctagtcttgaactcctgggcttaagtgatcctctcaccttggcctcccaaagtgctgggattatagccatgagctaatgtgcttggctggtaaccattttttaaggctaatttctaaccctgtgttggattcatcacctgaactcagcacagggatgggttctcccagttaagcacttttactaaattgaaacttacactttcaactttaattgtaagcccacagaaaaaaacaaacaaacaaaacaaacaaaaaaacccagaacacatagcctaaactctactgaagatacaaaattagagattctcatggatgaaaaggaacttcaaggcacttccccagctgtccatttcaatgcccacgatttcagacatttcttccactgatctgaccgtaacttctcctgggggtaggaggaggtagagggcaaaactgtgcccaagtgagaagcatagcaagatgagaatgtgttgccctttggttttagcttttcattatcaaatggccaatgccctttttctaaagggtgatataaatcaatttccattgagatttattatgaggaggaaaaaagcttctcccctataaatagcagcctaaggccttaccctgtcactgctttgcgtgtgtgtgtgtgtgtgtgtgtgtgtgcgcgcgcgcgcgcgcgcgcgtgtgtgtgtatgtctgcgactactgagttgaagaagagatctttccacacagagaagggcaatttttttgtcttaagggctgcctttttattaggaccctttaaacaaactgatatggtttggatctgtgtccctgtgcaaatctcatgttgaaatgtaatcctctgtggagaaacagcaacacttttacactgctggtgggactgtaaactagttcaaccattgtggaagtcagtgtggcgattcctcagggatctagaacaagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaaggaaatgtggcaaatatacaccatggaatactatgaagccataaaacatgatgagttcatgtcctttgtagggacatggatgaaattagaaaccatcattctcagtaaactatcgcaaggacaaaaaaccaaacaccacatgttctcactcatagatgggaattggacaatgagaacacatggacacaggaaagggaacatcacactctggggactgttgtggggtcgggggaggggggagggatagcattaggagatacacctaatgctaaatgacgagttaatgggtgcagcacaccagcatggcacatgtatacatacgtaactaacctgtacattgtgcacatgcacccgaaaacttaaagtataataataataaaaaaagaaatgtaatcctcaatctttgaggtggggcctggtgggaagtgattggatcacaggggaggtttccaatggtttagctccattcccctagtgctggtcttgtgatagagttcttgcgagatctggttgtctaaactgtttagcacctccccgttgtccctcttgcttgtgcttcaccatgtaagatgcctgttcccccttcaccttccaccacaagtaaaagtttcccgaggcctccccagaagcagaagctgctatgctctctgaatagcctgcagaactgcaagccaattaaacctcttttctttataaattacccagtctcaggtatttcttaatagcaatgcaagaacggactaatacacaaactcaaagcctttgtatgtgccctgagagaatccatccagaagacaagtttgattctatgactctcctgcttgagattggcaagttaacagtttcctattgctgtaaggcaaaggatcagaatgcaacacacatgttctgcccttcacctggcttgcaagacgcaccatggctcatgacctcccagctgtccgagttggagtcacactgtcctgctttagtttctgcagcagcccgccatgttccttccagccaaaaagccttcaacatgttccctcaatatggaatagccctggctcacccttcagatctcgtaagtgtcatctgttacaggcaaccccttctgatgccacctctactcccaaggtacccaggtctctctgttacaagccctcttatcccccatgtaatcaccttcatggcacttcaatgctatctgaaatcacaatggccattttacatttttggccattttacatttatttggtgaacatctgattattatctgcctctccaccaagactgcaggctcctgaaaataagaatcctgttgggctatcactgaattcccaaaatcaagctcaaggtttcacatgtcccagaaactcagaaaataactggtggatgagtgaatattcaatcaaatccattgggattttctgagaaccactttcaggtacctcaaattctagcttctccagtcagaggtggaaaagtggcaaaatatcttattttgttaagtatcagcaaaacaactttttagccatcataaacccaagtggaaggaaaattacaaagagatgctgaagatgcctggcaccctgatccactcctcatccagtattgcattcttcattgtgtgcatcatagccatacattttcatcaagcttgtacaaacagcttaatccacacacataggcattaatatcatttaaaaattgtcacttagtcaaagtggcatgtcctatttaaataagtttaagttgcctacatgtatttcaactactatttctaaacctgctgccatgattttaagtgtctagcaataaaattttagatcaaaggagtaaacttagggtttggaaaaatttgctacaaagttcagatcaaaatggaggaaaatctttctttttagtaataatattggccttttagtaatttcacttttaatttgatgcatgtaaaatacaggtgacatatgtacatgtaaaatagtacacgaaaactagtatcatggacatgagaaatgctcagcctaactttaatgctccactttagtcataagagatttctcatgagttcagtccaataaaggactcaaagtttttaaaacaaaagtcacatgatactccctgggaagaagagggaatgagccactggattaccctcttctttccatttcaaccacagggaggctagtagcatgaaaatagtgtgtgtatgtgggtgggaagaatcaaatctacacaaacacacttgagaagaagataatctccatgtctggaaatagaaaaacataatggtgagtggctgaaatcctctggcccatggggagtggcccccactgtgtttagcttcaacaagcatgctttgggacacaaccagaactaagctccctggaagaagtaatgagctaggaccagaccaatgttaaaactaaaatatcccttcatcaaaccctagatatgatcagaaatgtaatactctcctacggccaaggaggaaagaacatctgcgatgggaaagaaaagttggccagcactgcaagggagctcagcatccagaatggacctcctctgcatgacaaagcccaaaattttcaacaaaagtttcagacccattcaacactgtgcacccctcatagacaggctagagaaaccatgaaaacacataagatgatttcacataaaaattataaaagcttaataggaaatccagtaagaaacacctgaaaggcacaacagatgagaattcatgtgatgcaacctgataaagcattctgcaaagtaccttaaaaacgttctttattctttgagaagggatagcaaactttccatgagtctggagatcagaaaaaacagagggcagatatgaaacagaatgaaatggaaaccgtgaacatggaaataaaatctttaagttataaaagaatagatattcatttcgttaggaagaaaaactggtgaacatgaaggaagaattgaagatgacttcactggtaagttctaccaatgtgcacagaatatctaactccacagaaactcttttggaaaattaagatgtacttcccaaattgctttataaaccttaaagcccagtaactatgagaaaggaagctaatctcagtcatgaatatcaatgtgaaaatcctaaacaaaatgttaacactccaaatctagcaacaaagaatatattgtggtcagcttgggtttatttcaggaatggaagtgtaacactgaaaacaataaaaaggacttgtcacctcaacagactgcagaagaaaaatcataatcatctcaacaggtaccaaaaagcatttgctagcattcaacagtcatgtatgaaaaaacgttttaccaaaccaggaatagaagagatttattttaatcccgttatattagtcaggacagaacatgttataggaactaacagactccattttcaagagcttaacatataaagtatatttcttgctcatacacagtctgcttatggtctataggctttttggagtagctgtcttccaagaagcgactcagatctaggacgcatttgtctaatctatcgccactcctattcagcatttttctgaaagtctcagctactgagttaggcaagaaaaagaaatatgaaagaaaaataaaatttatcttaatcacagataagattataaaacagaacccaaaagaatcttgaagttaattactaacataagtttagcaagtttgctagataaaaatttatacttgaaatcaattgtactttttgtaaagaggcaacaaatgaatttttgaagatactatttttgatagcaaggagccagcaataagttggagaaaagaactctacaaagaaaatataaagctttgcaataaattagagaaggctaagaagaaatcggatcctgataatgagttggaagacttgtattatacatatgttggttcttaaattcatctatagattgaataaaatcctaatagattgttttagcagaatttgatgctaaaatttacatagctcaaagggccaagaatagccaagattaacttttggtttttgaggtatagcctatatacaagtaaattctataattacattaatctgagtgtacagcctgattatttctgacatgtgtgcagaccacataaccaccacttggattaagaggtaaatattggctgggtgtggtggtgcatgcctgtaatcttagtacttgggaaggccgaaatgcgaggattgcttgagtccaggagtttgagaccagcttgggaaacttcgtgagaccccatctcattataaagaaagaaaaaaaagaggtaaatatttccagcactctgtgtggtttccttgtgccctttccagattataacctcctaatactgaacttttcccaccagtgattagctttgcttgattttgatcctcatataattggaaccacgcagtatgttttctttttgactggtttaactcttgtaggtaatttttctaccagatagcaagaagtatttctcttcttaattctagagggcccctcttgctgggctaatgcagcccctggtagctctagcaatgagagctagcaatggcagtatacagctcttctggcatctggttcatgcactgaaccagaagtgcttctcagaaccaacctccagcagtgccaagtgaccagcaatgcccagcatttttcagcttcccctagcatcctctcaagcagctgctcagtggaagaccacctgtgaggcacctcaaaggctcccctgatgccccctcgggaggctttgcagcaggctactgcaggtgaggaaccatcccatgcacaacttccccagtaaccccttgggtagcttcacagtgatttgtaaggtgtgatacttcctgacggatggctttcccagcatcccagagggaggatgtcctgaaagttccagtagcacagcatcttagcaatgtaaccacgcattaaagcacagccatgcccttccaggaaggtctggaactcaacccttggggatccctgtggacagggaaagggagagtgaatctctttcctggtctctatctcagccttaggggcagtatatctacttcctagattgccaattcaccaacttacattatagttatctaggagaggatagttcatcaatatgggccacattagtgatagaaagcttaaactcaccaattttacataataaatagagaaagttacctcttacaaaagcaacaggcccatatggttttactgagtattctacaaaccgtcaaagaccagctaagtaagtccaatatcactgatagcaccacaaaagactatttcaaccaatatcacacgataatatcgacgtaaaactccaaaagacaataacagaatacaatctcattaaaaatgttacacaccatgggccaggcacggtggctcacacctgtaatcccagcattttgggaggccgaggtgggtggatcacgaggccaggagatcgagaccatcctggctcacatggtgaaaccccgtctctactaaaaatacaaaaacaaaattagccgggtgtggtggtgggtgcctgtagtcccagctactcaggaggctgaggcaggagaatggcgcgaacccaggaggcagagcttgcagtgagccgagattgcgccactgccagggcgacagagcgagactccatctcaaaaaaaaaaaaaaaaaaaaagaaagaaaaaaaaaatgttacacaccttgaccagctaggatgtacttcaggagtgtatatttgctcaacagtaggaaacgtatcaatataacatagcatattattaggaaagagaaccataagattatttccatagtgctaagaaaaagcttctgacaattcagcacccattcttgattaaaagacacacaccgacaaaacagaaattgatggatatgtaattaatcctaaagtcagcatctttacttacctttcttaatgtgaaacgcgaatttccactatagtcagaagcaaaacacagacactacccccactactactgaacattattacttcttaacattaacattctatttagccaaatcaattagaggcataagaattagaacagtagtaaaactatatgtgcaaatgagacagtgtatctagaaaaacaatgaatatctccacagcaaaaaatttagtaaagaagcatataaaatataaagataaaatgctcagaaaaaagcttaagaaatttgaaaaacataaatgaagaatgttttaaaacactcttgaacggcaaaaaggtaaacaataaaaagatattccttgttcttgggctagatgactcagtaaggatcagttctccttaatttataaatttcaataaaattacaaactccaaaaatatcaaatttttgtttttttatggagctaggcatgatgataccaactccacatggaaaactgaacatgcaagaatagtcaataaaacaccaaaaaagaaaagccacaggaggaatatcccagacagatattaaaacatacaaccgcatcttaagttaaaacagggttgtatcgcacatgagtaagaggacagagaccaatggattagagcagaaaattcagaattagacctgactactttggaaattttgtatatgaaacatggtaactcaaatcactggggcaaaaatgggttttaataagttgtattaggacaactaaatagtccattagtaaaaagataaaattagatacagacttcactccatacataagaataaccttcaaaggatctgaggtgtaagtgtgaaaatttaaactacaaaagtgctagaaggaaacagggactcctctgtaacctgggcataaaaagctgctaagtaggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaattagccgggcgtgatggtgggcgcctgtagtcccagctactcgggaggctgaggcaggagaatggcgtgaacccggggggcggagcttgcagtgagccgagattgcgccactgcactcccgcctgggccacagagcgagactccgtctcaaaaaaaaaaaaaaaaaaaaaaaaaaaaaaaaaaaaaaaaaaaagctgctaagtatgatcaagttccagatgcaactgttaaaaagaataaacttggctacataaaattacttttgcatagtgaaaaatgccataagcaaagtcaaagaacaaaagaaaaactgggagaaaatatttgcatcatgtatcacaaattaaaggctgatatccctaatatgtattaataattacatatatcacatatacatcgtataaactcaacaactggagggactccaaaagcccaagagaaaaatggacaaaattcatgaacacacagttcataagataaaaatgatcttaagtgtgttaagagatttccaagtctacccataagaagactggcaaaaatgaaagagctcgaaaacactctgttgctgaggctgtagagaaacaggcacactcatacattgctggtgggcatacaaactggttcaatccttacagaaaggaaataggcaatacctaaaacagaaactacaagtccatttacctcttgaccccagcagtctcgcttttaggtattcgtgcttcagatacaataaaaatgtgtgtgcacaaggctattaatttcaggattatgtatcgttacaaaacattggaaagagtaaatacctatacaggttaagcctccttaaaccaaaaatgcaaaatgctccaaaatctaaaactttgagcattgacatgatgccccagatagaaaatgccacacttgacctcatgtgacacgtcccagtcaaaatgcagtcaaaactttgtttcatgcacaaaattaccaacaacattatatgaagctgggcatcataatgtgcacctgtagttccagctactcaagaggcttaggcaggaggaccacttgagcctatgagttcaaggctacagtgagctattatcctgcctgtgaacagccactgcactccaacctgggcaacacagcaagtctgcgtctcgaaaaaacaaaataaatagttattttcaggctatgtgtataaggtatatattaaacaaatgaattttgtgtttagacttgggtcctagccccaaaaaatctcattatgtatatacaagtattccaaagtctggaaaaaatctgaaatctaaaacttttctggttctaagcattttgaaaaaggcaactcaaaacccgtatttaagagacagattgaatgaactatggcatatcaacataacacaatactttgcatctgcaaaaaaagaagatccttacagatataaaatgacatctacaatatattgataagcaaagaaagccaagtgcaaatgcacacactgtatgccaactttactataataaaggggacaaaactatagatagatatatatactactatagatagatacgtctacttatgtttacaaaaatgaacatgggaaggataaactaatgagattggtggacaggtgaaaatatattggagtaaggaagtgacacttctccatatagttttgtttagttttgccttctggaaccatgttaatgtttcatgtgctcaaatatcacctgcataaggacgagtgcacagtcagcaaaattcaaattgtaggaaccaatacaggtcaaagggcctaggatctttaacagacaaattgtaaggggggtttaaaaataaaaaaaaaggaaggaaacctgcagattaaaaaagatttaaaaagcattttgaattaaaaatgggcaaattttagagatcagtgatgcgtacatgggcaataaaactatgaaatgcaaggaagtgttaggatagtggttaatttgggagatatggaagggtttgtgctttaggacatggagggacatctaaggttgctgaaaagttatatttattgtcctgggtggtggccacaaaagcatgtgacttatactaagtggcataatcgtttggtattctagatctgtgtttttaataaatacctttttgaaaaaagactaaatgcctggccattcttcagctgtccatgtgatgtccatctgcaggcatccttaaatcttcagttcacatttttcttgccacccaggacaattctataatacattccttccattagatgatgtgtgatcagagagtgcattctagtttttatattagcttaagaaaaacatgaatagtagattgtaagtattgccaacaataacttttgtaatgcattccagtaccaactgtaaattccaaagcctgtcttctctatcagctgttttagattatctccattgccatcctccttcagtagcacagacaatgaaaatacaatcccattttcttgagctaaatctgtgagaaggtgaaagaggcctagtgttcttacataagagctgaaattttgtgaactccctggacacacttatcatcctggctgcaggcagttttggcttgagtagtcaagattctttatttgtgctgacattcaaacactcacaacattgtgggagaaaaaaagcaaaatcaaagctgttctcattgtccaacttctttcagttagctgtataaattgtaactgattaagtctgggacatgagttgacaacccattggtcactgcaagtagcagcctctggactaaaaatcaagtagctgtaggtctcaggaggaactgcacggggtccatatcccaaagaggggtgacctcccattccaacagcaatgacatattctttcttaccttgtgcattcaagaaccatgtccccctaaagccaggcaaaactgcacagtctccctctgtcaagttccccagaagtctagatgaaggtacaagtgtttgcttcaccagcaagccaaggcagcttcatgaaaaataccaagttctctctccttctatggttcttgccatcttggggcccccaaaaccaaggcaagcttgattacctatcctcctccttaaaaattagatagctgtttaacaatgatcccaatgccttccctccgtcctccttctacaaatgaatccgctacagatgggttcctgaaaatttgagtgctaaatgttaaaaagcatgtagagatctaattacaatatttaaaagaacacagccagggctagtgtagtcaaattcagagagacagaaaatagaatgaggattgccagggtctgcagagagaaaggaataggaagttgttatttaatgggtacagagtttccgttggggaaactcaaagtgtactggagatggatgatgattgatggttgcacgcgtacttaatgccagtgaactgctcacttaatggtgaaagcagtaagcttctgttatgtatgtttttctacaaagttaaggcatcaaaaatacccttgggcaaaacaaaattgtttcataaatcatcttttagttctgcttggaaagtgaactttcttaaaaggggaaaagatcttcaactggctagcctagcagtagatactcatttcctcggtgctactcactttgtcaacagtacatctttaacccgagtctgcaccctatgagtagggatgaaaggcggcattctatgtgcagtcccagagacagtccctaaggaagtcattaagaatagcagttctcagccgggcgcggtggctcacacctataatcccagcactttgggaggccgaggagggtggatcacgaggtcaagagaacaagatcagcctgatcaacatggtgaaaacccatctctactaaaaatacaaaaattaaccaggcatggtggcatgtacttgtagtcccagctacttgagaggctaaggcaggagaatcccttgaacccgggagatggaggttgcagtgagcggagaatttgccactaaactccatccagcctggcaacagagcgagactctgtctcaaaaaaaaaaaaaaaaaaatccattctctaaggtgggttaccaaaagcttgaagttggaacctcagactcctcccttgcacaggcctggccagtatctactgttttttgcttttttttttttttcttgacaaggacctatccttcccccagacaattttgtaagctttcacaacatttgggctcacctctgtgggtcccagtgtcggacagatcagattttgatcccacctctggccttcgataacaggcaagttactaacctttcttactttgcctcagtttcctcatctgagaaatggaaataatggtaataccaaccctgtgtccctatcaagattaactataataaatccaagaaaactgcttggtactgagactgctcattgtaaattcaataaatgttccccttttaccatcaccattacctgagtccctctaaaagccagatcaagttccttcaactgaaagtatctttcccattttcttggccatgttgccttaaattcctacaatgaatgactattatcagctctcaaattttatcaaataactttaaaaggtaaacatgtatgaatatagtgttaattatctgcaaacatttaactattttccatgcctcagtgtaactgaatatatcagttctttggcaggcagagcaaaggtactgtaaagattttcaggatgattacattttaataccaggatgagggagttaaggctttatcaagtgggtaccacagtggtggccctctccatcagatactccaaggactttgctacctccaagaagtgactgaaaagcaaagtatgggtgaatgatgatgtgcagacttcttgaaaatgtccatttttaaaaatctacatttttaaactaaaaacatatctacaaggtgctccacatggtagtgcctattgtctaggacttttaattctataaacaaatccccacatgaacaattttgtttaaaacaaatggctaaagaatgcaggaaataaggggtctgaacagagtgactgtttgccctataactttcctctcatccctataaaggaagcagagtctctttttcaaaagtgtagctcaaaccatttcagtgtttggcagcaaggaggacacaggggagagaaagctgcttggacgtaaagtaccaatgtcagggtccactcaccctgaccctaggccagctgagaacagcacacaatggcagaagtctactttttaaaaataattttgtccaataatcattagtcttccttgttcaacactgaaggtgtcacgggactgtaaattgaccattttggaagtatttttttcaatacctagatcatttagtagtatttaagatgaaagaatatggtatttcagaagcatgctaggtctagactgataagactttggtcttggctatgatatacggcggaggaaaaaagctgttaagcagcaaataacttcagtcttaactacagaagccaaattcctgtgtccagtgtcctccccatgcctcagcccaggttctcacaattgatagctgagaagagagctcatatccacgtctctcgttttacacaattgagacagcaagagtcctgagaaaccttctgtccatttccatcacgtagcaaaggcttgactgtgacccgaccatcaatgaagtgttgagagggccacaggtgtgacttctgagggggctaatgagcatcacgtcgtcaaaacttttgtttcacagccaaaggacacacacccagttacaacttccagacataagccactagtcacaaagacagtaccaggagaacatgtggatggctaaatgccaatggaccaacacagcaaagtaatgaagaaagaaacagaagttctgaagatacagcaagcaaagaatcaaagaagaaaagcagtatactttattcaataatcaaaagcttccacatgcatttaatcttgagctggccagggcactaggaatagagcagcaggccagccagtggttatgagcctggctctgtgatcaggctaggggcttaaatctcagctctgccacttcctagctgaatgaacagacaagttacacaatccttcagtgcctcgtttcctcatctgaaaaataatgaagtacctgtctcatgaggttgtgaggattaaacaaggtaattcataaaaagcactttgaatgcctgggcatgcaatacatgctccactgatattaggtattagtcaacgtaatgcggagtcaggaaaggaacaaaatgggtaagaataaggcatgagcaaggaggcatttagagaatttactgagtgaaacacatacctacagcttcctatttaatctttacagcaaatccatgagaaattcccatctccttccttcttgcttcctccggtcctctctgtatgacccaaggctcattgggttgagggtgggaggagaaaattaactacaaaaaaagtagtagtagtagtagaagaaaggtgagttggttaatgaagaaaaaacggggaaaagtagcagtaaagtgttcacctagaagtaggtctggtatcggtcatggctggatttagtaactctgccagcatcaccaggacttcatgtttcttcatctttggtctctgcccacctctgtgttggcttcattctcaggaatggtttgcatgaattgtatcagtaataagaccatgaggtcttattaccatccagataactgagtctcgaaaccattgaacacagttacctgacgtcaggataactgagagtttccaaaatatttgaggatacttcctagcaatcttgaagaaaagggtaaatagtttatttctaatctctctcaaagaacagagcttggagactcacagcctgaatttcaagggaatggggagggagagaagaaagaaaggaaactagagacagaaaagagaaagtgtagggaaaatggaggttaggaacattggtggacacaggttgaggtgcttaaccagtatcatgccctcatcttccagtgacagcactggttagggatcagcagagacgacagagagcataccagctagctttagcacaaagggatttattaccgagtatcaagggagtttcaaaaccagtgatttacaaagcttgaagtagtggggactaggttaagttgccaaaatgtcccttcaccccagaatcaccccacctctgttgtgatacagaaagtcgccccctcaccgctgtgggaagctgccatatgaagttgccggaagcagaatcgcactgccacaaacatggtctgcaccagccacatgtgctgctcctttacttcctcactcagttctgaattcaggtttcacttgagtgcagatgaccggcaggacctaaagcacacccagaatgccaggtttgaggaatctgggaatgctgtttctagctctccatcctctgaaatgtggaggcacagcaggtgcaggctggaaatgctattgagctaaccaatctacagtactacttctgtgcccgttttctttgaagagtcactgcttccaccatttatccatgtagctgaggtaggtgtggccctaactcctgtagccaagggcagaagatgatccagacctggccagtcagagctctacattcccctgacccaagtgagcagttctcagatgggcatatgtcccaagctggagatcgggctcaattccatgatctttttgaaaaccctctctactaaatctgaggcttcaaggatgagaacctggcatttctggaggctgttgaatccccacagccatgcaactgatacaattcatgcaaaccattcccgagaaggaagtcaacacagaggtgggcagagaccaaagatggagaaacatcaaatccttgtgatgctggcagagtccctaaattcagccatggccgatatcagacccacttctaggtggacactttactgctacttttcctcctcccttcttcgttaatcaacccacctttcttcttctactactactttttttctagttatttttctcctcccaccgtcaacccaatgagtcttgagtcatatagaaagaatgagaggaagcaagaaggaagaagatgggaaaagaggaagaaaggagagatgaaggctgggtgaaggacttataagtcacattataaatatctataaattatattatgtgccaggtaccatgctggataccgttaattcataatcttatttagaactaattttaaaagataatatatatgcaagcactcagttgagaaaacatgcagtttggaatccatcaggcatctagaattaatgtaattaccatacctggataaaacagaagctgccctgaattatatgaagactaaaatggaaacagcaactcttctgttgcagctcatttccttaatcctcatcaccactgtataattaatggaattcattaatatggctcactcatatagtcacatttcattcctggccatgactgaattttcttatcacttatggtacaatggctaagagtacacaatttgctatcagatctgggttcaaagtctctttctgaccatgagatcctgagcaggattacttactgtctctgtgtcttaactttttcatttgtaccacaggagcaataattcctacctgaagaattaatgcaggcaacacacatagctgggggtctatggatagactagagtcagagacctgacaggctccgaaacagacttaggcatttctaaagtggaaacagtagttggtggcaattaaagcaaattattaacaaaatattccatgactttggactaatggtttaaaaaaagacattgtcacccctggctcacttccattccatccaccattcagagcaaaaactcaccctaatcccacagaaccatggtgagttttccaacaaaacttttgcgtcattccagagtaagagcccctagtcttgcaactattgcttttgctgtgtatgtcagaaaaaatattagatatttttgttcctttaaatcaggggtccccaaccactgggccatggacaggtctgtggcctgttaggaaccgggctgtgggcaagtgagcatttctacctgtgctctacctcctgtcagatcagctgcagcatgaagttctcacaggagggctaactctcttgtgagctgtgtatgtgagggatgtaggttgcacactcctcatgagaatctaatgcatggtgatctgtcactgtcacccatcattcccaaatgggactatctagttgcaggaaaacaagctcagggcttccaatgattctacattatggtgagttgtgtaagtatgttacaatgtgataatagaaataaactgtacaataaatgtaatgtgcttgaatcatccccaaaccatcccccacctctggtctgtggaaaaattgtcttctacagaactggtccctggtgccaaaaaaggttggggaccaccactttcaatgaacaatgtaggttccactgaaggatatgtgggaagatgaagaagagggttacaattcacccgggttagcaaaggtcctccatgccactaaatttcctctctcaaagacagtggcttcatagctttctctttccaaccatccccatctcctcctgcccactggggctggttaccaccaactcctcccttctcagccactccctctctttcctcatgtagagtaatgtggtcctgattcttcagttagcatcttcacctcatcccctagccttggaaccaatcttccttcaagaaggctttaaggttggtaaggggtggcagggaggagagtatacataatgatttttccttagcaacttttctaaacccatttcccttgctttcagagggaagaaggggcccattctgtactatggatagggatctattttattagctatgtgtcagtttttttttttttttttttttttttttttttttttttgtaagacagggtctcactctgtctcccaggctggagtgcagtggtgcaatctcggctcactgcaacctctgcctcccaggctcaagtgattcttctacctcagcctcttgagtagctgggactagaggcgcacaacaccatgcccagcttattttttgtagttttggtagagatagggtgatgtggtttggctgtgtccacactcaaatctcatcttgaattgtagctcccataatccccacgtgtcatgggagggaccagtgggaggtaactgaatcatgggggcagggtctttcccatgctgttctcatgacagtaagtctcacgagatctgatggttttataaagggcagttcccctgcacacactctcttgcctgccaccatgtaagacgtgcctttgctcctccttcatcttccaccatgattgtgaggcctctccagccgtgtggaactgtgagtccattaaacctctttcctttataaattacccactctcatgtatgtctttattagcagcattaaaaccaatgaatacacggggtttcaccatgttgttcaggctgctctcaaagttttgagctcaagtgaaccacccaccttgatctcccaaagtgctgagattagacatgagccactatgcccagccccagatttcttttaattgcttttattatcatctaacatcaaaacttgtgtggagaaagtgtatgtccagcacaggacattatggaattagtgaggggagtgcattcttttgttgagccagattctctatttaaatctttgaaattttagaagaaattgtgccttgccaccatacacacccttcaacaccctccttgtcactattagtttttccaaaagatattttcctttctactttgcccatctttaaatgattagcaaattcaacaactgattagttagaacatccacaaacctgaaacatttaaaaatagacatagtacagcaagactggagtaagaaatgccaaaaaaaagatccacctcaattcaagtgcccatcatttgcaagagaccatttgttattacaaatgtgaattcctttttttttttttaatatatttttactaacaccacaaattgggtcccatgaagctaatgaaaacgtaggaaaaatgcaaactcagataatgccaagatccttctttagggtgatacaatggcagaggatactggagcagcaaaatgagctaagttttcctgtgactgtctgtcttattctgcttctgcctttcaacaaccatatcagaagagagatcatgaagttatacacactattatcatcatcatccttatgtggttctctgttttttccttctatcaattcattagaattgcaaagattcaaggcactgatcttttatatttcttttgtatccctagtatgtatgcaaagtataaattcaatataaaaccattggataaataagttttcccatctacaaagatctaggtttttaaaaaccacattgaaaacagaaaatacatataatacaaaaagggtatatatatgtatgtaacaagacattggataaagagaaaagtcctctgagtcctgagctggaaaaaatcttaagatgtgatcaccataagctgtaataaccaggaaaggccttatgggaagccttgaggcatgagtaggacttggaaggcaagaggcatagggaagaggaccccacagagagaagcaaggcctgaacaagggttaagtgccagaagactacagagtgatcaaagctgctatgcgctctgacaaaactaaagatggcgcagcctaatggttaagaactcaggtgtgaggtcagacagacttgggatcagactccagcttcacatgcacaggctctgcacccttggataacttgctaagcctctgtgccttgtctcgaatcataaaatgcagtgacaataccaacctccgagggctgtcatggaaactaaaggaggtaagctggaatcacactcacatgctcccaggaagagaaaactccatttgttagttgttacacatagagcactaataggacaatatttcttaaactgtccctgaaaaaaatccagtgtgtgtatccgccatagccaaatgctaatcatttgctcagaagattctggaatgaccatgagaagaaaagaagctgtgacttccaccgcctcaaatattagagcatagaatttggcccctggggctgaaattcttaagtagttgaaggaatgagagaagctaagtgttgtgaggattcatgaattaatttcatctagaccactcgggtccttggtcataaggttcttgtaaagtttttattattatttctaaaacaatcactcacctctacccctgtgaggaggcagaatttggcctttaaagataaagatggctcatctctctgtaaaacatctgatttaaatatagtctctggcctcctccagggaagatacctccctgcttcaagacctttcacatcctgggtcattttcaaggttttgctcatctttaagtaattacagaattatctactaattatatgttcctgtgttgttattaaatccagcaagaacacaaaatgaaattagcattatcttcctactacaaagttgttgctctttctttctcccaccccagaaaaccttcccttatctttctataaagagacacaccaattttattttaggagaaacagtacctcttatcctttttaaaatactggagaccaggcaagtacattagaagaggaagatacaaagcagctaggaaggagatctgaggaagtgccaagtgttggaggtggacatctgaagctctgtcctgacctcctcaggccgaaaggtcctcaacctctcgatgactctgtttccatatccaaaagggatgcctttgtagtgctgttgtaaaaatgaagtgggaagcctgacacaaaatacatgtgaccactgatagaatcttctactttttttaaaaaatgagaagttggaaaaggtatctgttgtttctctctggtactttatctcctcttatgcaggcaaataaggaaggatccaatggagaaagtaggcagaagaaactggaaaacttatctaaggagggcccctcttcaccccataagagcttcgctgacggagggtcacataaggccaaaacagttatggagagagccaggaagcagcatgctaccctcttcataggttcaagacaagacacagaggtttggccagttgtccaagggtgcagagcctgtgcatgtgaagctggagtctgatcccaagtctgtctgacttcacacctgagttcttaaccattaggctgcatcatcttccattttcacagggctaggggtaggaggacacatagaacagagatacctatccaggaaaaaaaagcagatgagggtctcaaactggccctctctatagtccatgttactgatcagatataataaagtcaaattactactcccttgatataagccaacatactaagtaagtggctacagtcacctgtatttaaaaggagagctgatcatctacttctgtaacagaaaaacgtgaattaaacaagcagatatgggagatttagtaaagaaggaaatttccatggtatgtgattgcttcaataggcatttgtttcaatgtccaatttggacaactcttcagatggataattttgagatacattagaccaggatgtctgcttctcaaaacctgaaatgtacactgtctagttttgttggcttagcagtaaatgtactttaataaacaaatgccaagtctcttaaaatgtatcatttgttcttggtcagctattgctaagatgcttgataggtagggtcaaaatggggcaagatgcccatcttatccagtgatcagtaggggatccggcagctccaggcccacctcaaactggagacgggagctcagtgtccagtcactgccacctacaccgtgttcatcatgcctgaagattaaagcaatgccctcatgagagcatgttctggcctgacttgattgcaaaggctgggaaaagtgcccacagaaggagtgtcatctgttacacaggagctggtggttctgccctaacagaggctgctccccctaggaggcacagcagggagaaatggagaaggaaggagtctggcagtgatatgaactttgatctttttgataaaacatcttctacaacatgttttagggaacagctaaagtctttaagaacaccaaagccggatctttcctctatttgctgaaagccagtcacagcgataacaagaggaagatgacaagttttatccttatagagaacaggtgggtcgatggttggaataaggcatgaactagctggggtgtagcacagaataaagggggcatctcaccctaccaggagaagggctttatggcagaggcatcatgccaagtgagcctgaaaaagaatgtggtccaggtggataactcttaggttggccagcattccccactggtcagccattctgcataattactaggtgttcctggatcatctctcatatgctaaagctttgctggaaaaccaggggaactaaagatgacaaggagcctctttgacctctcaaaagcctagatggctacccacctagagcttgcagggactctgcctctcatttctcccaaaggaacatttcttggtggatgataaaatacctcatgttcccagcaaaccctcagactgaaacataagaagtacttgagttgttgccagagaaacgttccagagccaagtggacgactgctaggggtggccttgggataagctatcctccctctagcagtttttgggaggaaaaggtgaaggtggaagtgagctgctccactgggggaaatgcctgagctaggcctcagttagaaatctaccaagagaaatcgcgatgctcgaatgtccgaactgtagatttctgcctgaagcacgtcactgctctcaagcaaccacgatgatctcaacgcctatggtgctttgcgattcaactcccatttaccccaaagtttaatgattgtcaaaacaagtcatgttttcttagtaataacacgcttaattcttaactgtccattcattgtttcggaaaaatgcttcggacaaaggcagagatcacatttgtgtatgttttgcatactccatgagagaccttagaggcattagaactcccacagattggttttttacttccttaggatggaattcctcagatgtgacagaaggacacagtgaccctttcagggaaagcagcgaggcatctgggacaaagacaatgtccacatggcaaaccgcaaagcacatgcttgaaatcctggctttctatgcactttcccccaacttttgtttagaagtcagacgttgattttcattatctgcatacttaacaggactgtcatgacatcccattacaaactgtcttcaaagaaagtagtaaacataactttactcttcaaagataacatcccgtccgtatgtgactccctgcatcttgcacggatcatttacaaaccaagcatctccacggggccccagggtgacataaacaaaccttggaagggtgtcaagaagcacaagaatcatctctggaggctgtatcttaatcttgaatcttttgttacccctgctgttttagaaggaaaaaaaacaaccaatcatctttttatctgagaaatctgagcatgagtgccttggttaaccaaaatgggttaaccttatatttgcaacacgaatgctatttctctcactacatatttcgacagctgttcaaagaaaccttttctgataaatgcctacactccaaatgtgctgtgctttcttggttcatgcttctgctgtgacacttatctcactgttttataattagtcggacatgagtctgtttcccaagctagactgtccgagtcatgtctgtatccccagtgaccggtgcagggcctggcctagagtacgacagagtaggtactccataaaaggtgtgttgaattgggaaaaaaaaaaaaaaaaaaagcacacaagtactcactgcatcagtcagtccaatcaaaggaaagcatggtacttactcttgaaaacaaaggttgagccaaaagtcctgtccagtacagctgaaaacatagtatttttacaatgcagatttggttctctaattttgcatgcttttggctgacatttagataagcatgtaccagtcagcaatgtagaatacggcccataagttcatgaatggcatgaaagccctcttagagtccagaatctgataatctgaaccagtttatgggtggatgattccacagactcagatgagctagactggagcctactcactatttaccattattgttccagttgcagaatcattccaaatttcaaacaacagacatataatgaactatggggcacaactccttagttggggactgactgtaaagataaaattgtgaagcatcatcatgacatagtcccataaatcacactacacaaaaaggaactgggcatagctggatttagacattcattcttctcttattcccttcagctactctcggcagcctcagatgctgtcctagggcacctcgctgagcttgaaagctaatgttgcacaatggttagacacggactctggactcaaccaaggttcaaatcggaaccacttcctgtgtgacactgattatttcttcaaaccccaggttctggatttaccttatttaaaaatggggatgaacggccaggcgcagtggctcactcctgtaatcccagcactttgggaggctgaggcagacggatcacctgaggtcaggagtcacgtgaggtcaagaccagcctgactaacatggtgaaaccccgtctctactaaaaattagctgtgtgttgtggcgtgtgcctgtagtcccagctactcaggaagctgaggcaggagaatctcttgaatccaggaagcagaggtgtagtgagccgatattgcgccactgcactcccagtttgggaggttgcagtgagctgagatcgtgccactgcactccagcttgggtgacagagtgagactccgtctcgaaaaataataataataaataaatacaaatggggattaaaaagtatataggtaatggggttattttgaaaattaaagagaaatatatgaaacaagctactcagtagcatttgtcacgagtgttcaataagcattagctattactgttatttacacaattccttttccaggattttctctgtactccttacaggtcaacaccacaatttaactttgtgttccagaccccttagatccctacttcctaatcatgtcagagattatttaagaaacttgggccaaagtgttgatgcaagacaaaatgatttagtgttattcctgccaaatagcatcttagcatttctaagaagagtcaccctcagcccttaccacctgcttgagagatgtgttttagagaaggcacgagaacaagcccccattttaattttcacatcagcaatgaaatgatctagggaagactctttgaagtcaaatttgtcaactactcaagagaggtaagaattttcaaggggaaactttgaagactggattatgagcacttcaaatggagctttaatagaaagtgtttattgtggatgagtgaaaacgtctctcttgttcataatcaagtttctcttctacacggagtctttccctttagcacatgaaagtgttcatgcctctcctgtattcaaaataaaagattttcctcaaatctacacattagatccttgctgcccatctgtttctattgggcctgtccaaatctcttgaagcagtcgtctatatgtgtcatctcttctctcattatccagtctttgctcatccataatctggcttctatcccccaccttccacttacacagctctcctgaaggtcaccagtgtgctctgtgatgggaaacccaacagacttgagttcttgcattatgtgacttgtcatatgtgcatctgttgaccaactcctccttcttgaaacttccccctctatcttcgagacagcacttttctccttccgtgttttggccactactccccatactcgcttctggattccttagtgttctgttgggttctgtcttcaaccatcttcccttctcactgcacacacatcttgaagcatcatctacttccttggcttcaaccaccattcatattccagtgactctcaaaattagatctcctgctcacaaatctctgtgccccagactcatatgcagtggcttattggacagttcctcttgcatatatcacagatgtgtcaaacttagtaggtccaaatctgtaattatcttaacatccaccctcatcaccattagaacagctccttcctaggttttcgacatgctacagaacagttccattgctcaaccagtagaccaaacctagacaggaatcatccttggcttctcccttacttcagtctccacatctggtcagccaagtacaataggttctacctctcagtgtttcttaaatctatttccctgaatccttactgccactatttagtcatggacttcttactttttggcctagtttactctaaaagtatctttactcatgatcagtttcacccttacccaatccattcttcatgtgttatgtttattttagtctatttgaaaaggcattttctatagagggtctattcctctcctgtaaacatcaggaaagcataactttttcaattcttaaaacataccagaaaacctacccatacaagtaatgacccagttatttcaagatgattgggtaagtaccagggataatattcaatgtgattgggcaatatttccatttgcttctgtactaataagttctttctctgatgttggtttattcatgcaatgggatatgatagaaaagtgagtgtcagttaatgagaactgcttggtttacatggatgtagcacacaaacctaatatttagcagacagtcatacaaaggcacacaaaatatatgaaggttattaacatgaaaaatactactctgtcactttgggatacatgcttaagtttaaaagtagaggaaagtacatgggagcaatgaacaccaagtttgcaacagtggctaaatctggctggagtggagagggctgaaatgaggaagggatgaccaagcaggtgcattagctttattgaagcatctcagtgtctcatatcttaagctgggttttggatacaaagtcatttatgtgtccttatacttttttgcaggtattaagatattgttccaaaattaacgtccaagaatggattttaatataaagaccatttaacatcattctaggctctatggccccttacccctcctgccccccaaataccccaataaagtaacaagccaacataccactagaacagaaaaggttgctagactctagccagagaaaatcttatcctcaagcagtacttgatagaacaaagcttcagaacaaaaaaagattctggaatccaccagaatataatgtgttttaaacagattgtctgagtgctccttttcagaagggctcatctcacacaccttgcatatctggccttgtctgacctgttttccaacagggaaaggagcatgggtgcctgcagctacttcctaagtgggctccagagttcactcagaaaatacgcctaacaagccccaggtggacacatgaggaacggagcctcacacagaggccaaaggtgaaccagtgcattcttcacagagccagctagcaaagtgggtttcaggatgcagctcccatctgctccaccagcgcccctggggattcacaggctgccaacagcaaaagggcaagggtttgatgtgggcacagcccacaacacctctattatgcataacagtcaactgagatgccccaaagcccatgccctttgaatcaggtacactcagcttcctgaatactttcactatgtgggacctcatgcttcagcacaaagacagtgaggaaattaacctgtctgcaacagcatgcgttgctttcaaaggactgggagctccacacctgcatggttctgagaagagatctcaccaccggctctgcctattccaatgtatgagcaacgcagtcttaatatcacactgcagctcttcccttcgtaatttattaagtatcactcagcttcttcccttgcttccgagtaagagctggcaagagtgccagccaggactagagagaaaagaaaggaaaggcctcctgggatgcatatgtgtacatagcctttctttatgagccactgagcaccactcaaatggaaatgcatggccaaagttttagaaagcagaaagaccatgattcaaaacacattttaggagaagcccacacatgagtgaagcagaggactgtcaagaagcatttttcgggccaggcacagtggctcatgcctgtaaccatagcactttgggaggccaaggtgggtggatcatttgaggtcagaagtttgagatcagcctggccaacatggcgaaaccccatctgtactaaaaatacaaaaaaatagctgggcatggtggcatgtgcctgtaatcccggctacttgggaggctagggcagcagaatcacttgaaccagggaggctgaggttgcagtgaaccaagattgtgccactgcactccagcatgggcaacagagtgcaactctgtcttaaaaaaaaaaataaaaaaaggaagcatttttctgtataccaaatacaggaaaagagcattcatgacaccaaactaaaggctttgaaactgagcctgagacttacgcatcaagttcagagttatagattgaaatatagagtcactgggaaaacagatgtccataaagtcttaagagcagggtaaagtctactgtttgctggtttcaagctacatacctggagtccaactcagaagtgacatgctgctgggcttggcatgactatacccctaagccagtgaatgcctctactcagtttccaaaattcacaggtctaagcaggaagcctacagcataggcctagatagagaatggtgtctcagtcaacaagtctttgcacatttttgaacaggttaagagccactggggcaaatctcaagtgacaaataagatcttaattctttggcagaagcactggctcttcatactcccttaaaccaacatggcacatgtatacatatgtaactatcctgcacgttgtgcacatgtaccctaaaacttaaagtataataaaaaaaaaaaagaaaaaaaaagggaagaaaaaaaagaaaaaaaaaaaaacaaacaatcctccctccaggcagtgttgtggtggcagcttagaacaatgctcagagggccccagcctcctgtcttccccaaggcagcaaaaaggctacagcaattctagggctgatggagagtgcttcccccaactcttgctagagattgtgtcattctattcttccctagaaagtagaggttttctgggcagctgactttaccaataaccatgattatttatggagctttattatttgtcaggaactgggctaagagcctgcagaaactgagacttggacagctgaaataaattagccaagatcacaccagccaataagtaatggagccaagatgcaaaccaaggtatctgcagcctaagctcagtgctatgcaatgggagccgccccatgcagacaattcttacaactggccttgggtgacttcctttcactcaaagtagtagggaaaagaactcagccaatctcaagggttttttttttgtttttttttgtttttgtttttgttttttttaatgtctgttagatggctggctggaacaaagatgtgggaataaggaagaaaagaattcctagtctgcttgggaaggcaagactcacacatgttgaaagtattagagactgtgaagagagggcatatcattaagtgctaaattgcaaggtatggactttaaatcctaaaggaattcggagaagacagacctaaaggaaactccttcatcaggggcttgaggtggggagtggggtggaaagggcaaagtcctgctcttatcggaagtaactggattaaaaataggagcatgctctacacctgtgtatctacaccagctgcagggcatggatggggtggggggtggtagaggataactacgcaactacatagtagcaggcagaacacaggaatcattttgccaccagttaagccgtgtcaaggtacaaacagcaaaatatgttttctgtcagtgtgattttttttgtacccttgagagggatttctgtatacagaaaagattcaagagttgttttgtcttattgattttaaaaattagtattcgatgtattgaagttaaaattcaaattcctgtttttctctgaagaatatagttcaacttacaaatctgattctatgtaagcaaatttcaaacaattattttaagggaaacttacaaattacactcaatgttttaaactgcactcagaaattttgtatgttccattctttttagacttcaattgtctaacttttggaattttaattaaaaatatcaatatagaggccaggcacagtggctcacgcctgtaatcccagcattttgggtggctgggcaggaggatcacttgagcccagaagtttgagaccagcctgggcaacatagtgagaccccatctttattaaaaaaaaaaattagaagatatcaatatggttagttcttaatgactttcacaatcccacacttgtaactctaaacctcttaattatctttttaaaattgaagcacaaagatgtttttctctgatgggtttttttttttttttttttttttggcagggggagacagtcttgctctgtcacccaggctggagtgcaatggcagaatctcagctcactgcaactctgcctccctggtccatgcgattctcgttcttcagccacctgagtacctgggattacaggtgcacacttgaggtggagtctcgctctgcactgtctggagtgcagtagtgcgatctcgtctaactgcaacctctgcctcgaaggttcaagagattctcctgtctcagcctcctgagtagctgagattatagccacacaccgccatgccccgctaatttttgtattttggtagagacagggtttcaccatgccggcccggctcaaactcctgacctcaaatgatccacctgcctcggtctcccaaagtgctgggattacaggcatgagccatcgtgcctggttctccagtgggcaatattttctattttaaatatcaatatatttaaagaacagatgtacccagaaaggtctttaacaaaaagtgatttacttaccattgttttttcacatagttctaatttaaatttaaaacacacttagccactaataaaacaatggtgtcttcccaaataatgtctgggttgccttcccgagctacttttggagggcacttttcactggctgtttttgcacactgaccaggatcaggagcagcagacggctggggcaatttttctcaagacccatgctatggcggctagtcaatgaagcccagaaggaagggcctcagaagcatatcctgagctctcaatcttgatctagtctaaacgctgattgaaattcacttccttcaagcctagtttagagtttgtttctttggttctgaacccatctccaagactttgtcgtcacagtcctaaagctgagctgaggacgcagtcctcctgacttctgttaatatgctattaaatggggtgacatgacccaacctacatacgtctgtttatttcagaacaaatgttaatatatgagaagcatgtgtccaatcacaattcattatgtcctcccacacctctacaacaaaccataggatgtaccatttcttagtcaatagcacatctagatgttcaagccagaaattctgaagtcttctatggctccattctttctcccacttaatacatccaatgacaaatgcctgacaactatgtgtccacttttctctcttctccttccttcttctccacctgccctgtcgatggagaccagaacttcatcaagtcttgattaggagactaaccatggctgagcctcctagtctccctctgtacctgtcttccactccgtggaagtgaccaggggaaaacactgctctgatggtataaaccgctgggcttgaaaacctggatggtttcctaccatctctagggtcatctcttaggatctgcaaggctgttcaaagctttacttcctgtttcattctcacccagaatctgttgcttttgttccctaacaccatgctcattcgcgctgcgtaatttcacccacacaattctttctgaataagtagctttctgtctactcagatgccattcccattccagagtcatttccaatgtcatctgccttttcctggtcaagcctgtcctgaccaactgtcggagaaaaaaaaaaagacagaagagatctttaaggtgttttcactgtatttggtatatattttgatcacactatactacagttaattataagtttgtttctcctaaattggttttgagcacagggccaggagtggctttattctttatcaatatgatacttggcatatagtttatttaaccagctgcctcgttccataaggtatgaggttatttcttttgtctgctctccactaatcccccctactcccagtcactttagaaggcaagatttacaagggacctttgttttgttcacggacatagctagaacagtgcacatggtaggcatttaatatttgcagaagagaaggaaagaataagaaggttgaaagtaagcaagcactcatagagcaaagaggacacttaccaaggggactattattaaacctaggttactttaaaaaatcctactaccatggccatattgggatcaagaggaaagtctaaaggcatcacagaatctctagtagctgagctcggctgtggtcctataacaagttacagatcctatgtgatgggcgctctggcctcctcctgcttagcatattcttggggcatcccaacctgaggatctgggttagagggaaatgggctctcaagaaccctccagagctgcagagtgcagggcagccctgtcaaaccagtgagggctgctgtggggtcatagtgggcagagtgggggagagagatcaagagatgaccgctttagggaatgctcatcttaaacaaaaagttggcaaaatggaaaaagaaaacaaagaggagccagaggcggccctgaaaaatgatggctaagtgattcatgggagaccccagatgtgattaactcaagttccaaagtaagaaatttcaggttaaatggcattgtctaacatatttaaaaagttggatcagcttcaagtatagatattaagcacatgaccaactaaaaagccgcccctttcccttctcagagaacatgcctccccaaggaggaaacaggtctcccaagctagagacaggcagtgccatcttggctggaacttgtctcttgtgaaactccccttagtggctaggcgccaaacccattcctcagtcctggccctaagaccccagttgcctttatgcttctccccctacaagtcaaaagttcggtacacaaaagagtctgttaaggttggaggggtgccaggattagacaagttgcattaagtttcccagaaacggattcttaaggtaataaccaaggaatttcacacaatggccgcaatgtggtaaatggactgccagatttaatttcaaagcctgttcggacggaagcctttctcatcctgactttcctgcagaccaactgtgtcatgttgggcaagtcagttcatcactccagacttcagctttcacatctgctaaatgggaaggatactgcctgtcatgcctgcttcacagggttgccatgagccaccgactctcagcctttgccatacgaatctagttatctaggtttcatcccaaaccaattagataagggactgacacccaagatttagtagtcacatagcttcccaggttattcagataaacagccaaagtaggaaacctctgaactataccagtgtacagtacaaagaagagggcagtaataaccaagatcatcatcactggaacatggcatcatatgatttggggttgaaaaagttatgctgaaatctccttaggagcaaaacccatgtttcttttgcacgtcccattattacctgcaagctttaggcattcagtaacatttttgataacaaatgcaaattcgaaatccttacaaatcctagtcttagattctttgtttactaaaactacctttggagatgtcacctccatgaccatccatcagcccagcctacggcaaagccatcatcttaaaacttgcccaaaggtcagcttagagaaacaggaaatgtgagaaaggtggctttaatcaaaatggagagaaattgcagttttccaccagggaggtaactgactgtttttgtccggccaagagccagtcacagtgcaggagcttggatgaaagccagagacaaacactgcttggggctactttttcagagatgggttaaaagcaatgcccctgccgctctggctggcctttgactcaggatacacaccttttcctggagaattttaccacacagccctttagattgtaggcttgtaaagcatctgcattagtagaaacagttttcaagacaattcttctctgactctgggattactaaagccagacctgagccatgcttatcacaggcctccacctccgaaaatcctgtttgatttattaccactgcaggctgaaaagacaaggcacagtgcctgaactaatcaagccagtatgtgactttcatatcatgcagaattaatcagaaattccatacattgacagctcgtgccactcgcctcaaagtaagatttgaggacaaagtagatgtggaatccatttaccctttcaaagtaatttaagactttggaaatctaagaaagataatcaattttgaactatacttgattatgtatgaggtatatgtcccccataacgatggattaacgttctatgttaattttagggtggtttccaggcactttcaagatgtaaaacttgagctgagagcggtggctcatgcctgcaaccccagctacttgggaggcataggcagaagggaaacttgaggcaaggaaattgagaccagcttgggaaacatcaggagacccactgctattgaaaaaaatatttaataaattaagatgttttccacagaatctagtttaaaaaagaaaaaaaatgagatgtaaaatgtagagtagccaactcttattcccagaagtctgcaatcttcagacacatacatctaacatatcctccttagaaaagttttttttttttttttgagacagagtctagctctatcgcccagactggagcgcagtggcacaatctcggcttactgcaacctccatctctcaggttcaagagattctcctgcttcagccacctgagtagcggggactacaggtgcgtgccaccaaaccctgctaatttttcggtagagatggggttttgccatgttggccaggctggtctcaaactcctggcctcaagtgatccacccacctcagcctcccaaagtgctgggattataggcatgagccaccacacccggcctagaaaagtttctttgcagctaaaccttgagggccattaaaaagtatctgtatctctacttaggataagaggaagtgctcagaatttattatgtacatctgtaaactacccagtttttttttaataactataattattggaggctgagaaagtttacataactatattttacttcgtgtatagtggagagagaatatctgctactccaggtattggatttcagtgttatattaggactgctaactgttcatagttacaaatcatctaataaaactttcatgtttttagcagttagaaattaactttttctcctgtaaaatgaagttaaaggaaaatagaaagtaacctgaagatgtgaatatgtatttagcctcaaagtatctgtttacttcaaaagcataaatgattcaatcatattaaaaatgatgccaccattatatagtacatgtttacttgaatgctaaaataaaattttaaaacgttttatttttccatctctaattacttggactatcatgtgaggaggggtactaaatatttatgttttccaaattgaaagccaggtgtatttatttatcattattattttgttttttagagacggagtcttgctaatattgcccaggctggagcacagtgactgttcacaggtacaatcaggccacactacaaccttgaactcctaggcttaagcagttgtcctgcctcagcctccccaggtagctaggactacatttgcacaccactgtggccagcagaaagcaagttgttgtaaaggtacatgttaaataatacttccttcctcactggtttgtaatatgtgtattatatataaagtctcagatgtaaagttctttctatgatttatccggctccatttaactgtactcattttagccaacaaagacttaattttaaaaagtgatcttagtgttttgttcttgtctggtcagactggtcacatctcattatccttgtttggaattttcttccaaatctcattggcttatggttccaagtgagttttaaatgtgttttaaactcagtgattttttttaaactcctcttgttttgatgaggtaaagaggtcttaaactattccagctgaatttatatctaacttcatttttgatgaaaccatttttataaactcctagtggtccacatcactgaagaaaagggacctcaattcttccaacacaagccagacaagcaggtagggaattcacggcagaaagctggacaagagagggcggtattcccagtcccattcaacacttccacagcttttgatcttcaccattgtaagccaagtcaaaagagggaggggaataggaaaggaaagagttgggaagggaagaggagggagagaggggagaaggaacatgcacatgcagaaaaagagacacagttttccccacgtgagagccttgactccaggccccttagagcaccctcctaggtagcctagaagtttctcccttcacctctgacctcagtgcttcttcattctcgctgtcttccagtggggggagagattaccctggctaaacaagacaaccctgctgtttctaggactttctaggagcatttacctggttggaggagaagaatttggttggaggaggtagaaaaggggaaatttgcagggctagaatgtggccactgccctgaagccctcaagagagaaagctgagaccctcattatcttagaatgagttatttttgacctacatgagattgtttatcctaatactatatgtagcaggatcccaggacaggtgctaatatggtttggttgtgtccccacccaaattccatcttgaatcatagctcccacaattcccatgtgttgtgaaagggacctgatgggaggtaattgaatcacgggggcaagtctttcccatgccattctcataatagtgaataagtctcacaagatctgatggttttataaaggggagttcccctgcacaagctctcctgcctgatgccatataagacatccctttgctcttccttcttcttctgtcatgattgtgaggcctctccagccatgtggaactgtgagtccattaaacctcttctgtaaattgcccagtctcaggtatgtctttatcagcaatgtgaaaatggactaatacaggtgccaaatgggaagagtttccaataataacatccctgcactggccagggctgtccaggcaatcggacttcaatttgccataaaggaaaccacaaagggtaaggcagggaagaccataggaggagtgacagaacacacagagttcaacttggcatgtgaatggcatctgaagttgtggcaaaaatgtaacctgtctagaaggctctgaaagaccacacctctcttagaagggattcccaggactccagcaaaacagagcatgtgactggggccccagggcttccaggaaatgatgtatcactcactggggcacccagctctgaaagaaacagctaaaagcaaactccccacacactcacaccaaggaggtgaaagagttcctgcagctgtgtttcatcagcagatgggcaggtggacagttcatcaggcaagatgaatcagtccctcattccccttggacttgggcttgaactaatcacactcatctttctaggtgtccccactgcctgaccacctgctctggggccattggagtcattggttttatcctcacatccacccagtggagctgctcatagatgagattcctgagccattccttgtacacagaggcagcagacatgtggataaataacccccactaataattgctacaacttgccatgcatctattcatacctggcattacatgggctataactgaatcccagaacaatccttcaagtaacacaggattgtcttcattttacaggcgagcacaaaggctcagagatgtcactaacctaccagagtcacaccatcagtagtaagcaaactcatatctctccgactctgaagcctaaccaccctctgtcacttacatggccagagccctcgatgaaagtaagggaaggcctattttctttagtcttttctttcagtctattttcttttagtctttgccttaatgtcagaaatcaaacatcacgaacatcagcagcttaactccactcgggagcctgctgcacaagtgacaacagtaggcaacatacagatgtcatccttggtgacagaggccagccatggacttaccctcacagcccatctaaacgacaccccagcactatttcacaccctcaaaactactatgcaaagaagtctgcttaatgtgtcctctcagactcctggctctcactatcctggcattgaataattcaaagtccaccttctctcagcaccttttctgcatctgctcacccaagtgattttctcttccatggccacctccaagggtgatcctgcctgttacaagggtgttcaagaggaccttcacttgcagggccaacatgaggctgcccatgaatactgtacagatggaacaatgagcaccaccctttagaatgatctgtccaaatgagcagcctgcccttgagggtagaagtcacctgcagttacatccttatttcaaccttgtctctaccaaaaatacaaaagttagctgggtgtggtggcgggtgcctgtaatctcgggattacagctactcgggaggctgaggtaggagaatcgcttgaacccgggaggcagagcttgcagtgagctgagatcatgccactgccctccagcctgggcgacagagtgagacttcatcttaaagaaaaaaaaaaaaaggctgggcatggtggctcacacctgtaatcccagcactttgggaggctgaggcaggtagatcacgaggtcaggaattctagaccagcctgaccaacgtggtgaaaccccatctctactaaaaatacaaaatgtagctgggcgtggtggcatgcgcctataatcccagctacttaggaagctgaggcaggagaatcacttgaacccgggaggcagaggttgcagtgagctgagatcgtgccactaccctccaagcctgggtgacagagagagattccatctcaaaaaaaaaagaaagaaaaagaaaaaagaaaaaaaaaaaagatgccagggtctgggggagggagagagggagggatagggggagcacagaaaatttttcggacagaggaaacactctggatgatactatgatggaaaatacatgtcatgatacatttatctaaacccacagaacatacagtgacaagagtgaaaactaacatgaactatgtagactttgggtaataatgatgtgtcattttaggttcactgattgtaataaatgcaccactctggaaagggggcacagaatgttggtagtgaggaggaaatacctatccatgtggagtcgagagtatatgggaaatcactatttcttccagttttgctgtaaatctaaaactgctctaaaaaaaatccttttttaaaaaatgtaggaattaaggatgagacaagctccctgatttcactggttacttcttctgctgtcagttaaccgctgccattctgtgtctatcttgggtccttcagaaacattttctcctcccttaatcagtcaggtctgctctatcctggtctcccattgtacaaaagggaactgaggcatggtgtgtggtcagggcacttatccaagacaccaaattgtcagatggcagagcaaacattcaaaccagcttcttttcgaacccacccactgtgctgtttgcacttggtcacctgcctcttactgagcaaagtctggacaaggataggatgccttcctgggttctctgaaggaacatgttcacataatgcataagcccaggtaataatcaatggccgtgagtttctttcaaactctcacaagtcttatcctgtacgtgctaggagacccttgctacagatcagtacaaaagcaaggggttggagggccgggggctgaggggagaacattttgtttataaattgtttaccattaggcgcatctaccagcaacagacaggggaagagtctgcactattgaaaacacggctgctttgttttcaaggacacacatgaattcaaaggaatgcctggttttgcaataaaaaaacacaagctgaaaatagaaaaagaaagtcacgagcagctcctcactttgggagagatgggccaaggctgtcaaaatgaattgtgtggtttttattaatcatgttccccggtgcaaacacccaaaccacaggaccactaggagtaacctgttccaaacaatgtgggagtgactgaacttagtagcggaattacctttctgtatgaaaaggagggtggtctgcctgggccatggctgaggtcaccagaaatgcaatttaagaagacatctagctgcctgcccaatttgcagagcttctggtatggaagtgcttttcaactctagctgcctcgttctttgctgcaaggccacaagtctggaagaaaacactattgatgtttcattcttattggctagaccttcacaatttagcctcaaattctctttggcctgtgacataaccattccaaggttctgacagtatgcttgggactctgctgcaaatgcaagggcatactaaagttgcaattgaggggacagctggggggcagggaagagagaatgtgagcatcagtactgatacatgcaatagatttatgttttttaaagttttaaaaatatatttgtgattgttggaactaccaagatctggtgaacataactttgcagcctcaatatactccagggactaagacaacaaaatagagttaggcttcctgccactgaggctgaaggcccaatggagtttttaaatattgctatgacggtggtggccacaaaacaggatgactaggtccaaagggagtctcagcttcctccaagtacaagtgcggttgtttcaagggtgagaaacttcacataccaaaaacaaaaacaaaagagagccttggatgagctcagagacactcttgtcaccagccactttggtgacattggctaggtaaggtgattctacctccccagcttcagtgtttaccaaacctcagttatccctgtaaccacctgggctgtttctttgtgttttcttaaatataattcactaaccttaaaaacagcaaacattagcatggataaagtatcagtcatgtttataagttgatacactcacacatagctatgcaatagtatcaactgggctgttaaaattcacacagctaaatctctggaggatgggaaccccaaagtgtgaatggctttaaaagcttctcaggcgtttctaatatgctaccaagtttgaccaccatggtaacaaatggaaaccaaaatcccctgctataaagacaaggtaaggtcaacacagtggtataaaaattgtagccataggccgggcgtggtggctcccacctgtaatcccagcactttgggaggctgaggcgggtggatcacaaggtcaggagatcgcgaccatcgtggctaacacggtgaaaccccatctctactaaaaatacaaaaaattagctgggtgtggtggtgggcgcctgtggtcccagctactcgggaggctgaggcaggagaatggtgtgaatccgggaggcggagcttgcagtgagccaagatcgcgccactgcgctccagcctgggctacagagtgagattctgtctcaaaaaaaaaaaaaaaaaaaaaaaattgtagccatatactgatgcttgcagggacttctggagattcatcatcttatttgaaaggaagctgtattagagaaaaattaaaagcaagcagcaaactgagatctttaaaatataatcaaggagactgaattagttctgaaaaggggaaccaccttctccctgtctgaatcaacattcttgaatgcagaaccagctgctgggacagagatgagaatctcccagccacccgccaattcttacattctgtagttctaaaatcaatcattatcacacctaggtaactgctatggtctgaatgtcccccaaaattcatgtgttgaaacttgattcccattgtgttggtactgaggggtggggtctttggggtggtgattaagtcatcatgaatgattagtaacttgtaaaagagcccatgtgaggacacctacccagcctatgaggaacaggctctcagacaccgcacctgcccacacctttatcttgggattcccgggctccacagttgcaagaaaataaatctcttttactatatttttaaattacccagtctcaagtattttgttatagcagaatgaatagactaagacagtaacataagaaaatcctgggggctaaaaatgctacatagacatgcatcaaagcgcagaagtggatagtccaagatctatgatggacaaataaacagagggcactcaatttgaccaatcttagtatctattttgctttaagcaaaatgttcctgaaaagaaggaattggttttgtaaataaagttccaccttaaagtactcgtttatttatggaaccccacagtaaatcctttggtaaagtaaaccacctcgcaatgcatctgttttgaaagtccaagctttccttaaggtgaaatgtccctttacgtgcatttttcagtatccagataaatgtggaaaaggcagctgacatgggggtattttcaggggcaggagggtgaggagattataaacatgacaggagcaatgaacacttatcaggcttatgtagccctggcactgattccacacttcaatatggaaaatactcaaataccacttactctgtgccaggcactgctctaagaatttcccaagtgttagctcatttacctcatttaatcttaacaatgagtattagcatcatccttattttacagaggaagcaattgaggcccagagaggcttatcacctggcccaaggccataaagctagcaagtggtaaggccaagactggccttgtggccctctgactccagaatccattctcatctactatgctatgccacctctatgggaatttacttatcacatcctcaaagagccctgtgagataagaacagtgttcccattctgcagacaggaaaatcaaggcctggaggggttaagggttgagcccttgattccacagcagagcttgggtttggactatcctggtcctgaacttgtgctcttagtcaccatgtcttcagcctctccacaagcttcccaactgtgcccatggtcttgggattgtgtgtccatcctgttgtagagatcaactagttcatgttgatttagttgatgatcctgttctagagctcagtttccttatcactactcttttgaatactcttcatttcataaaaatataaaacaatccatcattcatcagttcagcaattcatggggtatactgtgaagatactgcaaattccagtcactccctctcatgttaatcctgcttagtttcctagtgatatatacaccatattgtccgtattctgagtaattatacagaatataatctcatttgaaatgtcaaaaattagaagacaaaatttgtgtaatgtagtctaaatttttacaaaaggagaaagaaatatgaattactaaaacgattttaactgagttattttgccaaagcagtatacttccttagtttataccaccttttacacctcattcttttctttcagtatcagagtggataatactgtgtcccccaaaaagacatatccaagtcctacttcctggtaccggagaaataggtgttatttcttatttggaaatatggtctctgcagatgccgtcaagttaagatgaggtcacactggcttagagcgggacctaatccaatgaatagtgtcataaggaggaaatctggacactcatagaaacccagaaagaattccatgtgacagaagaggcagagactggagtgagcagctgtaagtcaaggaacgccaaagcttgtcagcaacccccagacgctggaagcagcaaggatatgctcccctagtgccttcagaggaaacttggccccacagacaccttgattctgtcttctaaccttcagaactatgaggatacatttctgtttttttaagacacaatttgttgccttaagtttgttacagcaaacctaggaagcttatacaggcatattgaaaaccatactcaaagtggatttttaagtgccagattctgccaggtgcagtggctcacgcccacaatccgggtactttgggaggccaaggtgggcagatcgcttgagcccaagagttcaagaccagcctgggcaacataacgacaccccgtctctacaaaaaatacaaaaaattatccgagtgtggtggtgcatgcctgtagtcccagctactcgggaggctgaggtgggagaatcacctgagcctgggggcaagctgagactgcagtgaattttgatcgtgccactgcactccagcctgggcaacagagtgatatccagcctcaaaaaagaaatccagattcagacttccatctttttggatattctttatttttaattagtaaatattacacaaggatccactaagtggaagctactatttttcattaaaaataataaggagaatatgctttttcttatattggattctcttgggacaaaatggtattttttcctaacttttctcttccagtcttactgcccctactccaagagacatgaggtgatggaaaaaatctatcttaatgctcttccagcctaaagatggcagctttttacctgatcatgtcaatagtccaattcatgctccagaccaacagggctgccatggacattccctgtaaccaccgcgatgtccatggcttcgtgggatggatgggagtcataagatatgacgggatagaacacgttccaaaacctgggatcaggccttctaatctaacctgagacaatcaagtagccttgggaaagggcttcttcattcaagtcagctcctcacccgaggacccagacctgtatgtccaagtgccagtccttcctctcaagtggaacaaaatccatgctgaactactgagctccccaaatctgctttctaggccaccaacctgcctagctataaccaaaaactcagagccatccttgacttctgtcctcaccccaaattagcaagtcctattagtaccacttttaaaacactcaaaatccaaccatttgtcacctctcctctgctacctctgagttcagccagcaccctctcatcattatcactgccacagcctcctaagggatcccatttatacccttttcccctaggatgtatgcacagccagcagccagggtagtctgggacatacatgagatcctgtcactcctctgttcaaactctccaagggctcccatgcctcttggagtaagaggtgcctgcaatggctcataaagcccactgacctcatctactcatgatactcagtgagtctcaggtttcttccctgctactaactaaaggccattgcactgctaatttcttcttcccagaatcatcttcccccaggtatcatgtaactgactccctcatctctttctggtctttgctcaaaggtcatcttcaaggagaccccctcagaagacactgtgtcgctacaactccctgtcccagccatttccaatgctgctgtttttcccttcattttcatcatttcatcttcctaatacatagtattgttcaactgagtgtgctgtttatgtgcctctctccctttctcctttagagagtaagttcctcaaccactggacttttgtctgttttgttcatgaatacattcccaggatctagaacactgcccagcacagagtgagttccatgaatacatgattaagaaaggagtggtaacgggaagttatatcatctcaagacatactttccatcaagaagtcacttgctttttgctaacagagaagtcaggaatagaaaacagcatagtattctcgagtagtctccgagagccctggctgggagatggtttcctgagaagatggtggattatcaaaaacagacaggcatatgtgcctggaggttctcaacagcttgtcgggggaaggtgggccggtgccttcagggggaggtagcaggcgagccaggagggctcatggaggatgtgtacaccaagtttttaggcccatcacaaacttcatcccagttctctgcgtgaccatttattagcaaggctctgaagaatggacatactgcaggggcacactgcagtctgcagggaaaagaaagtttccagaaaaggagcctactttctattttgcaataccactgacagaacacactctactggctcgccaagatccagctgtataaggaaacaggagttttccaggccccctggggaccagtaaaccagccaccatgtgcggcaaagctgtgacaagcaggcaagactttgacctccgcctcatgctcgtgctctgttaggctctgacattaaagggggcagctcgccaacaaactgctggcaggaggaagataaatttattatttgaaagccttttgggcaaaaaaaaaaaaaagtcatttaatcttccttcataaacagctctttttataacacatttgtgttgagatcatagtcaaggtaattagaaatgtatttggtctttactttctcattaaggtgttgaagcactggcaatttgctctaaaattcagtggcttaggaaaaccaccattttatgatatcttacacttttgtgggtcaaggatttgggcaaggctcagctgggaggatcttctgtttgggtgtggcattaaaggtcccattgtgtcacttaactggcagatgggctggctagaggatgcaagcaggcattctcatgtctggtatctttgcaaggatggctggaaggctcagctgggactgtcaccagaacacgtaagtgtgacctctccagcatgatggtctcaggttgaacctcctaagtggtggatctaggctctaagattaagggtcccaatgaacaaggctgcatgttcatgttttaaaaccatcacagggttgttcctagattacctacacaatgtatctttgattttgtacccacagtgggattcaggtgctcactggcctccctacctaacaactcaatcatttcagccattaattaagcccgtttagagatctagcaatgtgcaaacactggcagatatcaaaggaaatggcacatggcttgcaatgagtgaacatatacaatggccaaggtcatagacatctgttcttttagcttgcctagcatccaagctttattttggaaatggtacttccattttcttttggggaatgatgacttttcctgtcatctcatgcgattcaggtggtcccatgacctagatgtggccaagcagaatacaacttacttgcccactctcagcatggcagttgttcaaatattgatatgtagctcaacaagagtacattccagtacttttctatgatctggagaaaaaaaaaaggcatgaaggatagcgagaggggagcaccagaaagtaatttcataagcagaaccaagggaaagaggctgaatcctgatgatagggtttcaggctgcctgaagccagcctatccctagaatttgcagttacataagccaataaacttcctttgttggctgtgaacaattctgaattgggtttctttcacttgctaccgagagtgccgacttgaatccagaaacaatgagagaggacaacatagtattgggatcaatggaaacactccaaaagattaaaaggcacttatggaatgagcctctaatgctagatgtcaaaggccattgaaataaggatctctgagcagtagagcccagatcagctacctgcaaatcacaccatgcaggttgtagactactggactatgtgagagcagcatggttcaagtcactttgctgcaactcactccaaaatgcctacttcttggcttcttgaattaaaccaaataacaccaacttaagaagcactgggcactaaatagcttagagttgccaccttttcccactaggtggcagctctgcatcagggaggtagaaatttggggtctgacaaactgactagaattaggacccttaaaagcgaagtactggtggtttggatgccatcttagagtaagaagataataggaaatgtaagatgccaaaaacctagaaaagtcaaccattcatttagtatctactctgtatttagcactgggctgctgtatcctgtagattcaaacaaaatccaacacagatgtccttaagaattaaaatattgctgagaagccaagaccaacctgcaaaagctttaaggttcaaaacaagagaacaaataactaagcattgaattttctgctctaggcagaaagggctgtagggatctccacagtctcagtgttggagtcctcccaagctattcacttcattgatgaggaaaccaaggcccccaaaaatggcacaatggcctcaggatcacgagggcactgacagttgagcaggcaaggaagggctcatttataggcattctgggctgggacctgacaattgggaacaatctggtttttttgagactgagtcttgctctattgcccaggctggagtgcagtggctcactgcaacctctgcctcccaggttcaagcgattctcgtgcctcagcctcagctaggattacaggcatccgccaccatgcctggctaatttttgtatttttagtacagatggggtttcactatgttggccaggctggtcttgaactcgtggcctcaggtcatctacctgcctcggcctcccaaagtgctggaattacaggcgtgagccactgtgcccagcctttaaatttttgttttgtattgtttttgtttttgagatggagtcttactctatggcccaggctggagtgcagtggcacgatcttggctcaccgcaacttccaacctcccaggttcaagctagtctcctgcctcggcctcctgagtagctgggattacaggtgcacaccaccacacctggctaatttttattttatttgttttattttatttttttaatagagacggggtttcaccatgttggccaggctggtctcgaactcctgacctcgggtgatccaccctcctctgcctctcaaagtgctgggattacaggtgtgagccaccgcgcctggcgaggaacaatcttctaaagcagaagggcacaggagagtagaccaaggggaggaccacaagggacaagtcaggcattcccttctgagactaatgtttttgaaactgcctttaagcattccatgcttaagtgatttaattagtaagaggggacaatccaaacagcctcctcctccttccctgggcacagctctcaataactcacactttgggagctcgcagggagagtatcttgtaaaatcagctgtggtgatgaatgtaaaaagcaagtttgaagcagtgaagcaccacacaagtatttatgcaattacacaaggatgatattttttaattaacaagaaagactaaaacttccttattcttatgctgctaagctcgcgacgaattacatgaaaataacactggtataattctccattcccagctcttacatttcctctctggtctagttctccctccaagatcactgctctgagaatcactgcagatcatttttccagggggacattagttttctctggtccaaattcaggcgtattgtttcattatttattgccaacagcattagttcttcctcttgctattgcgctcgggcccatgccgagaacagaacatggccttcctctatcatcatctgtacatttcattaagccgtgttttcaggctcctctggatccctcacgcagttaataaaggatactcagccagcagtgaccctagaggcaaaacattgagagaactgtctacattgttaagaggtcaaatagccaacagaacgaagccaatccattcaaagacaggctgcttcttcctaaatttagggtttgtttttttttttttaaaataaaacctatgcataaaattttatactgaaatattagaattatcttatggtatcaacattccacttggcatggcacccaaacataagtgacaaattttataattgcataaactccaaaacaaaggtgatatcttgacttaacataggaaaatgtttatcaaattatagatacatatgtgttgaccccaaggtagacatggccaatatgggaactaagacagatctggcagatgtacgtacaaaattgcaggaactgcattaaatgtgaggaagaagtgaaggacttctcagaaattggggtctcaacagcctaaacatactagggacctgaatccaactggagagaaaaatctggaataaatgtgacaagctaaaactcaaactgaagccaagtataatcattttgcaaaatggaaatgaggccctcaaagggctatactcttaatgaaacaatggctttaaaaaaccgcaaacacaaaacaaaacaaaaaagctctgcaaggggaagcagcagggaaacttactcatttgggccttagctgtagacagagaaaaggcctcccccactgtgaatctatcatcacagatctgtgtccacacagcttcagggactgcatttagactaaatgcatgacctgcgatccctaaagcaacaacattaaccaaaagtggtctcagaaggcacttccaggtatctggcagaagcaaacaagtgtcccgtggaggcctgctctcaagccagggccttttggactgccacagattatgacagttaaatatgggttcccaataaaaagtgaaaaataccgaggaaagcaaaactatgagctagagttggtaaaaacaagaaatagcaaaagagagaaatagcatacccaaggatatcagatcggcatcttcaaatgcatagtataaaataactaaattagaaatatcatttatttaaaataattaaactaaaacatgagcgaggaacaagagttaaatgaccagggagatttgaaaaagaaacaatttctacatatgcaaaatacataatagctgatactaaaaactcaaataggtcagatagagtcgacacagttaaagaatgaattacctacttgaggaaacatctcagtacacagcacaaagaggaacaaaatgaaagagggattaagagacagggagatggaataagaaggttgaacatatgtctaattagaaacccaagagaaagaagaaacagaagataacagctgagggttctccagaattgatgaaaaacataaatcttcagattctgagagcacaagaaattccaactgaggaaagaagggacctagatataagcaaagtaaaaagtagagacagcaaagccactctaaaggcagagaagagattgattacttcaaagcaacgacgttttgatattagacttttgcagctacaaatggaggccagatgacaatgaaatcatagcttcgaagtattgatgggaagcccctagcaatctagaattgcggatatggctaaactgacattcaagaaattaagcaaaatagtatttttagcaaacaaaaagagaaagtaaagtacaaacagtatgtcaccataggacttgctaaaggatgtatttcatcaaaaagggtaattatctcaaagggaaaactgaaataagggaaaactgaaataaggaaaaacaagcaaactgaacaatgtggagaaattttttaaaaataaacaagaagaaacagtaatttaaaaaatctaatttccgggaattggaataaagatatatccaaaatactgattaaaaatcacagatacaatagaaagggatgatcaaagctaaaatattctaataaaatactgtgttattcaggaagagaagaagatatttgtgaacaatagacatgaaggtgattgttcacctaagagtaacccactaatatctgcaaatggaatgtctaacttctaaaaactgtacaggaagagtatttttagattaaaaaaaaaaagctcaagataggaaagtaaaataaaggcagcagctgcatagaaaaagcacaaaatgacatggcagaaataatttatcagaaatgccaatagagttttagaaaagagattagattttagaagccaaattctaagctgcatgtgatagctcatgcctgtgatcccagcactttactaggctgaggtgggaatgatagcttgagcccaggagttcaagaccagcctgggtaacataactagactgtctcaacaacaacaacaaaaaattagctggtgggcacctgtagtcccagctactcagaaggctgagggaggagaatcgtttgagcccaggaggttgaggcttcagtgagccatgatcatgccaacacactccagcctgggcgacagagcgagactctgtctctaaaaaaaaataaagccctagctctgaactccttacataaggcatatctaaaatacagaacacagacacagaagagaggggtggaagaagaaaaaaagctatattaaaacaagacaaaatagacattgaggcaaaaaggcaaaaagcacttaggataaagagtcatttacatcttggcactacctagaaaagaggcgaacatttttaaccgtagaccctgcctcaaataggtctatgtgaaatgcacagagcaatacattttgaagttgtcccagatctaggcatctggagatgagttcagaaattctctctaacaacttttatccaaggccttaagagttccaaggaattcacacataaagatccaaggacaaggacttacagtcaaaagtcacaaacacaaaggaaacctagacagagcaagacttaccacacatttaatattccaagtaatgagaggcctctttcaagaatacagtaaaaccaacatttatagagaaacaaaacagaatgtttaccaacagatcctcacactaaaggaaagtcttcacaacatgctttggacagaagaaatattgtccaacataaaagatccaagatagaaggaatagtaagcaaaaaagaatctgtttatacatggatacaactaaacagatactgactgtaaaataaacaatagtatctaacttgtggaaggagaataagatataattaaaatactggatgacgatagcatttacactgggaagcagtgattaccttgatagtgtctttaaatgcaaataattagcattaatctttggtgtgacttctaatattctaatgaggtttgtgtgaacattcccctgggtaaaattctacaagtttttgaagcagaattttcagcaaatgctggaactgtaattagagttctcccaatgcattaccttaagaaaagatcaagaatggaggttatgtaaataatctgcacacataattcaaaaggttgaatcccagcagtacatttggaatttatacaaacaattataaatcaagttcactttatcttatgacaaacaacatgatcttaatttttcatgatctttagtatttctatccttggtgctatatctttcactattagtctctcacgttttaatgttcaatgatgttacaattcttgatccaatgaaattaaaattagacgctttgctaaaatgaaacacaacagaagaaaagtgataaaccatgttaatagtctgatttatccatcaattacaaagaggtgtgttaaaatctcaatccaaaagtaaaacacaccacacacaccctcacccatccaccccagaaggacagataaaacaaaattagcctacagataaagaagtagcataaagaaagctaaggtgtacaaaggaatgaaaaaaacaactcattaaagttcattctttggaataaaccaggcaaacctctggagagattaatgaggaaacaaaaagatgacaatattaggaatcacaattggagcataacttcagatgcaactgatttaaaatataatgaatttcatgcctataaaattttaaactgtgatttaaaaattgtggagaaatgaacaaattcctagcaaaatacaacttaatgaaagtgattcaagaggatatggaatacctgaatatttctgtaaccattcattaaagtgaattcaattaaaaatctttttacaaaataaaaaccaggcctggatcacttcctaggcatgctctaaccaagcatgcaagcaacaaataatcctagtttacacaaaaatctttcaaaaaatagaaaaagaggaaataatttttaactagctttgaggttggcataacctggataacaaaaccaaagacaccatgagaaaagaaaattacaggagaattttaggaacatagatataaaatatcggaaaactgtttctcaccatgtacaagaaaagtaaggcatcatgaacaaaatgggtttaacttaggaatgcagagtttgtttaaaatcatgttatctcaaaacatgaaaagatgatcaataaaatttgacagtgatttcaaaataacacactcttagcaagtaaagaatggatttatgcttttataaccaatagagaactttcacacgcatagaaacatgcttgcaaataaactttatggtgaaatgtctaaagcgtttcaagatcagcacaagataaggatatcaactttcaccaattctactgcacagtgtactagagcaacgaacggttcttgaagtgtggtcctggaccagcagcatcagcaccactagagaacttgctgtaaatgcacattttctggctttaccctagacccactgaatcagaaactcagagtgaagctcagcagcctgtgttttaataagccctctacaagtgattctgatgcacactgaagtttgagaaccattcagatttcaagtagactaataagaaaaatatataaagcttagaaaaaacaaactcacctgttgatatacttgctcttagagaaacccaaaacaatccacaagttatcacaatcacaggctaccaaaacacacacacatagcccagatcttaaattaattcacaaatgtcttcaagaaacaacaaatacaactttaaaaggatagcatttataatattaaaattaggttttcggagtaagtctagcaaaagacatgctttttacagaaaaattagaacatttcataaaaagattaaagaacttttaagagtagatctacactatgttcatagataacaagaaatctaatttgagagtaactggtttactttaacctttagattggattacttttggtgcatcttattttggcagaacttgactaattgtaaaatttgagagggtaaatggcatccaaaactacaggtctgcttgggcccaggagtttgagaccagcgtgagcaacatggcaaaactttgtctctaaaaaaattgaaaaataagccaggcatggtggtgtgcacctgcagtcccaggagtggaggctgaggtgggagaatggattgagcccgggagtccaaggctgcagtgggccttgatcacaacccacactccagcacaggtgacagagcaaaaccctgtcttaaaaaataagaaacaaagctaatccaccatgatcaagtaggttttatccctaggatgcaaggatgattcaacatatgttaatcaagaaatgtgattcatcacataaacagaaataaaggcaaaaaccatatgattatctcaatagatgcagaaaagacttttcataaaactcaatgccccttcatgttaaaaaatcaacaaattaggcattgaaggaacgtactgcaaaatagtaagagccatctatgacaaacccatagccaacatcatactgaatgggcaaaagctggaagcattccccttgaaaactggcacaagacaaagacgccctctctcaccactcctattcaacttagtactggaagttctggccagaagttaggcaagagaaagaaataaaaggtatcaaaatattaagagaggtagtcaaactttccctgtttccaggcgatatgattttatacctagaaacccccatagtctctgcccaaaagctctttgatctgataaattcagcaaagtttcaggatagaaaaaaagttaatgtatgaaaatcagtagcgttcctatatgctaacaacatccaaagccaaggggccaaataaagaatacaatccattcaaaatagccagaaaaataatacaatacctaggaatatagctgaacagggaggtgaaagatctctacagaaagaattacaaaacaccaaagaaatcaaagatgactcaaacagatggaaaaacattccatgctcacagatagaatcagtatcattaaaatggccatactccccaaagcagtttacagagtcaatgctattcctatgaaactactactgacactcttcacggaactagaaaaaacgattttaaaattcattatggagccaagaacgagtctgaatagccaaggcgattctaaacaaaaagaatagagatggaggcatcacattacctgacttcaaactattaggttacagcaaccaaaacagcatggtgctgataccaaaacagatacacagaccaatggaacagaatagagagccctgaaattatgccatacccctacaaccatctgatcttcaacaaagtcaacaaaaacaagcaatagggaaaggactccctattcaataaatggtcctgggatagctggctagccatatgcagaagactgaaattggaccccttcattacacatatacaaaaatcaactcaagatggattaaagacttaaacataatgcccaagactataaaaactctggaagataatctaataaataccattctggacacaggaactgggaaagactacatgagaaagatgccaaaagcaatgcaaaagaaacaaaaattgacacatgggatctaattaaactattagggagaaaaaacaacttctatagagcaaaagcggctatcaacagaacagacaacttacaacatgggagaaaatatctacaaactatgtatctgacaaaagtctaatatccagaatctataaggaacttaaattcacaagcaaaaaatccaaacaaccccactaaaaagtggaacaaaggacatgaatggacacttttcaaaacaagactgatgcatggccaagaagcatatgaaaaaatgctcaacatccctcatcagagagttgcaaatcaaaaccacaagcagataccgtctcgtaccagtcagaatggctatcattaaaaaataactgatgctggtgaggctgcagagaaaagggaacgctcctacactgctagtggaatgtaaattagttcagccattgtggaaagcaatttagtgatttctgagagaactttaaacagtgacccctcaatcccattactattatacccaaataaaaaaacattctaccataaaaacacatgcacacatatgttcattacagtactagtcacaatagcaaatacatggaatcaactgaatgccaatcaacattacaatggataaaaaaaatgtggtatacacaccatagaatactacatagctataaaaaagaagatcatgtcctttgcaacaacagggatggagctaaaagcaaactaacacaggaacagaaaaccaagcattacatgttctcacctctaagagggagctaaacatcacatcgtgtccatatggacacaaataagggaacaacagactctggggcctgcttgagggtggagggtgggaggagggtgaggaccgaaacactacctattgggtacactatccttattacctgggtgataaaataatctgtacaccaaaccccgtgacacaagatttacctatataaacaaacctgcacatgtacccctgaacctaagttagaaataaaagtgcaaatgtccaagaaccaccaaaatattcctgaaaaacaaagtagagatcactttctaccaaagatacataaacatatagtaatcagaatagcttgatattggtaaggaaatagacaaacaggtgaatggaacaaaatcaaaagtccaaagggataacacgcacacatgaaaaggtgagtgatggcatggaaggacagaaagcattaaaatcgttgaggctcgatggtgtggaggacagaaagcattaatatcggagaggcttggaccctgccttcccataaggggaagaaaacgcagctggattcctgtctcatactttacataaaaaaattctacatggattggagaaggtgaaactacaaaactttaggagagaatgcaggtagatattgagaaaaaatgtataaaccatgaaggaaaaagggtgataaaatcgatgacattaaaattcaaatttttttcatcaaaaaaacaccataaactttctgcagcacataacctgacaaagtattagtattaaaatctgtaaagaatcaatgaatcaataaaagaaaaacaatctgatagagaaataggtaaaaggcatttcactgaaggaaatgcaaatggtccattaactcaaaaagatgttcttaatctcattaagaatcagagaaatgcaaattaaaactccaaagataccattttatacccacatggaaaaaatgatcacagtgccaactgtccagaaggtgaaataatgggagtcttcttccattgctagtgggagtgtaaactgacaccaccactggagaaatagttctccagcaaaatcaaacatcccccctccatgactgtgtaggtccctccttggagacatcctctagaaaaacttgcgcatgcataccaggaggcacctgtaagaaggttcacagcagcagtgtcataaatgcaaaacatatgtctaagaacaatccaaatgtctatcaacatagacatctgcatgcaatggaatactgggctgcagtgaaaatagtcaactgcatcaaaggaatgattctcaagaatacaatgggccgggcgcggtggctcacgcctgtaatcccagcactttgggaggctgaggcaggtgaatcatgaggtcaagagttcgagagcagcctggccaacgtggtgaaaccccatctctactaaaaatacaaaaaattagccaggcgtgatggtaggtgcctgtaatcccagctattcgggaggctgaggcaggagaatcgcttgaacctgggaggcggaggttgcagtgaaccgagatcgtgccactgcactccagccctggcaacagagtgagactccacctcaaaaaaaaaaaaaaaaaaaaaattacaatgaaggataaatgtatgtcaaaagtagagggctacagtacagaaaatgttctaggcaaatggttgttttaaaaattaagcagttcaccactggatggctgagtggatggtaccagtctgcactctgatgactcctcatcaactgctttcttttattgcctcctcccagatgtcgttcatctgccattagacacaaatacattttccaattgcacgtttcatgttatttatcccaatctagtattattcatcctatttttaaatcagaccttaaatatttgactctaattttcaaactgatgttcacagtaaagaaaacaagccaccatcgacactatttgagcaaatgctccattgatttgaaggcaatttagtgggacttcaaagagtgtttttgaaaagcaactgttttggaagtttaaacctcccaaagggtaggacactcgatatcccaaatgtgcaggtcctaacatctgggatggaaggtgttctttgttcaagtggtttagggaaatgcttctttaagttgaacaagtttctaggccaggcgtggtggctcacgcttataatcccagcactttggaaggccgaggtggatcactttaggccaggagttcaagaccagcctggccaacatggcaaaaccctgccaaaaatacaaaaagttagccaagtgtctgctaaaaatacaaaaaattagccaagtgtgggggcgcacacctgtaatcccagctactcaggaggctgaggcaggagaatcgtttgaacccgcaggggtagacgttgcaatgagccaagatcatgccactgtactccagcctgggcaacaatgcgagactgtctcagaatgcggggtgggggtggggtgaggttgaacaggtttcgaaactgcagtcttcttcagaacctttaacatgcaaatatctaccatgaaagcccaactcagggatacaagcagcctttccctaatgtatttggcccaggccctctcccccacctctggagcctcccacaggattagcagtctatggcactggtccccaacctttttggtaccagggactggtttcatggaagacaattttttccatgagggtttaagggaggcccagggggacagttttgggatgaaactgttccgccttagatcatgaggcatttattagattctcacaaggaacccacaacctaggtccctcgcatgcactgttctcaacagcgctcctgccaccatgagaatctaatgccgttgctgatctgagaggaggcggagctcaggcaataatgctccctcacctgccactcagctcctgctgtgcggtccagtaccagtctgcagcccaggagttggggacccctggtctatggaacacaatttgagatacactggcctggctcacctaaggcttctctattgattcgatgtgtaagttctgttctccctgtcttcttcagcttacaaagcatccttcccagaccctctccttgtaagccactttaacctgtcctcaggtaaacagctgcacactgcaaaatgacaattttttccagtcacacttaccattacttcagaaccaccaccttcagaatgctttatctaactgaatgctgcagtagttaatcttttcaagtactatttgccattttaaacaatttggtagataaaagtttattctaattagttggcacaatgtgtggggaaatgtctgtgtgtacacatgccccctaatacctcctatttctccccccacaccgtcactaactcccagcttttgggggaacaggtggacagaaactctacccacaatgcctccccataaaaaatccttgccaattcctacattttaaaaaagtcatttacaagcaaattgaatctcaaataaaagattttcctgcatctcagaaattaacagtgaaaaagagattatctcaaattctttcaattctctttagacataaacagggatgaaaagttatacccatcaaaacgctacccttggccagatgcagtggctcacacctgtaatcccagcactttgggaggccgaggtgggcggatcacgaggtcaggagatcgagaccatcctgaccaatatggtgaaaccccgtctctactaaaaatacaaaaattagccaggtgtggtggcacacgcctgtaatcccagctactcaggaggctgaggcagtagactgcagtgagccaagatcgcaccactgcactccagcctggaaacagaacgagactccgtctcaacaacaacaacaaaaaagctacacttactcccaatttgtcatctgttgatttagggatcctaagaatatcacaagtccacacatgacttctgaaaaccagcactttacatctggacattggatacattcagtgtgacaggtaacagaaaatgtcacacaaacggcagacaagtccctcctgcttctcagtgagaaaaaaaagattttaaaactacctgtttcccttcagaatcagtcctgtagaagcccacagcttatctatggtactttgtcccaatccaaagccttcctatatcccattccatcaaggtctctctactctcagccatgaaaagagaaacctacattaagatgttcaaatggaatatctgccatctcagattttccagagacatcatgaactaggacaaaaataatctgtagccagcaccctcccccatattctaaggaaactgtaggttttgaaaccaattcagccaggctttgctgcccaaaacctgccttaaaagtatcaaaagacaggctgggcgcggtggctcacgcctataatcccagcactttgggaggccaaggtgggcggatcacaagatcaggagatcgagaccatcctggctaacacggtgaaaccccgtctctgctaaaaatacaaaaaaatagccgggtgtggtggcgggtgcctgtagtcccagtgacttgggaggctgaggcaggagaatggtgtgaacccggcagacggagcttgcagtgagccgagattgcgccactgcagtccagcctcctgggtgacagagcaagactctgtctcaaaaaaaaagaaaaaaaaaaggtatcaaaaggcagcagtttaaaaggtgtagagaattcctctggagaaggctaatggggtctaccctcccctactttgcctcaaaccaagttagagggtctccagggaataagttgaagttgcatgtgagtccactggtgtttgtcaggcataggaaactacgcatggaaaatttaaaaggctatcccgatggacgatcactgtcagaatttgttgggacccagcaagtgagagtttcctgtgggccagatagggacttaggaatgggagcaggactagattgtcctgagagggattctacccaagaggactgcctggtggaagagacaatcccaacccagaagtggatggcccagaactagcttctaagaggggaaatctacaacgccatctagaggagccatggctgcacccagggcatgctggtgagagacggatgagggtcttgggttgggacagagcttacagcatctaaaataattcttctcaacttgggaatagtttgggctttagggaaccacaacccctgcgagattaaacacagaatttcgtgtgtatgtgaccaggttggactctcaaatgggtctaacctaatacagttaagaatagctgccctagaggaataaacactccccataaaatctctcagcagagacatgacaggtctcatgtagcaatgatttcaaaacggtacttcccgatgagatctgggtgtgcagccagctgcactgctgatgagatgctggtccatgtgttttaaccatcagccaaactgaatgggaccaccagcatcacatgaacacggaacttaagacaatgatcaggtcgctgcagcatttcctcccagaaagccgttttagtccaagatacaaagataacccctaatcaaactctggggaccaccagcctcagtaaaaccatgcaacaggctctgatctttccgtgggcctaaggatgggaacctaaattccagaaggaatctgctgagttgatgttatctaataatagaaatagtgactaaagcaaaaagctgatgctacactcaagaaaatcttagtaatagtttcccagactttctcctttaatccctatttacatttggtttcatttctgactaaaaatacccacattaagtaaaaatacccacattaagcaacagaacaaattcagccttaagtgttcagcaatggagtttaacgtaatctccaaatataattataccattagttaaatggctgtataattagtggcacaggaaatgaccatatgttatgtgaaaaaaatatgtacccacaggatctcaaaaataagaaatacataaatagaaaaaagactggaaggatatgcactaaaacagcaataacattacctgtctgatgcagttatttttgtattgttttcatactttgtagttttctgtattttccagatttttttctgcttttgtaatcagactttgtaatcaatttactctgcaaggcttattcctaacaactgggttggcagaaaactgtgttcatctttttcaaaaagaatattctgtctagttcgtataatacagtctacagtcaaaggaaatgcacgcatattagaactttccctccacctgtgaataattacctccaatttatcaaaatgtgcaatgttcatctaggtacttataaggagagaaggacagaattttcaaattctgttatttggtacacatttcaattgtttcgatggaataaaaattcagttctgaataaataagtacacaaagctttcaactttagagttttgagtaaaaatttattttaaaaagtgttctcatgttgtatgattgtgtaggagggagacacacagagacagtaagttatctactagattattccccgaaactacaaaatattgggagttttgcatatactgtcttctccagtctatctcagagagctaccatatgtgaacaaatccttacatcaaaactatgtgacaaagagaacatagttaaatgaaggtcaaaatgagaaaagtgtatgaacacgatggaaaaaattccaggttgccctgtgtcaggtctccccataaaacacagggagctgtggaccctcaataagaatagcttgctgagcagagcaagttagaagcctactcagtaagtgtgaggcagctggagcataaacacacacacattccctttttccctccatttaatggtggagaaaagaaagaagaactgagccagccagagctgctagtttgttttaaagacctggatacataaatgcttggagaaccgggtggctgggcctcacagaaccctgtgacagactaacctcagtttctggaaccctttagctgatgagtttgtaaacacaggtatcagcagccaggcatgggggctcacacctgtagccccagcatttggaaggctgacacggatggatcacttgagcgcaggagttcgagaccagcctggccaacatggagaaaaccccatctttactaaaaacacaaaaattagtcaggcgtggtggcgcatgcctgtagtcctagtcaggagggtgaggtacgagaattgcttgaacccaggaggcggaggttgcagtgagccaggatcacgccactgcactccagcctgggcaacagagcaagaccctgtctcaaaagaacgaaaaagacacaggtatcagcagctggaacagggcaacttttggtgcacagagaccaactcagctagtgatgggtgcagcctgcaccacagcccagaccttggctttgaacagggcccaactggccaggctttgtccagcgtcccttcctctttcatctccttgtatttcttcaaccaagtttagctcctctcagagatgcccaggttagagctgtgagaatctaatactaattggtgtcatcagctgataatgcatacatctacatctgatccctactgacacgcttcaaactaactgcaggcatttaaacacagggaaagggggagagtgtctgaggagaggacgattcagtggtccatcaagactattttttacaaacttcaatgtgtatttctaacagtggacagaaagcatcccatgaaacctagcacaggactgttaccagacatgagaaactttcatccttgcccattatcttatagacaacagcggccatctggagatctgcgcactgccccttggaatctggttgttgtacctctgggctcatcccctcctgcccctccctactgggactccatcagttttgtgagcacagcaaatacactgtgcatgtcaaacatcctgggaagcagtttaacgtttaacagttgatgcggtgcaagactgacatgcaagacaaaaattcacacccagccctcaagtttaccaaaatgaaaaagtcctttataagttaaagctttacgtgtaatgatagcagctcttgttaataaagcaccataataacagacagacatttacacagatcaactacatcattctcacagccagtgttacagatgcagaaatagcctcagagatgtcaaggcaaggaccctctgcctacactttagcaagggacagaatgtggattcccattcctcattcttgctgaatccaaagcccatgctctttcaaatgtaacatcttgccatctcaggctgctgttggactgtaatagtaacctatgcccttttcattcctgtctcacaacacaaaagtaaaagtgggggtggatgaatgcaagcagcccacatgctccagcactcacagagctcatgttacgggctggggccatcccagtttaggtgctgacactccaagagtcactaggctggggctctggcctggagctctgagccttggggtcccactgaccagaaatgaccatggaagagcatcttcaaggggcacatgggaaaggagggaggggtcccagacaggccttccccacttgttttagtggcacttgggggtgggggagcacaggtgagccatctccacccagctgggagccaccctccaaagtccgctctccttcctccacttggttcccagcttcaaggccacaggtgtgacttcaaatatggcagaatccacagacagaactaattttcagaagcttctgctcacagaaccataattattctcagaatcataagagggaactgtttcttttaaaaataaataaacagatatacagcactaaggcagtttccattgtccacccctgcccagatacaaagtcaggtgagatgggagagaccaagcccagcacacccaaaaagcagcatccaagctctccactccaagcagaagaggctccagacctctagagtgacccccttcctccctaggttcctccatgtaatgacatttagcctcctgttcccttcagcttttcacgatcccatgggaaactcccaacgtgactgggttcagaaagtctggcgcgttaaaaggtacctaatcctgttagtgtgcgggataatcgtttcagagaagacctcagcaccagcttatactaagtgcaatttcctctgaagttattatcccagccggaatttgaattgtaaagtatttctgatgccctgggaaagctcaccacgcattccagaaccgcacttctccctctaagtctctctctgcttggaatttacagccgcctcttctggttaccaaacatctttattcatcatgaatttctccactctcactgccttgcatgttgtactggagaacaagcccatcctccctaccgatcctgtacctgggcaaggggctctgaagttggaaataggcttagtcctcggtggccaagcagaagcaggaacagatgagtgataaggaaacaaagattcctttcctggcctgtatgccagggaaaatggagaggaacatcatccacatagcttcaagacagacagactgtggcatagcctgagaaactccatcacttaggggtcaaggtaaatagctgaagtttattaagaactaaccttttcctcgccacagccagctaatcaacttggatatagggtgggatttcttaatatcatccaaaattgtgatgactttttacccaattccctttcttcaaaggtatgaatagaagcaacaagcctaagctatagaaagataagaacctaggatctcaccaattacaatgtgttccagggaaaatacgttctacttacttaggaagtgttccttggcaccatgaagcaagttgacacacatgagttgttgcaggcactggggtttcctgccccagttcttgctggcattggaaaatgagcgtccataccaccgggttatgggaacaaaaccaggcaattctgaatggaaaactaccaccacctttttgggacaggtttttaaacgagactgcatgccaaacgctggttcatcctcttgggctcagtttagctcctttttctgtgagggattaggctggcagtcattcacagaactaaatcaagatttttctgcactattagtttccttctgagaatcaaagaatgtgttagctatggctcagcagaccttagcaaggatctttcctgagatggaacgtgattgacagggaatgagttaatcttctgcagctctaaatatggcatttttctaggcaagaccgtcagagaaaaggacatgctccatctacaaataaagtagaactagtgatgtggcggtgtgtcttcaaactccagagaaaggcactgggccccaccttgtagttcatgtaaatatcagtcctgggaaagggaagtggaaagccagtgctttttgtgaaagtgtatgtggtacatgagaatttttttacacatatacagtgtgtagcaatcaagtcagtgtattcagggtgtccattatcaagatacaatacatctttgttaagtatagtcatcctgctctgctatcaatcattgaatttattccttctatcttactgtatgtttttaatctttaacccatttcttttcatccttccctctcccacccttcccagtctcttatttttccactctatcatctgttcaaatttttgtttagctcctaaatgtgaatgcgaacatgtgatatttgtctttttgttcctggcttatttcatttaacacaatgacctccagtttcatccaagttactgcaaatggcaggatttcattttgatggctgaatagtattccatttcacttacatactacacctttctttaaaaatctcagccttggaatcgaagaatcaagaaaaactcagccaactcatgggttacacaagttgaggatgccacctgattatcaacaggtactgctcatcaatagcaccgttgggactctgccacttaggcagggaccagcctgagcccaaaggtgaatggggtaaattcctccagttccttcggcatggtttgtaggatcagtaaaggtaacacaaactgactccccccctttttttttaatgtaaactccatagcctagaataaaatactataaatttaagaaagcttaggtctataaaactaacattttataacaatgaagagaaagaaagaggagaagcagctaccactgtgagagagcactcggagtcccgctcagactcagagccaaatgggaaagacatttttcccagctaaagaaaggattttcggccgggcgcagtggctcccgcctgtaatcccagcacttcgggaggccgaggcgggtggatcatggggtcaggagattgagaccatcctggctaacacggtgaaaccccatctctactaaaaatacagaaaattagccgggcgtggcggcgggcgcctgtagtcccagctactcaggaggctgaggcaggagaatggtgtgaacctgggaggcggagcttgcagtgaaccgagaacgcaccactgcactccagcctgggaaacaaagtgagactccgtctcaaaaaaaaaaaggattttcagtcccagtgtagtttgatgccagccccccgttaaaggaacttacttttatagaaaactatgaaaaggcagtggcattggaccgttctaaacatttcacttctcagtcctcacttaccatgttccaaaaagtcagcatgtatacgtgtggcataaacctggacaagatattccctctgatctctggccctctcctccagccctctccaagaaggacattgtccttgcctcctatcccagagagctggcaaatattcccctacccaggggtctggtgagaaccaaaccaggcttctcaatgactcttgaacatggctgaaggtccttccttcaagaaaggagacagatatcaaaattgttcatacccaggttaaggttaaacaatctggtcatgctacttttttaatccatctgcctggcacaaccaatatatctggggactcatcactcactagacaaaaatcataaacaaatcacatagcttaaaggctatttggaatactcaccctgtgccaaacaggactgtgtgcttttcacattgtctgccaattttttcccccacaacaaccctatgagattagtgccatgatttctgctgaggaaattaaagcacagagaagttaagaaaattgaccaaggtcacccagtaaatccccaaatccattttctcaacattgatgctgctctatgcctcccaatagagttaaaaaaaattaaaaaattaaaaatcccacgctgacatccaggggttaaattcagaaccaggcacagcactgtttttcactagacttttaattcaaaaccaaaaataagttttagttacaacccaatttgttactgatccctctgatgagagtaggaaatcgtatcagagataggttatttgatgactgcatataaaattcaaattcttatggacatatcataagcaaaaatgttggattaataaggaacactgatacataaaactactgatgctagagatatttatagctagaaggctttacacattcctaaaatatcacattagagacagaaagaagcatcattcaatgttttaaaagtaggttggaaaaaaaagattagcattataattaatgacagaagagtgaaacattctgttctgtttaatggccaagtactgatgggataaacagtgaagaaggaaaacaccattgcctatccaggactttttcttttgatcacagatcatttctctctggccagcctggtataaagtaatgtatgatggaaataaaaaaggaagaaagccttcaccatgaaacaaaagcctacccagcacaggttttgtttgggcacacgcgtatgtgtggcagcaatatggtgtggaaagaactgggaaaaacagcccagagaatcatgcccgtaatcctagcactttgggagaccaaggtgggtggatcacttgaggtcacgagttcgaaacaagcctggccaacatggcaaaaccccgtctactaaaaacacaaatattagctggatgtggtggcacacacctgtaattccagctactcgggagactgaggcaggagaatcacttgaacccaggaggcagaggttgcagtgagccgagatcgcgccactgtactccagcctgggtgacagaatgagactctgtcccaaaacaaaaccaaacaaaattagccgggcatggtcgcacgcacctgtagtcccagctacttgggaggctgaggcagaagaattgcttgaacccaggaggtggaagttgcagtgagccaagatcgtgccactgcgctccagcctggtgacagagtgagactccgtctccaaaaaaaaaaaaaaaaaggccaggccagaaaaggtggctcattcctaattcctataatcccagcactttgggaggccgaggcaggtggatcacttgaggtcaggaattttagaccagcctggccaacatggcaaaaatgcaaaaagttagccaggcatgggggtgggcacctgtaatcccagctacttggaaggctgaggcaggacaatcacttaaacctgggaggcggaggttgcagtgaaccaagatcgcaccactgcattgcagcctgggcgacaccactgagactatgtcaaaaaaaaaaaaaaagcccagagaaaacctcaacagccatgacccagccttgtgactacaagcaatgccctcagagtaagcatcctcatctgaagaacaagagggcttgactatgagggcctccttttctggttctaaaactgtttcacgtttttagataatgttggtttgtgactgtaacattaacatgctccattcaacatgggaatccaaggaccaagtccatgcaggagtgggagagccagtccctgagcacaagtcttgctcactggctggggcaatgtcaggaaagggtccaggagacagaggctgagccactgagtggaaacatgtcaagtgtcatgaggagatgagggacaagcttcaagggcttattaaaaaaacatttgaattcagtttctctccacaggtttttcagtacaggtccatatggagatcctttgggctttttacaggcaatgaagtctctgtttcccctcagctctgctcctgtagcaggaatgcagccatagacaacatgtaaggaagtaggtgtggctatgttccaataaaactttacttacaagaataggcagcagtcagactcagctaatgagctggttttgccaacctccaagaaagaagacaattccatcagaacatcccacaaaaggcaggcagggctacggagggcccactgacaacagctgctggccaaagcccatctgcacatgaagccactgtacacaagttccagaggactttcactcccccatcagatgctgcagccccatctgaatgcactagaagttaacataccaccactgggaaagcagacagaacaccacattcccttttcatgagcctgacagcaagtctaggatgttttcacaaacctgtaaataacctggtccggctggcaatttcttctaaatgttgactctctgtgaatgtagtgaccagggttaccaaaacatgaaggggtggtgggaggaaaaggcaaggaggaggaggttatcctcaatataacttctgcttttgaatctttgcaaaagcctcatgattactcccaaagaagtgaacatgcatgctataattttacaattatattattaaataagcagatccacttcaattgaatcagaaaaagtgttaagttaaataggatggggtaagatttctgagggcactagagttgactgaattttctagtacttaatgaaacaagaaagtatattttgtactatacataaatagagcagaaattttaatcaccctataaaacattcatgtttgtggcttatttcactgcagaacatgaagggttttgagttttattaaatcttaggagagcaactattcaaacaatgaattattttcttgggtacctggtaattgctagtttgcaatatattttaagtggaagggggttaatttaccttccgcggagccaatgctttaaattgttcttaaaggaagaatttaaggacgccactctgagaacatgaattccaggtcattagtttcagttcctgatggccagaaacaacatctgggcctaattatttgtatgtgcatctagcgggcaattggttggctaattaatatattttaagaggtcagcatttttagtgatagagttgtaaacacaagacttattttgtctaaagagcaaatgctaattttgtaggcttcctctacgatagagacttctcagtattatcttacactaatatgaccacaaccgttggttacagagtgtagacagggtcaagaacatctatcttgggatgcttcagcacctagagaccaccattgtaatctgccattagctaagcccagaaaccccaacaggcagaaaaaacttactgctaagaagatgaatatagggtctcagatgcagtttactggcttcatgaattcatcccctgggagcaatggaatggacaggccaggaccccagaatgtctccaccctttgtctttcacagcctaagattctgccttgagccttccatttccttggtccctgcatctctagaagtcctttgtaaaaattaaattaccctgaaagctacaaattgcatgcgtatgctacaacaaatggtttcagatttactcatgctacctagaaaagcatccagccaatgagacctaggacagatgtgtgcgagggtagagaagaaggtgtcagagcttcaaggcatgcccaggacggagaggtggttccacagtgtgaaaggctgaacagccagggaatgccaaggctgtgactatagactgaaaaattacacacttaaagggagaagggaggagagtagagatcccgaagaccaacgtccctgcctccatttgtatccaaccctgacagggcagggccctatgcagttttctttgcacacagtgcacccaaccctcagagtcccagggagcttttaaaaaagaggattgctttcattcattcttgagttttaagatcattgatgacaccactctttaggctcaacaactgagaaaaactctgatgaagggaaaaacatacattgggccaagcatggtggctcacgcctataatcccagcactttgggatctgaggcggacagatcacctgaggccaggagttcgagaccagactggccaacatgatgaaaccacgtctctactgaaaaaacaaaattagccgggcgtggtggcacatgcctgtaatctcaactactcaagaggctgaggcaggagaaatcgctcgaacccgggaggtggaggttgcagtgagcccagattgtgccactgcactccagcctgggcaacaacaacaaacaacaacaaacaacaacaacaacaacagaaacagatacattaaaggctcttgataacttggttgtaaggaggccacattatagccacgggaggcagcacattggagtagcaggccaagagtgtgggctgaggaggcagagggcccaattttggaactactctgacacttataagctgtgtgaccttaggcagggtgtattcacctcttgtgtcagtttatgcatctgtaaaaggtggacagcaatatgacttgattcatatggctactgtgaggatgaaatgaacaaatacatgtagagaccattcaatggtacctggcacataagcactcaacaaacattacagggcacagtggctcacactttggggatgccgaggcaggatcccttgaggccaggagtttgagaccagcctgagcaacatagcaagaccctgtctctaaaaaaaaaaaaaaaaaaaaaaaaaaaaaaaaaatatatatatatatatatatatatatatatatatatatatatatatatatatatatatatataaagttagctacatggtggcatgcacttgaggtcccagctgctcaggaggctgaggcagacagattgctctagcccaagagctcaaggctgcagtgagctgtgattgtgccactgcactacaacctgggtgaccgagcaaggccctacctctaaaaataatttttaaaaagttatcagatattggcagggcacagtggctcacgcctgtaatcccagcactttgggaggccgaggcaggcagatcacaaggtcaagagatcaagaccacccttgccaacatggtaaaaccctgtctctactgaaaatacaaaaattagctgagcgtggtagcgtgtacctatagtcccagctacttgggaggctgaggcaggaaaatcccttgaacccgggcagtggagtttgcagtgagccaagatcgtgccactgcactccagtctgggcaacagagcaagactctgtctcaaaaaaaaaaaaaaaaaaaaaaaaaaactgttaccagatataatctttattgtatataaatcatcatgttccatgaaatgagatgtgatgctcagggttccataatcagaaaagctcaactaatctccatttccatcagcaccacatcccgacaaataacattgaaaatggaaaagaaaagcaagcgagcccgtgcatgccacgcgttcctttgcacgacttccacacacattatgtgtaagttgctgggggtcatgaaataatgactacaagtactctgacctccttggagaaacgttctatgtaagtactgaggattatgttactggagaaattgtataaggaaatggggcctcccacactgaagttgaggcatattccataaacactcttaatacattaaaagaatttacatgttttttttttttcaaacagcaaccaactttaaatgttaggagccaatacagacactgtgacatccaaaaatacaggcatcttacattgttttcagacaaccaactaattcttagaagtgctttatgcattctctcgggcatgaaaaggtggggaggtgggcaggcagaaatctccctgttatttctaagagctctgagaagtgatttggtcgcacttacagcaattttaattcaccgcatgccaaactgaaagaaagaacaacatcacgaaacaaaatccatcacatcttcaaagctatcgaatgcacagccagaaaagagtcatgacagggatgtgtctgaccacaatttcaggatttctagagagcctgggtctcagggaagcagagctgagcctgatgacagtgcccagtgacacgtagctatgtcatacataggtagaggaaatagtaaaatccatcctgaaccgactgaagcagaaacttttcccactgccagcaatgagctgcgtgatcaaacacatggatgaaagcttcctggacccccgtttgctcatctgtaaattgaaggagtggacaaagcagagctcagaggtcccccctcccagttctaagtttgtgtcactgattccctttatccctaggacctcgctatgcaatgctttccttttctctgtctagctgcgtccctaaagccgggtcacagacaatgcgtgagtttgttggagctcatgtgtagttctccagacacacttcagtggcctcaccagggctcaggacccctgcatacaattgcatagttttgccctgtacgtgggcacccagctgagagtgccgaaaggggccgaaatccagcctgcactccctctatcagcctaaaggaagggatatcttttcccagttgaaaaataaagcatcatacacagtagctacagccctatctggaaacacaaaccttttcacaaacacagaaaatataaaaataagtaagcaaatggtcatttagtccaacatgtaagttttaagatttaaatgccctttaaatagaggctgattccttatagcatcccaatcttcccattttacactgatcggtcttgcttagcaaggcaaaagagtttcatacttcattctcggtgtacggtattccaattcctaaacaccaactttagttgctcttttcagaatattcccccttgtgatattctgggtatgtttgcatagagagcaaagcctttttgagcctaagtttaagcatttgttgtaaacaaactacttggaccacactataaatactgcccaagttctcagctttgacatctgtatgtgtgctttttactgcttccctgatagagggatttatagacagtactgcccacctaagtcaaacagcctgttcccattttctgcctcaaacaaaagcccaacacgtattttttttaaatatgatataaagtaattcaaaaatactttctgaaatacttagaaaatgtgattcacggaagcaatcagcaagaactcttctctcattggaataactataattctgtggccaaaaggtcaaccacatatttacaaatgtccctttttttgtccagacataccaatacctggcagactgtgggacaaagggaaaatgtataaataaatacatctttgtaaactatttcttcccatgactactcaatgatcatggactgggaggtgtttttttttgtttttgttttttaaaatacgtatttttttctccccttggccaacgcattttccctggagatagtccaacaatatagagctaacatacttccactgtggaattcatctggaaaattttgcaacttaagaaaacatctcagccatctgagaggcgtctctatggatctgcagactggagaccaacaacacagtaaatatttttggtctagcacaaaaggagtttggtaatttgtgcaactgagcttatttatttacaataactcactgaagaagctgggacactgttcacatgcatttggtctgggggttaagaatccagagggccaaatatacacagtgcctgagtcagaataggggttcaataaatatttgtggaacaaatgagttttgagtcttatattcattagctgactgttctgatgccagacatttaattcttggaactttaacttccatagttaatgaaatggggtgagaacaagtcaatcctcattactcaggtagttttattctagaaggtaacctcagaaactgagttggcaaatactgagtcattggggaaacacagcgtgaggttcccataagcctctggccacaatattctcaaccaatcaatatataaccttgttttatgtatatttctgtttaaagacaccttatttaatagattctgttggcccggcatggtggttcatgcctgtaatccaagcactttgagagcccgaggcgggaggatgacttgaggccaggagttcaagaccagtctggccaacatggtgaaaccctgtctctactaaaatacaaaaactagcggggcacaatgctgcgcacctgtaatccccactacttgggaggctgaggcaggagagtcgcttgaatccaggaggtagaagttgcagtgagctgagatggcaccactgtactctagccagggcaacagagtgagactcagtcttaaaaaaaaaaaatcactgattgatccatgttgaagttacaaccagcagcattgtaactcatgctttaacagagcttatctggcatatgcactttctcacaaggcacatcacagccttcttgcatttaggagcactagacatgtcagcactgctcttgggggccattttaaaacagtgaaatcaccaccaataacaaaaacacaagacagaactgcacagactgcagaagggtacttgtttactgtatgacagctgacaccagaagatagtcccattctgtgacctcagctgggaacgtgcatagtgggacactcatttttcacagctctggatgtgtccttgaatgaccatgaaagttctgtactgatttggagattacacacatatttcagcaagtacatcaatctgcaaatttacaacgtatattacaaggtggattacattatttgtactctacaaatagagaccagttacactttgtcatttcctaaatattttttcccacctcaatgccagcaccatggtaggaaggtgaccagaacagacaggttccttcctcactgcaataatagcctagaggggggaaattacacaaatagtcatccaaatgtataattacaaaatgtgattactgcatgatgtagaagccacaggaatgcattgaaggaggccataatctaacagcaggttcagggagaccatgagagctaagcccagtcataaagtgcaggcaggagttagccaggtggagaggagggcatgctggcaggcagaatagatgcaaatgctctaaagcgagtttataggtaattcatccaggtaatacataaaaaggtgctttatacattctaaaatcctgtgcaaacataagtttcttggtgtacacctgtagtcccagctacttgagaggcaggaggatgagttcaagcccgacctgggcaaaacatcaagaccctgtctcaaaaaaataaacatatataaggttctatcacaaaggctcactatagcaaaacaaaacctagagaatgactccaagttcaatgtgcttcattttttaaaaaaagtgaaaatacaattcaacaaattactttaacaaagatttactgaatatttcccatgtgctaggcaccaggcttggtgctagggatagggataggaagaaggataagatacttttcttactatcatggagcaattgctgagagaagaagatcctaatgggaagtagattgtgcgcaagctttcataaaagcaatgccagtcagagaggaggtaactagtggtttttctttagagtggttgtgaaaaatgcacaaagcaggtaatatctgagctttagtaatgagggtgtgaacttcctggaatagctggaaggacattccaacagaagagagaacatcaagtcaacatatgtcctgatttgcctgagacagtgccagtgtttgcctattttatcaatgtgattatgaagagtgcccctttcatttttaaaatcatcctgatttggatgacaaattcttcactgatgctgcagagttctgtgaggctgggccttgagagcaaggaggatggaagagatgtagttatggattgatgtcagcgggtagaccaagccaggaggatgtctctgtaagcagagtcaagcagagctgggtacgtttgggggactgtctcaggaagatgactttcagcaacatgagagtcagaaggaagacaattcagaggctgagaccagagggcattattcagggcaagagataagctgagtggcagtagggatgtacaggagttccaattcatgagactgtcatgaggcagaagtgatgggatttggtaatcaattacattatgaaaaggcagggaagaagcagataactcccaagattccagtttgggaggctgggaagttggtgaagtcactaaccaagatcgaaaacacaaaggtggaggaggaacaacagcaggagaaataagttctgcttcaaatgtattgttcatggagcctgcacagcatgttcaggctgcactaacaacataccatgaactgggtaacttataaggaacagaagttgatttctcacagttttgaagactgagaagtctgcgattaggatgccagcatgattgggttctggtgaggaccctctcccaggttgtgggctgctgagttctcgttatatcttcacacggaaggacaaggcagccctataggggcttttataagggcacaaatcccattcattagggctccaccctgatgacctaatcacctcccacagaccccacctaatcccatcaccttagaggttaggtttcaacatgtaagttttggggagacacactcagaccacagcaaaggcctccaaagagagaagcgcagcaggtgactgacatcagagagaaaggacagtccatatgtatgtggcaactgaggataaagtaaatgggaacagaagagattgctatgggagagaaggggcataaacagaggagagacatgctgtgagaatcctgagcatgaccccacctactgcaagacatccacaataaacattcagccctaaatataaacaaagggcctactacacatacacattaagtagcttcaacataaaccctttagtcatgtccactcgtagccctttaaaccaggctgctgccattaagcacctcattctactgaggaactgctgaccctctaccgatctgtctcaggaagatgactttcagcaacatgagagtcagaaggaagacaattcagaggctgagaccagagggcattattcagggcaagagataagctgagtggcagtagggatggctagaagagatccaattcatgcgactgtctcattcatgggcactattaataatcacaattataaaataggcaaatgctggcactgtctcaggcaaatcaggacaatactgaagaggtgagctgagggagaagtaaagttaaagactgatcaacaggcagaggaggatccattcttcactgccctcccctcttaggagttgcattttcttgtgtaagtctggtagcaaaaggcagctttgacttcaaacaggaccctagtgcaattttttcctcattgcttgcatgggaataatcagatacaaggccaaggcagctccaagcgtcagctggcattcttcttagtgcatgtacaacttcctaaaaacctgtgttccctgtcaaccagagtccccccgagacaaaagctcacgcaagaggatgcaggcaaaagtctgtttatgagctaataactgcaacttcaggtgacagagaagattccctgtctcagcatttttatcctgattttactggttatggtacagaaggtgtattgacttcagctctgttcattcgcattaaaggcctccagtgattaacagccaggctagatggttgggaattgtggtagaaggaatccacaggaattttttatcccatttaaaaataagtgttgggtaatcattgttgagtttactaaatgaagcaatttaacgggaaaattcttcagaaagtaggggtacaccacatcattttaaccaccaatttatctggctgttcatattttatagatccaactgcaacatctcactgctcccggaaacaactgggtatgacttcactgcatgtggacaagaggaaaatgtgcttttcttctgaaagcaaagtaaaagcctctaacatcaggaagcactgcactcaacagcagcactgtttacggctccgaggtgatggatgtaccccaggccacgctcttcctgggtaagcatttcccactaaaaagcacactgctcaccaagagcagagcaagtgggtctagtgcgtctgtgtttgctttgcagctattactgtcagctgagaaacttggctttaaccaagcaggaacactgtgtgggccaagttaatttttcagttcacacacatgtatagaatatatcatgtacaaaacactgttgtggacaactctgggaacagggagtgaatgattcagtctacccacggacagattctatatcagtccgttttcatgctgctgataaagacatacccgagactcggcgatttacaaaagaaagaggtttaatggacttacagttccacatggctggggaggcttcataatcacggcaaaaggcgaggaggaacaagtcacgtcttacatagatggcagcaggcaaagagagagtttgtgatagcaagctcctgtttttaaaaccatcagatctcgtgagacttattcattatcatgagaacggcacgggaaaaacccacccctatgattcaattacctcccaccagattcctctcatggcacatgggaattgtgggagttacaattcaagatgagatttgggtggagacacagccaaaccatatcagactccaatcctgtcacagctggcaaaagcactgacacttcaatggcttgtcggtgaaagttccatttttgtgaaaaccaggagcaaatgacattctacataaggatacaggctggcagcataagccagcaactgcaatcacccaggacaaaaggcatcactcagggcctgtggaaactgctgtatcaaccatgtggagagggtttgctgctaccatgaaagtttcagcaaagctacaagacactttttttttgaggtgggggggtgggggcagggaacaacattgtgaatgtatacaaggcacatttttaaagttacaaggagactgggcgtggtggctcatgcctgtaatcccagaacgttgggaggccgaggtggatggatcatgaggtcaggggatcaagaccatcctggctaacatggtgaaaccccatctctactaaaaacacaaaaactagctgggtgtggtggtgcgtgcctgtagtcccagctttccaggagcctgaggcaggaaaatcgcttgaacctgggaggcggaggttgcagtgagcaaagatcgtgccactgcactccagcctgggcaacagagcaagactctgtctcaaaaaataaataaataaagttacaagaggccaggctcagtggttgatgcccataatcccagtgctttgggagcccaaggtgggaggattgcttgaggccaggagtttgagaccagcctgggcaacatagtgaaaccctgtcccgacaaaaaaaaaatagccaggcctggtggcatacgtctatagtcccagctacccaggaagctggggtgggaggatcatttaagcccaggagttcaaggctgccgtgagccatgactgtgccattgcaatccagcctggtgacacagggagaccctgactcaaaaacattaaaaaataaataaataaagttacagggtacatttttctatttcgtaaggattgtacactgcagaaaaattagaaactgcagatgtatttctccagggccaaggaggaaggttttgtgatggagctgtttacaaaggtgtgcacaggggtaagaatgccaacccaggacatgaagcactgaggggctggcaacagcaggaaactgctaccccatcacctgaaggggtaaggggaaagagccggtgcaggaaggcaatgagatgtgaggctaaagtcatgagggacactgacaatgactgtggcccttcctagaagcacgcagccaataccaacccaccgctctggagaaagttgaggaggaaatacaccagcctctctcccctcatcccctgatcagctgctgggtgtgtcactggctgtacccaacagaaagccagatggcactcagttcattccacagagtcagcctacagaactcaggacacaaagcaggacaggaaagaatggggagtgggtgtagagtggcagagaatatgcagcacaagaaacggtaattttccctgttcacctgcaagaaccccactaccagaagacagaaactttgactcatggagtcactgaatatttctgtaaaactggataaaaatttaggtgttacgatggacacagggagaggaacatcacacaccgggacctatcgaggggtggggagctaggggagggatagtattaggagaaatacataaatgtagatgacaggttgatgggtgcagcaaaccaccatgacacgtgtatacctatgtaacaaacctgcacattctgcacatgtatcccagaacttaaagtataatttaaaaaaattggccggacatggtggctcatgtctgtaatcccaacactttgggaggctgaggcgggtggatcacaaggtcaggagttcaagaccagcctggccaagatggtgaaacccagtctctactaaaaatacaaaaattagccgggcatagtggtgggtgcctgtgatcccagctactctggaggctgaagcagagaattcctgttacctgggaggcagaggttgcagtgagctgagatcacaccactgcactccagcctgggcgacaaagcgagactccatctcaaaataataataataataataataattaggtgttacatatatacatgctttataaaaatgaatatatatttcatatgtaatctgctttgttcacataatatatcataagcatattttcatctcagaaaaatattcattgaaatagcttccattctatggacagacccaaaattgtactcttatcattgcacatttaggttttgttcagtttatattaaaaacaaaagtgagattaagcagcctcaaatgatgcctctttgcacatccttaatttccctaggataaatttctagacatggatttctcacatggctaaggctgcctctgtgcaaagttagtttactgggcactttgtaagtgcgatatgtccaacattgtgctggatgatggttttccataagtctttttttttttttttttttttgtgatatggagtcttgctctgtcacccaggctggagtgcagtgatgtgatctcggctcactgcaacctccacctcccagattcaagcaattctcccacctcagcctccagagtagctgggattactgggattacagacacacgccacaacacctggctaatttttgtatttttagtagagagagggttttactatgttggccaggctggtcttgaactcctgtgacctcaagtgatccacccacctcggcctcccaaagtgctgggattacagacataagccaccttgcccggccaacataagtcacttataaagatgaagtattgcctttttagctacacttattttccaatatggtatcaccagtatcctccgccagccttcccctctagctcccataacccctcacagatattgtttataaacattaaaagacttggacaatattcctgaataacaaggctccatgctagctatgccccgctacaggctgatactgcctgtgtctaacctactcccaccagccatctcgttttcctttccctggaaagagggttctgaccaacagctccttggcttcctccttgaatcaataggacatcctggctgtgaccacagcactggaaggtgaggtacagggaatatctgtggctgagaggaaagttggagtcaagagagtcactactggggaacacatggacattgctccttagggcccatgtgcacctacgtggctccaggctgtccctgtggctgcaagaaagctgctttcaagcccaggtctccaggcttagactggaggaacacccgcggtgcccttgtgctctcaacccggacatcatgaagtgctggagatgacttcaggttccctcacatctctccccgaacttccggaggggcactggagttagggtggtacaatgagaagtacctgaacatggggtcaggcccacctttcagctgcaggacctaggatagattaactatatctggcttgcatttccatgggaaataattactaacgccatggggttgttgtgtaaatgtacccagcacagtgtgtagcacagaataggcactcaaaaaaattgcatccatgatgattactgatgctacatttgtctgaatatttggctgctacgaagtaacagtgacttaagatagatgtttttctcgtgtaaacagcacagggctgatgcaatcatggacctctgcttcttgcctttccatcttcaacatgtgcttctattttagttcccatagcatgtctgtttcagaaagcaggagggggtgggggaagggtggaagagaagcatgtgccttattacataagtggcaaaactcagaagtaaaacttctgagtgaaaattataataaaagtgaaaaattataataaaaacttgtggttttcattacaatttttttatcccacaaactaaagaaatggacactcttgcaggaatgatttggggaagaaaagtcaatatataaatggttaactaattcattcctcttcaaggtgggagaaggaataagaaagtgggatggcaaatgtctgagaagaggcgtgggcttaggatcaacaggatgttcctaagggaaggcatgtgagcctggaaacatgaccagcttctttcataatgaggatttgtctcatggtcatgcatgcgtgtgcccagtaataggacggcccattgcttatacaactcctgccatgtaaccacctccatatgaaagtttcaaagtggaccggtctatctcttccttagcaagtgattctatatcttacaccaaggaatccattatcctaaataattttcaatccagccaggtatggtggctcacacctgtaatcccagaactttgggaggccgaggcgggaggatcacctgaggtcaggagtttgagaccagcctggccaacatggtgaaatgctgtctctgccaaaaatacaaaaattagatgggtgtggtggctagcacctgtaatcccagctacttgggtggctgagccaggagaatcacttgagcccgggaggcagaggtttcagtgagcctagatcacaccgctgcactccagcatgggcaaaaagagtgaaactgtctcaaaaaaataataattttcaatcctatcactccatcgtacaaggcattttagaagttcatcaaaatctaaacccatgattgacgttcaaagctatgccacaacttggcctcaagcaaagctcggcaaaggacagttgaatatactttaatgatcatattaagggagacttaagtatcactgggtttggggaaagggaggcagtagctgctgacaggtcctgaacgctaggaaagccatttgagtaccctacaataagaagtgaccagtggtgcccaggtgtggtggctcatacctgtaatcccagcactttgggaggcagccaagactggcagatcacttgaactcaggggtgtgagaccagcctgggcaacagggcaaaaccccatctctacaaaaaagacaaaaattagccaggtatggaggcgtctatagtcccagctgcctgggaggctaaagtgggaagactgcttgaccccaggaggtcgaggctgcagtgagccatgattgtaccattgcattccagcctgggcaacagagtgagaccttgtctcagaaaaaaaaaaaaaaaaagtaagaaaaagaagtaactgacttcttcttcagtcactgacagggaggagacagtcttcagcaagaaaagtgataggacataggtttccttaatggcacttccaaagaccagcaactgtgggatgaacagagctcaataggaagagataaggcaggagggtggtcacttggaacaactgtgttgagtgagggatgaggtgatacaagcctgaatacaagcagtgaagggaaggggaaaggcattctcaaaggctgctattatgtgtcagattagataaaaggatggtgggaaggttaaaaaaaaagggggggggtagtcagtatttactcctagagagcagatttaatgagctagaaaaatgctggctctagtggcaataacaagaaagctggcaggacgctggtttgcagataacatacagatgacaaattcagctaaggcaaagcctgcaaaaccctcaacaggacagaagaaaggatcaaggacttcagccatggacgtggagactgtccattcacatagaattctatgtgcattaacataggtacaatcagagtagaacttggggccacaggctctaaactattatgaaaagggaataaaatataataaaaatgtggctggagtagctgtttggaaaatcatagtatcatgagaccagaagccaagacagaaagaggtcacatgaaggaggatcatgatccatggggtggtgggtggagaccaccagtgcagatgacagtggtagatggtaacttgcctgcagtaagcaacaatcctcccattcctgtgcacaagctgccgctgtcccaaatctagactggctggccctgtcacctgctttgatcaatattatgcaatgaaagcagcctgtgctagttccagttttcagtaatttgggactcaaaagctgcctcagactgcttctgtctctgcacttggaatgcttatacaccataaacagatgccctgcctagactactgattgatgagggaccaagtggagaggtcagctggaagagaactgaagcatttctgctggcatccagcacccagacctcagacacaagagtgaggccctctcagctcctccagtgccagctgaaccactgcagcctgcatcatctggaaccaagccaaaccttctctaatgagccttgcccaaatggcaagcccatacaattgtgagcaagagaataatttttttaggctactaagtgttgcggtggtttgttatgctgcaacagatgaaggatacaagaataaaactgtattttataagtgggaactaaactatgaggatgcaaaggcataagactttggggactgcggtggggggaagggtgggaaggagtgagggataaaagactacaaattggtttcagtgtatattgctcgggtgataggtacatcaagatctcacaaatcaccgctaaagaacttactcatgtaaccaagtaccacctgttccccaaaaacctatggaaataaaaaaaaaatttaagactaagaaataatcaaaagtcagctggaaacatgactccaacatggctccaccgctggtaagttatgggactgtgagaaagttgcttgacaaacctaagccttaatcatctcttctggaacatgaggattaaaaatagtttgttgaggccaggcgtggtggctcatgcctgtaatcccagctctgtgggaggtcaaggagggtgaatgacttgaggtcaggagtttgagaccagcctggccaacacggcataaccctgtctctactaaaaatacaaaaattagctgggtgtggtggcagacacctgtaataccagctacttgggaagctgagacaggagaattgcttgaacccaggatgtggaggttgtagtgagccaagatcccaccactgcactccagcctgggtgacagagtgagactccatctcaaaaaataaacaaaaatggtttgagattgtcaagaagattaaagaaaatacacattgcttaacacagtgcctggaacatagtaagtgctcggcacatacttcttacaatcattgttattaaaaacaaggtcataaatagctcttattattttgacatacattccatcaatacctagtttatggagagttttttaacatgaagcagtgttgaattttattgaaggccttttctgcatctattgagataataatgtggtttttgtcattggttctgttcatgtgatggattacgtttattgatttgcgtatgttgaaccggccttgcatcccagggatgaagccaacttgatcgtggtagataagcttttggatgtgctgctggatttgttttgccagtattttattgaggattttcacatcaacgttcatcagggatactggccttaaattttctttttttgttgtgtctctgccaggttttggtatcaggatgatgctggcctcataaaatgagttagaggggagtccctctttttctattgtttggaacagtttcagaaggaatggtaccagctcctctttgtacctctggtagaattcagctatgaatccgtctggtcccaggctctttttggttggtaggctattaattgctgcctcaatttcagaacttgttatatacccaaaggattataaatcattctactataaagacacatgcacatgtatgtttattgcagcagtattcacaatagcaaagacttggaaccaacccaaatgcccatcaatgacagactggataaagaaaaatgtggcacatatacaccatggaatactgtacacctataaaaaaggatgagttcacgtcctttgtggggacatgaagctggaaaccattctcagcaaactaagacaggaacagaaaaccaaacgcagcatgttctcacttataagtgggagttgaacaatgagaacacatggatacagggagggaaacatcacacactggggcctgtcggtgggtagggggctaggagagggacagcattaggaaaaatacctaacgtagatgacaggttgatggatgcagcaaaccaccatggcacgtatatacctatgtaacaaacctgcatgtcccgcacatgtatcccagaacttaaagtataattttaaaaaatgtgaaaaataaacaaggtcaataagaacatatttgagcacaaccaaaattaatataagttattaagtgtttgtttgacaggatccaggaaaatttagcaagcacaatctcttctgctattacacaatatttgcatttctaagatatcttgtgtaatccacaacttttataaaatataactgctctcatagggaaaaggggtttagggtctataaaatttcaaatttacaatagaagttattttctacaggaatttaataaataacaataacatttagctgtaaaacctaaacaattcctgggcaaatccagcatttaatcatatccagattttgctcaaaagtcttttcttcttctgtttccaccaagactatcactggcactctcctgtaaacatccttatctttatcgaccatggcttttcataaggcacaacattgaaacaggatggataatacaacacccaaagttaagataagttgtagcttggataacagtattgaagaaagtaacctagtcagctgcccaaagtgtcactagtagcttttgttcctatgagcagttctagtgcccaatgacagaagcctcactgccaatggtgttctctagtaatgtgcattatgcccagtttgtagcacaaaaactgattcggcaggaatttctgcattgtgtaccaaccatggtactaaatagttctataatcatctataatattggtatgattggtatggtcaataattggttgcagactgagcactatatggggaaaaccaagcaacaataactaaaacctacagcaactttacatctctctcccccacacatgggactactgaattaaaatgaaattttctgctcctctgagcagcttccctctaagtggacagctcccgtgttaaaagacttttctacaaagccaaggaagataagcttcctccatctctcaactccattcttttgataatccccagtgattgtgaacgtacaagcattactgagttaaaggaaaacccccacaacattcaggagatgaggaaaacatgcatcagagagcagagaaggttggcccagagtttagaaacagttatcaaatacaaaaattaggaagacattctcaaaatactttctgagagtctagtcccttttacactagagggtgctgctagaggaggtatacatcagacctagtgatgggatggaaggaatctaacagtaatgtctggaagaaaagaggcaaggtctctaagatgttcaacagaggcaaacaaaagtaaatggtgcaatgttaaaaatcagtatttggttaggacaaataaaggacctacagttaataaaagccaaaaactacatccccccgccctaccttcataggccatctccagaagcaaacagtggcaaaaacagcaagaactataatccagcacagatagcccagatgtcatcttatagcccccgtaaattagctttgaccaaactgtacttaggacagcagtggtctatacttgaaggtcaccagaggaacaattcctagcaagttcaccgtgtctattataggaatgatcttcatcacgttatatactgttctttttgcaggaatgcttggaaaaagcttctctttggtcttaataaggaacagtctttgttctcttgggcactgttgttttcgccacatggacttggataactttctcaccggatgctagaaagctgagcagcaagtgcccacccatggcaagtctatggctctttatgttgtaggctcttagcctcaatgccagctctatttcatatgtctcctgccctgtttatctttttccttttctctttcaatttatgctatcttcttatatataactgccttatatatggaataaaactaagtataaattaaatcaaataaacatgcctctatttcagaggacagtcttaccatacagtaatatgtattcattctttcacaaatatgtattctgcaacatcaggaaccgtactggacacggggcatacaaaaatgagacagatcagcccctgctctgacatctagtcaggaaaagacacaataaataaagtacaagcaattttaagtactacaacaaagacaaaaacctgaaatggacaaccacagatagggatggagggaagtgtcagtggtggagtttgggagacctcttactgaggatgtgacatcataattaaattcagaaggattaggaaccagaattaggatttaagtggggggaagaccttttatccaggtacagggaatagaacaggtaatagcctgagacaggaaagagtcttaaagaaatgaaacgactgagctcaactgagggaggatagtgtaggatgaaggtggagaggaagacaggggccgggcctcacagcccagggtaaggaatatggattttgtttccagagtgatgagatgccatagaaggattttaagcctgggtattttaaggttcaggatcataccttctgctacatgggaatagattgcaagaagttaagacaggaagcaaagaacagttgcaatattccaggccaaagatgacagtggcctggaccaggatgatgtcgtggagagagatagcccaaaaagtcccaaactggatacatttgataaaagatttgatgcaaaggaaatgtgaaatggaataatctaaaattgcttctgaatttgtatctggagcaactatccaggcattcagaccacaagctagagctgcagactgtgctgtgagtgggggctggtcgggggtagaaatcaccatctctacttggacctgtcgtctttgaaatttcttgaagacatccaagcaaagatcaagtaggcaactggatatgtgaattgctgaggctcaaaagatacatttcccaagatcctttctcaggaaagaactagtctatacacgccaccaaaataaaggaataaatcaggaaagaggaaaaatgtgagatccaggaaacccagaattcaacacagagaaagataaattttccaggatactcaggaggcaggaggatcacttgaacccaggagttgagtctttttaaaagattatctctttaaaaaaaaaaaattccccaggatgacagagtgaaggtgagaaaccaactggattagtgcaggcctcaatgctctgggccaaatgtaaggttgaaatgacagaacatctaatgagtttgaatatattgagagaaacttcatacaaaagggagtgagtggggatggcttttgattatatatgtacaaaaaaattaagttcttaactacaggaaaggtaagatacagtaaaagaaaggaaaagcaatcctagtatacacaaccgggcttagagtcaatagcatttccacagtcattacatcaacactgaaaactgacctatcccaaacggcaacacaaccataccgggggatgcaaagatgggaagtaagcgtgtgcgatggttgtaagcgggtgcggtagtcgtaagcatgtacaatgctgataagtgtgtgcaacagttgatagctgaattttctcctaccatagaaggaggggggaggactcaaaaactgaaaaagttaaaacataagtttcttacagcgatggaggcaaaaaccaaaagaataagccagaaagttagaaagcagttgctgtggtgaggacagaaggaccaggggggtgttgagggcacaaagtcttcccggctgtgggattgtttgattctaactgctgcaatttaaataatattttatactaaacatttaagacattaaaaatgctgagtaaatcattgatttgactctgaataggtaaaatgttgaaaatgtccatgaagactagatatcagaatattaagaacagacagactatgactagatacctttcccttcagaatattcgttgccttttatatttaaaaaattatatgtattttgagatggagtctcactctgttgcccaggctggagtgcagtggtgtgatctccgctcagtgcaacctctgcctcccaggttcaagcgattctcctgcctcagcctcctgagtaacagggattacaggtgcccaccaccacactcagctaacttttgaacttttaatagagacggggtttcgccatgttggccaggctggtctcaaattcccgacctcaagtgatccacccactttgatctcccaaagtgctgaggttacaggcatgaaccactgcaccaggcccacatttttatattagagaagctaatgtatcgagtgttgactaatccaattttgctacaaaaaaaatagtcaaagtaaaggcctgttcatttgggtttaaaagggctctaaacataaaagtaaaatacaaatatacatataaaaataaataaaatgttagcttccctttagaaggtaaattttcatctgataagaatacaccatgttcatactacagtattatctttggagtcaaatgcatgaactgcctttgaggtgaagtaatttttatttaagtgtttctgaatccaaagcagttcaggtggcttccccatacagtgatctgctctaccacaaacagcgtcacaactcaccattctagtggacaggacagtatttctattctagaaacttgcccagaattaacacatctgttaaaatttaaatatcgctcactagtgataatggaagtaccatccactaatgacttaagagaaattactccacaaaacaaatctattttatccaaggaaaaaaaatgtttaatatttatattgagttgtttttctgtgtgataatgacaattccggtaacatatgaacaccctacattttagagatgaatgctgacatatgtagtggtaagagacatgtctggaatttgctttataatactttagcagggagtaagagggacagatgaaacaaacatagcagaattttcgtatgagcatatgactctccattggcatatctgaaaactgttcataattataagctacattctgagagaaaaacattcagcttttcaccctcaaaataaacttgaatcttttaatgatgataatgctgtgggtccccaaaatctaagacaggtctcagttaatttagaaagtttattttgctaaggttgaggatgcgcgtccatgacacagcctcaggaggtcctgactacatgtgcctaaggtggccagagtgcactttggttttagggagacatgagacatcaaccgacatatgtaagatgaacattggttcagtctagaaaggcgggacaacttgaggcggggacggagcttccaggttgtaggtaggtaagagacatggttacattccaaaggaggcaatcaaggccgggcacagttgttcatgcctgtaatcccagcactttgggaggccgaggcaggtaaatcacctgaggtcaggacgagaccaactcggacaacatggtgaaaccccgtctctactaaaaatacaaaaatcagccgggcatggtggcgcatgcctgtaatcccagctactcgggagactgaagcaggagagtcacttgagctcaggaggaagagattgcagtgagcagagactgcgcccctgcactccagcctgggcgacagagtgagaccccttttcaaaaaagaaaaaaaaaaagacacacaacaaaggagccgatcagatacgcacttatctcagggagcagaggggtgactttgaatagaatgggaggcaagctggccctaagcagtttccagtttgacttttccctttagtttagcgatttggggggcccaagatattttcctttgacaacgcatgtaaagaacacctaaaggccaggcgcggtggtttgcatgtaatcccagcactttgggaggctgaggcgggaggatcacgaggtcaggagatcaagaccatgctggctaacatggtgaaaccctgtctctactaaaaacacaaaaaattagccgggcgtggtggcgggcgcctgtagtcccagctactggggaggctgaggcaggagaatggcgtgaacccgggaggcggaggttgcagtgagccgagattgctgccactgcactccagcctgggagacagagcgagactccatctcaaaaaaaaaagaaaaaacaaaacaaaacaaaacaaaacaaaaatgaagaaacaacagctgcagtggagattccctttcatccatcaggttacaaacccagccttaactacattccttccaaaggagcgtaggttaaaatgcagattagacagattaacttgcaagcaggagaaagaaggaatcaaacttcaaaccagcggcctgttgatctcatgctaaactcaagtgatacctttttattaagctgagactgcctaaatatggaaaggatgttaataaatacaaaaacctgataattatctgggttattcaagagaagcctcatccttttaggaaggtaatttggctgagaaaaaaaaaaaaaaaaaggaaagctgtttggtatctttttaaacatatatagctaagttgcatagctgtcttgtgtcaccatttccctcggaatctttaaacagagccaaatatggaaccagaacccggagcagcagaacgatgaaaatggcagcaaggccacagccagcaaatttgcacatgaagtctttacgagggcccttagagacactgagcagaggctctttggtccataaaataagtacattcagaaggagacacgtgttgaaaaataagtctgtaatagaaaccttagtaaatataagaaacatactaagtccagtatgttaagataaaagatgtgtaagaaattttatgagaaagctgatctgatgtccccttttcttcccactttattagcaggagtctgcccaaaggcaactcaatttctcctttttaggaagggagtgggtgccgtgggactacagctctccatgaagcgaggaagctgatacttcaccctgtgttctgctatcctatggcacagcacatgttcaaagcaagcagtgaaatgcgagccagccagtggccagccagggcccttaacactttgatgggctcctgcacttacccagcatgagcttgcagcagatagcagcccactttaaagcatagacctggggagtaaaaagactttttcctttttaataattggggaagaaaccattaaagccattcaagagattaaatccacagtgcaaagatggctatcatgtttgtaaggctgattagagataagtactgcagagtctccctcagtcgagatgatcacccttgtgttaagcaaatcccctgggctgtaaactaaatgcgcttctgtttactctgctctctgtgaaggtgggagtggtccctgtcagacggtcagacctggaaggaactcaagcaaagccccatcccctcctctgaggttcggcgagagccagagggtttctggaggaccctgcagtggaaggtagggagagggtaggtcattaaaaaccatgtctcccagaccgggcgcgttggctcatgcctgtaatcccagcactttgggaggccaaggtgggcagatcatgaggtctagaaatcgagaccatcctggccaacatggtgaaaccctgtctctactaaaaatacaaatattagctgagagtggtggcatgcacctgtagtcccagctactggggaggctgaggcaggagaattgcttgaacccaggaggcggaggaggttgcagtgagctgagatcatgccactgcactccagcctggcgacagagcaagacaccatctaagaaaagagaccatgtctcccaagttccagaaccacgtgctatctggttatattagatcttctgattcattttgataaaacttaagatgctaatttcaagtatatcaagattaaaatctgactatactgaaacagagacccccccctttagcatctgctacatttccttagagaactctccagtgaacagatgaattatgatgcctccatacaattaaatgccatgctgtgaaataccatgctgtaaaatggcttagcaccctatttaaccaggagtaagtattccttagctattaactgaaaaaaagcaattgtagaataaacccatttctgtaagtggtaggtctaaggatatcttagcatatgcatagaaagattaggaaaagtaaactccaaccctttgatcgtctttaccctgaaagggtgaaattggatgaccctcagttctaacttgcacattgctatggtgtaaaacacgcagagtaaatattgccatgatcataaacaaggtaaataaagtcttaaaaagagaatgtccaaaacagagttctttcttcttgtgcccccccttccctgtaggaactacagagtggagctttcctttgtaaagaaattatcaaataatccctctgtcttcttttttccaaacctaacaatctccattcccttgggtaggtcagctgggatggtagaaaaagtgatatatattttcatatactttcctagaagaataaaagtgctttcccctcatcatgaaggcagtttcttttgggatccaaacccctgaatattagaaccctaaagagtgtgagtgaaactctcacctgttcaaggcataaggatttagatatgctcctagtgctctgagcttcacaagacaaacgcagacatcacctcaatgacacacacaggagcatgtgtcaaacgtgttaggaaaatccaatagtgggtcaatctgtgctagcaaatgaacacaactcctaagatcacacaagtcatacatttaaaaggctgaacagtgggaatttttctttttttaaaaagacagttggccaggcggggtggctcacgcctgtaatcccagcactgtgggaggctgaggcaggcggatcacctgaggtcaggagtttgagaccagcctggccaacatggcaaaactgcatttccactaaaaatacaaaaaaattagccaggagtggtggcgcacgcctgtaatcccagctactcaggaggctgaggcaggagaattgcttgaacccaggaggtggagattgctgtgagccaagattgcatcactgtactccagcctgggtgacagagtgagactccatctcaaaaaaagagaggaaagaaaggaaaaagaaaggaaagaaagcaagccaaggaaggattcactgaagaggcaggacctggagatgccgcctgagtaaacaaagccagatggccaagggctgcaagctggggtgtccctgctggagcatcccagtcagtacacatgagctcccacctcaccccctacatcagtgaccaccaagacatggtcccggctgtgccaagacctcaaacccctcccttccctaggacagcagggtagcagctggaccaccagaactcccagggccagttgtcttcagcctagagcaccctttttcattgaccttaatgtggtctctgctgattataatttacctatattttatggcctgaaaatatgcttctaaacactgagggtttctggaaattgactcacaaagcagtgggggtggtggagatgctgagtaactgtcaggagtccactcagatcctctcatgccttatcattaaatctcctttcctacactttgggaggccaaggcaagcagatcacctgaggccaggagttcaagaccagcctggccaacatggcgaaaccctgtctctacaaaaaatacaaaaattggcctggcgtggtggcaagcacctgtagtgccagctactcagaaggctgaggcacaagaatcgcttgaacctgggaggcagaggttgcagtgagctaagatcgtgccacagcactccagcctgggtgatagagtgggactctgtctcaaaaaaaaaaattctccattactataatatcctcagtaataggttgccacgctcaaactagcaagctctgaaatgtattaaactcaggtcacttatgaaccactttgtgttttgccagcctcaaattcagagattcttcattaagagcctcggggtacctctatacacaaaatgcagttgcatttccttttatttcttgctttataatcatttccatttctatgatttagtcagcataattgctgttgtaacactcaaaaagacaattacatatacaaactatgcattatagacagacatatttggagactgcctggtttaaggtcatgtagtaaatacagagcttgagttataactatctggtcaaaccacagaaagcattatgttgtgatgcatacagttaactcaagcccgtaagaagccttttgttttctggggtggagggtgaggggttgagaaattctttcagttatcaggaggactggagagtaaaggcgtacagatgggatgggaggagaatcttggacagcatgtagatgtcccatcataccatgtaaaaaaaaatgtgtttgatactcacaaggaaagaaaaacacagcttgacactgaaaagctttcatttataatatactgagccatgtttatatcttgggagaagattcatgcagtgcagcaacaaagcaaaatatattttttttaatgcaccaaaggtcattgagtagctttagacaccaagctgagagcctacaatacaaaataaagagtgatggaatttgcaccctgagatttggaatggctcagcttaagaaaccaagaactcatgaggagtgtcctatccttgatccattctcctattagtccctccatcacttccctgacaccctcaaaccaccccacacagaatggaaagggtctaacaaatgaaggattggagacaccaggcacagtgactgtcaccaagggaccactgagggacctggacctgcagcaattgcaaaggacacaagagaccctggcttagtggccatggaataaacaaagaccatttacccagcttctgacaaagaaccaggctgctcacaaccttatgctttctcctcaagtttaagtcagaggttttcagcatactggaatcacatgaggagctttagaaattcctggtgcctggcaaccacctccagagtttctggcatgactttggtgtgaaaggtggcaagccaaggtatgtggagcagcctgaatgctgggaattttaaaaacctcctcggatgatttctatgcgcagtcaaggctgagaatcactgcctagcaccttgccaggaagaagtaaacaacagaacattctgttgttatagtgatatagtgacgattaggaccgtgcttctcaacacttgatgtgcataggaagcacctagtgaccttgtcagaatgcaaattgtgattgggtaggtctgggatgaagcctgggcacctgcatttttaacagtgatgtcttgctgtgaacagaatagtttctaatctccccaaatttggcaccatcctggagagaggctctgcagaaatgaaagttacatgtaacatcatagtaaagcttaatccctgttattttagataaagcttaatctccattattcttcaatgatgaacagaatttcatttcattggataactcaggacattgtggacagtgatatccatggaaagcaaggtatgtatgaccatgtgtcccctttattaagtggcatcagtgtgtgctgggtttttggggtcagtgggaatgatttttgtgactacttttgaggacttgtccaacttttgtttttaaccactgggatgaatgtcactgtttccagcagtcctcccttcctttaagtgcctcttttcaatttgcagttggcagaaaagcaaggtaaccacaattgtcaggccatcaaaagcccagtggttgagaagaacacaggctccagagtcagactgcctggctttgaagcccagccctgccatgcacctgcgtgtgaccttgacactatgtaagagcttgcatatatataaagacaagctagaacagcttctgacagtgagtcctcacacacagggcaatctgaggcactcatcagacagtacttgatgcttttgtatatccatctttggttcctcacctcaaagccttttgtgatacctattttttgtgatgttttctttgtaatatccattttggattcaaagctccctttatcatcatccctttccttccccacttcctcctttttcagctgtgtttcagatataagttgttgccaatcatatacagtatctccctccctatgtccacccaactaggccagtgtgatctgcagaaaaccaacaataccaaaaccaattttacagaatttttaaaacccttcaaactttctcagagataaaagcctgttgatattacattgtaagtttttctaatcattcagatttggccagaactacactccagtgcatttttgtttgggggcaaccttgcctctaaagggcattatcgtctgctctcatacaacctgcagttggttcaacaagtctgtggtctaagtgggttcccaggaaggcacctcagctctaccatgcaatttcacaccacaaaaaaattgagccatttctttgtgggaaaattccaaaatgaagcaaggacacattatcaagagcaatccaaatgaaagctaagaggtcacagtcacagaaaaagccacagtgtggtctgtgctggcttacagatgccctccaatcttcgaggaaatagcgctagacaaaagaagagggttacaaagcttacatttgtctatctatgcacctttctaagtttagcctacttaagttaaaatggacatgttaaaggtcatgaacgtccacataacgttaaattttttcacaacttcatctccgtaggatcctatttctgaacagatctgtgcctgtgtttttttctctacaccacatcattcctttaccttcctattacatcaaatgatgaattccagtttcctaacttttcccttcctttgccaaaataccattatcagactttgtttctctcacttcagaatatttcttttagactgttctctccttctccactactgttttccacagtcattgttaaagccatcactatttaggagtctccatgagctttgtggaacaaaacagctggtgttaaaaggaagttcaaaaattcataagtttaggctgggttcaagtggctcacacctgtaatcccagtactttgggaggccgagatgggtggatcacctgaggagctcaagaccagcctggccaacatggcaaaaccccatctctactaaaaatacaaaaaaattagctgggcgtggtggcacatgcttatagtcccagctactctagaggctgaggcaggagaatcccttgaaccccagagttggaggttgcagtgagctgagattgcaccactgccctccagcttgggcaacagagattccatttgaaaaaaaagaaattcttaagtttaatcactgatatattctgcatagggtacctgtatagtgttataatatatttttagccatacatggaaaaatataaagttataactgattccgaataccttcaatgaaaatggctttttttccctcgatgggtattcctccaaatatatgctatcatttgatctttgaatgtaaaaatttttctactatactaattcaaaactaacatttcggctaggtgcggtggctcatgcctataatcccaacactttaggaggctgaggagttcaagaccagcctggacaacgtagcaagaatccatctctacaaaaaattaaattagtcaggcatggtggtgggctcatgtagtcccagctactcaggaggatgaagcaggaggatagcttcagcctgggagattgaggctgcagtgagatatgattgcaccactgtactgcagtctaggcaacagagtgagaccatgtctcaaaaaacaaaaacaaaaaacaaaccctaacatgttgaaatgtatggagaggtggctttcagcctacaaagcgtgtgataattgatatgcaaatcaatgaggtaaggtagcaaaccaaggtaacactcaagggttattctattggcacaggaaggcttgtcatggaaagccatagaaaggcagcaggaagtgagtgctcaatcaactccttgcaataaagtcagcttcttagaaactggcagattatgctcatttcgagtatcacttaggaatgatgacttgaaagaagttccagctcaacaaaaactatgattcctggagatcagaaaaccaagtgacaactaaagatgcttggccaagaaatccaaacactgtaatataaataaggtgatacacaggtaagtgacccaaagatgaagatgagtaagtgaccgtcccaaggtcaccttgagaattcagacatgtggatgaggtgttatagatggaaagccccaatcctggtgtttgtattaaagtggatctacaggagtcaagttttcttttgtaaggggctaggcagtaaatatctgggactttgggggccaaattgggattctgtgtgttcttttgcaatgctttcaagacaaaaactactcaaactattagtagtacaagaacaagccatgggccctagtttgccaatccctgctctctaccaaactcccaggattagacgctacctgttgagagcccccctgtatctcccaccagttctgtttacatagcctcctgtgggacagcccacggggctgacatccgtccctgtcattcccagagggccaaggatgagaagcttcactccagatgaggcaaatagaatgtcccacaggagtggccaagaaggaaaggtctagaacggatgtggtcccagtttctgaagtcctcaaggtcatggtaagatgaactagttctaccacaaccaataaggtggcaacatattcatccaagctttcacattggctcttggcacacatggatcataccttaaagctagaaagatgcgacattttgcttaatgaggattaagtgtgtaggcatcactaccaccccattctctacaggtgtttcaagctggaaactaactgttcaagaagtgtcacatacttatatgatgacagatctataatgcattatgtggagagtcaagcaatgttggaggggcatgccttctttaaaactctgcttacagtcactgtcggaaaacatgatgctggcctaggtgaactgggcttggggtatttgtccctagtggggcaactctgatgctgctatccacatcacaggtcacatgagaaaataacacctcctctttgtaatgctttcacattgcaataattcttggaagaaacttgcggtacatgctaagttcttgctagcgcctctgcagaaaaccttctgttaccaccatccctgggttttcctgactctgcttgaagctgtgggatttctgttgctgaaaggacacagctgggctaccggcaattaagatcttaacctccaaagtgtgacattaatcaaatgtatgtccaaaacaagtatcttaaaaaggtcccaaaggaaatctttgggtcaaaattcctttactgaaagataaagggaattaaaattccttgaggacagaggatttttgttgttgttgggggtttgtccaattttcagatatattctaaatgtctagaacagtgcctggcagattgtaagtacccaacaagtattcgttgactaagtaaatgaagcttgttcataagattaaaattagtcaatagctaattaaaacactatttaaaatgagtcaatagcttcgcagaaaaaaaggacctcacttggcagaagaggaactgcagatgttatagctgtttactttttcatcccgcaaataaaagcaataatctaaaacagaatgtgatctttgttctctagatactcaacaatgccttaaatgccagcagaccctctaaactcacaaaaggagctccggtcctgctgagcaggagaacagcagggtttgggaaagctgctgattgaaatgcaagccttctcctgagaagatagaatatctagaatcaagaaagaggcatttggcttttccgggtgcacccaccccagcttcacttacaaaggatgaagttaaccataggaagttgggcagcaaccagagtagcaactggatctgatctcaaaggacacaccagtgaaagagcagccttttgtggttactgagttaaaattgtttccaattactccgtattgtttctctgagagtgagtgagaagtgatacagaaccttccctccctcgaacacctgttcttgtgggaaggcgggggaccccctttaaaaccttgatcctctactccaaagccagtgtctgtggcacaattaaacacacaggcaggaacccacatgtcctcttcaggtgttatttaagatggcaagttcaaggagttagctatagctgccagaatctagcacctgttacacattagcaattaaagttaagcggatctaacttggaaccaatgaaaataatggcagcttctcagaggtccagttaatctctggtttttagaagagtcttcctagctcagattttaaataaagcacatttggatagcaagagaagttcctgaagacctaacagatttcagttaaatcttattgtttacttttaacatagtcattctgtcattcagcaaatatgtattgaacaacctctctgtccaggcatggagctagcctctgaggatatagtcatgaatgaggacagatggctcatgctctcagagggttgacagcccatgctagagatggcctaacacaggagaggagaagctgccttcagcatgcaaggtgtgtcattcaggtcattctgcacaaaaccacctccaactagcccctgctctcttcttcacaagattttttgtttgtttgtttgtttttgttagatggagtctcgctctgttgcccaggctggagtgcagtggcgtgatcttggctcaccacaacctccgcctcccaggttcaagtgactctcctgcctcagcctcctgaatagctgagactataggcgtgtgccaccatgcccagctaatttttgtacttttagtagagacggggtttcaccatgttggccaggctggtctcaaactcctgacctcgtgatctgcctgccttggcctcccaaagtgctgggattacaggcgtgagccaccgcgcccagctagagttcttcacaactttcattttgtttcctccctgaactacatgccctgaatgagccaagtcttcacagagctgccctcagtacccggcctcagctatgccagccacaggacagggaaacaagcagaggagagagaaatcagaatgggcctggggctaaggatctgatttctagtcttccttctgccagtaagacccttcataatcctggggaagggatgaaagtggtgtaacttcaagttctagttcaggctatgccttccactggctcttatggtcatgagtagagtagcttgttagtcagggaggtagcaggaaacaaagatactctaatttccccagggcactaggtttctgggctctcctacatttgaaaatagcatctgcaaacgagtgatgtttctggctgtggtctcaaattgctctttcaaaaagatgaagttcatacgactcacaaaattcaacaaacatccattgagcatctaaaacattcaacatgcagacttggcaagatgtagtgatgacgatgggaggtattactaacatagcacttcctatgtgtcgtgaatttttcaaagcattttacatgtattaaggcacaatcctcacagcagccctatagtttaagtaccaattggatgctcattttacagatgagaaaattaaagcacagatattaaaactgctcaaggtcacaaaaccaccaagtagtagagctgggattcacactggagcaaagagtttatattattttatatgtgttttgacattatcgaagcccactcccccgccatgggaacttggtgacttgccagagaagtgcattatacagtctttcctcaaatgtgtccttacctagagcccaatgctatcaatctggtagtactattctaattaaaaggaccttgctcttcaaagcactccaagtaaacacatttgcaaaaacatcacattaattttcacattctcacaagacttggcaacacagttgtattatctcaaagaaaagtgggtgttttacatcccccatgtcactatttcccatgggaacattgagctgccctaagcaagaacactgcctcatgagacagcacgggctggacagatgaataccggcagggcagagaggcacctggggcatccctaccacttagcctccacgtggagttccatgaaccccaaagccaaaatcacagcgagtttttaaaaagcatttaacacacagttaaaagaaccactttgtcaagccaaagcacacacacacacacacacacacacacacacacacacacacacacacaaacaaaaaacgcaaagccaaacctatctcatcttgttttctgtggtgaaggtgatggcagtcagttggagcgagcataccctaaagctctacaatgtggccaaggactttgactgtacattgttcttttttttaaataatcattccaaatattgcgagatgcattgttgcaggaagtcccttgccctcctaaatgccaccctacttctaagaagaatggctcagtcctctctggagtccacacaggggaggtgatagcattagcattgctttcatgtaaattatgtaatgcaaaattttttaaatcttctccttaaaactttgtttcatttgtgaccagctttcatggtcccccttttttgtcccccaacttgagatgtgtgaaggcttttggtctccctgagagtgggtggaggcagccagggcttaactgtacaccaacttgagaccagttgacaaaaagtgaacactttaaaaaagggggaaaaaaagaaccactttgaagaacatggttaaatcttcttttgcccaaaagccatttctagctgcttgtctctcttccccatcactaatacagcatatgaactacatgactttgaactcaatcatacaccattgcttattgctcacagtttcaaagtcctggatataaaatcaagtctgcaaactgagaccagagattgtattttatcgttttatactcaaacattttctaggacttttctgagctcgtaatagatgcacaatagattcttaattaagaagtcaagggttgattaggatgtttattccacagcctcagtgaaaattgttttattagtgtttcctacacacgagaatatttcttgttaaaggaaagccttttttttttttttttttttttttttgagacagagtcttgctctgtcaccagactggaatgcagtggcgagatctcagctcactgcaacctccgcctcctggtttcaaactattctcctgcctcagcctcccaagtagatggtactacaggtgtgtgccaccacaccatgctaatttttgtatttttagtagagacggggttttatcatgttggccagaatggtctcgatctcttgacctcatgacccacccacctccgcctcccaaagtgctgggattacaggcatgagccaccgcacccggcctagtaacttttttaaagtcatttttaaacacacttcaagttcagaagtggcttccagagttccttcacttgtgctgaaaaccattcaccaacagccacctggtaaagagaattctatacagtcaaagaacattccatcatcagtaatgctgtattacttacagctcaattcaaagtaacctttaaagactggcttcctggaatgctggttctttatctcactttagtttaacctttagtttagtgaggtaggagagctaactgtttggtcaactgaaaggcctccatgctcctttaaggatctgtctaaataggtctgcatgcgtcctggggatgaggacactggtttcttacagcagtgcttcaagattttatgcatctctcattaagacagattctgatttaagagatctgggggcagaggcccaggattccaacaagctcccaaaatcatgctgtgcggctggtttccagatgatacttgaggtagtgagggtataaagggctaggacaatcaagtcacaaactaaggaaaataatatcctctattcttgggattcaagaagagtagattatagaaacaggataagaccaacggaatacagagaactctcgacttccatagagaaaatagatctaaaaacaaaatctaagatcttttcatatacacaaggatcaacaccactttcaagctgaaagcatcgtttcccattcctttaaacaaagttctttattctccttgatataaaatgtcatttttgcgagatctcatagcaatttgagtagctattagtgaaaacacatgccaaggtgctgctagtgtctcctgttcaaagagtataaaagaaacaccacactgctttaagaagtctggaaaagatgacagtaatggcattaacaaacaatcaggcaccaaatggtttctgaaaatctaacatgcattctgtaactgtcactgatttatgtgaagtccgaccttcagggactgaaaaaatgagcaaaccatctcagagacatttcccatgttaaattcgaggctttatactgtgctgataggaaaacaatgtgtcctaagaaacactgtggtcgtgtggatgaaagacacggctggaaccaggcaagcaatcctgctgccagcaccaccaggtcacttcaccagctcggtgaccttgctcacccagttagcctctttaagtcttaacctgccaattgaacatactcctttctcctctactacctctctcattttgttcagcattcaccccccgcacacgccaagagaaaggagcctttcctaagcccaaggagtgacttgatttgcctgattattgtcccttcactgccaacaacagatttaagagcagaagtacgcgatgtaactgatggtgcttttgcacccataaactgacagccgtggaaccacttggtctgaacctttgggtatatgaaatgctctcacctgcaagaaacgctatgattgattcacaggctacaaccttataaggaataaaacattgttttctttcaagttcgtttctagggactgctgcgttaccttgtactactcagtatttatcctggcaacccgaacagagcatgtgagtctccagagacagtcaggtgtgggcatatgatcacattaccttgtacagcgcctctaaaacgcagatatccaataaacgtttatgggtgcatgttcccctatccagtgagagcactggaacagaaccaagaattcaatggtgaaaaacctaaatcaaccctcatctccaaaaggctgcaagcagaacagtggttctctcctttcagagacaagaaccacctggggaacattttataactaccgattccctagccccatccacgcttagttttaacaagcacccgggtcactcatttaacaaatacccaggtgaatctgtggcccacatttttagaaagacttttttcctctgccccaacaatctttttgttttcactcaacacaaccactcacaatcctccccctacttttttgtccagaggccgtgacagccacactctgccccaacagaaggtcagaagacagacaagtgccaagaattgccttgttgacgctgtactttcaaaacaaaacacaaatacgaaagcagccacccgtgtttgctatgccccactgtttacacccaaaatccaatccaatctccttcacagacttccacacaagtatttcagggagcggcaaccatcctcaggatctcagggcacacaccctagacgcaaagtcagttgctcagtgttgctctgactccgatccaaccaaccctcaaagattcgcaccgcgcggcacgcacccagcaggttccagcgtaaaagctgctccggtcccaagcgcgtctccaaacccctcctttacagcgccgcctccccagccagccccggtgcgcagtggcgaacagcccgcagagcccccaggcttacctgtagcatgtggtgagctcgcctgaagacttcagacacgggtatttagtcgtcgcgattttgctctctgagcagatttctctatgaaaaagtgcagaggaaatgttcgattctcagcgggagagcggaggcgggcagcgcgcgctggggaatccctggcgcgtggggatcgccaggctccccgtcccggcgctctgggcaggggctggtccccaaacgcgtacgcggggcagactccggccacagggacgagccacgcgagggtcacgacgaagcgaaccagctccaggagaaaggaagcggggttcacgagctgtgccagccagtgtggcacccggggggaggcaggaacgcggggcgaagggtatccctgacgcgacccacggatggcagggcgcaaaggctgatacccgggagcggagggaagtgtcgcccaggacagctgagcactctccttatccccggagaagtgagggcgtgcggatcgctgtgggagtgggcgccggggaggaccgcccgcaccccgcgagccgggcgcgcatcaagcaggagctcgccctccgctggggcttgcagcgcttacctgtcgccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccg

SEQ ID NO: 2387 - DNA, 15061 bp, Homo sapiens
  source 1..15061: mol_type = genomic DNA
ctcacatccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacgtaaggacagagcccccgcccacccccgaagcccacatccgggactctaaagcccaggaccccgtttcccgggaaccttaaaacccgggatcctgacattcagggctccaactccaggatcctaagaccctcacccccttacacacacacacacacacacacacacacacacgcacacacacacacgcacacacacaccgccctccctgacaccgacatcagaggcctcccaaatcctttaaccatgatatttggtacacccaaagctctgggacccagacaccttgagacgttacaaccttgaaacctcaagacccggaaccctgtaatctggggaatcttaacatcagttccctgagaccctgttatctggagaccctaagacacctgtgccctaagaaccagggagcgtaaaaccccaggaccctggcactcggggactccaaaaaatccctggaccagatacttgggatccttcaaactccagttccccaaacacctggggcttaaaaaaacccaggattctttttttttttttccttttccgagatggagtctcgctctgtcgcctaggctggagtgcagtggggtgatctcagctcactgcagcctccgcctcccaggttcaagtgattctcctgcctcagcctcccaagtagctggtattacagccgtgcgccaccttgcccggctaatttttgtatttttagcagagacagggtttcaccatgttggtcaggctggtctccaactcctgacctcaagtgatctgcccgcctccgcctcccaaagtgctgggattacaggtgtgagccaccacgcccagccaaaaaaacccagaattctaaaatctgacatcagcatttggtcaccctgacgcacgaagactcctccgttcagaggccctaaaaacccaggatgccaacatctagggagtctgatttttgtattgcttgaaactaggtggtcttgatattcagggatcttgatacccagggaccctgacatttggaacttctgaaaacagcagcctcctaaaatctagtcttctcaaaactctagcagctcaatatgtatgcaaagaacatactatctgggaaccaagaaacccagagattgtgccacctggaccctttcaccttcccagactcccaaattttgatatttttctaaactgagttctcttccacccaccattctcctactccaagatcttaggacttgaggatttccctagttcctggttttccaaatggaagtcacagtcaccaacatccaggatctgtctgaactgtaggcatcctccctgccccgaccctggtactagtgtttccaaaaggctgcagggctcagcctgatccctgttgcctgactattcctgtgatcaagctggtccccttcttcagggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggtgagtggccctcctcctaatgcacacatcctctttcttcctcttttacaaagtaaccaagttcctttgcaacacttgcctttcctctgcaacacttgcctttcctctgcaacacttgcctttcctctgtcatttttcctgcggcttagttttcattagtggttaaggctgctgactgtactgccaaactgcctgagtagtttagatcctagccccaccacttggtaactgtgtgaccctaacccttctgggccccagttttcctatttgtgaaatggagatgataaatgtagtgcttttatgaggagcaaatgagtttatccagtttgcacctgggctgctcctggcttctatgttttaaatttagctgcaaaataccacccccaccccatagtatccatttcctagttccagaaaatactctgtctgggtcatatactcctaaactaatcactctgtgctctgattggcccagtctggatgacatggtcattccttttttttttttttttttgagatggagtctcactttgtcgcccaagctggagtgcagtggtgcgatcttggctcactgcaacctctgcctcccgggttcaagcaattctcctgcctcagcctcccgagtagctgggactacaggcgtgtgccaccacacccaactaattttcatgtttttagtagagacggggtttcaccatgttggccaggatggttttaatctcttgacctcatgatccacctgccttggcctcccaaagtgctgggattacaggagtgagccaccgtgcccagccttttcttttctttttttcttttttttttttttttgatgtgaagtctctctctgtcacccaagctggaatgcagtggcgtgatctcagctcacggctcactgcaacctccgtctcctgggttcaagtgattctcctgcctcagcctcccgagtagctgggactacaggcatgcaccaccatgctcagttaatttttgtatttttagtacagacggggtttcactatgttggctaggctggtcttgaactcctgacctcgtgatctgcccacctcggcctcccaaagtgctgagattacaggcgtgagccactgcgcccggccgacacggtcattcctataggacactgtgattagccactccttcaggatcctgtggagttgggataaggatgattacccaaagaaaggcatgctggttacccaaaagagtgtctgctatattacctctgtgggaaccacatatcctgcctctgctaagagcaattccaacaatgtctctgtgacagaataaataaagtgcttttcttttaaaaaatattttaatttttttagaggtaagtgtcttgctatattgcccaggctggtcttgaactcctggcctcaagagattctcctgcctctgcctcactagtagctaggactataggcacatgccaccctgcccgagaatttttaaatttttcgtagagatggggtctcgcttttgtagagatgttgcccaggctggtcttaagctcctggcctcaagcaatcttcccgccttggcctcctgagtagttgggactacaggcgtgcaccactgtgcctggtaaagagccattctgatgaaacactcacccattcccagtatagagctgagtccaggagtccagttcctgtattcaagagctgcaagtaatgccactccccctggctcactcactctgtgactttgggccagtcttttttttttttgaagcccaggctggagtgcagtggcacaatctcggcttactgcaacctcctccgcctcctgggttccagcaattctcctgcctcagcctgccgagtggctgggattacaggtgtctgccactgtgcccggctaatttttttgtatttttagtggagacagggtttcaccatcttggccaggctggtctcgaactcctgaccttgtgatccacccacctcagcctcccaaagtgttgggattacaggtgtgagccaccgcgtctggctctcttaacctttttgaggctaagtttccacatgtgtaaaatgggtataagaattgtagctactgtatagggttgctgtgaggattaaacatgagttaatgtgtgaaaagctggttataataagctttgcataaatgggattactattattggataggtccgatctggaacctgtgaatacatagtgaatggaaacactttgaactgacccaggaagtatatggtggtggagggacgatagagtaactaccgtgaaaactttcatttagatataggggactgggtggctagagttgttaaatttgggccttgcttatgcagtttctgtctcttagcaacaggtctcagagctccatccatcccttcgctctcaggttcacccagctctcaggagttgtcacattgttctctctggggctcttggtggccttatgaggcaggcagtctgtcccctggcccaggactgtatgtattcttaaggttagcacttaataggggggaagttatgtcttctgtttgcagaggagagtacacagcaggaggtgttgaggtgggggctcaggcttcctgcagttctctgttcttccctcagtgctgtctctcttggattttgttcacctgcttttgcttacattgattttagtgggggttagtgactatggcttttccagtggccaggaggtacatgtgggctgggcacgttggctcttgcatgtaatcccagcactttgggagtctgaggtgggaggatcagttgagcccaggagctcgagatcagcctgggcaacatagtgagacccccatctctacaaaaaataaaaaaaaaatagctgggcatggtggcacacgcctgtggtcccagctatgtgggaggctgaggtaggaggattgcttgagcctgggaggtccaggctgcagtgggctgtgattgcgccactgcactctagcttgggaaacagagtgaaaccccatctccaaaaaaaaaaaaaaaaaaaaagactggggacggtggctcctgtaattccagcactttgggaggtggaggcgggcagatctcaccagaggtcaggagtttgagaccagcctggccaacctggcgaaaccctgtctctactaaaaatacaaaaattagcctggtgtggtggtgtgtgcctgtaatcccagctactcaggaggctgaggcaggagaatcgcttgaacccaggaggcggaggttccagtgagtcgagattgcaccactgcactccagcctgagcgacagagcaagactcttgtttccaaaaaaataaaaaacaggtacatatggttgtctggcccccagcagccttggtttatcagcagcaggcaaaaggagttctcttaatccagctgtgtgctgtccctgtagcccccccgcaactcagcactgccatgttctggcatcttttcttcatatgccctgctcctggcaacagtttctgcaccttagccacctccatattttggcaccttccccactcctggaatgagtttctatatcagtcacagctctttgattgcatattgtggaaaaaatccaaagtaaaataccttaaaagccagtggttatacttatttgaccttgagcctccaaaataaatatatcttgcattgtgacccagtatactcctaagtatagaataatgatggcttctaagtgtactctgtgccaggccctgtggtaagtaacatggtgttaactcatttaattctcaggacaaccttctgctatatgtactgttggtataccctctttcagatgaagaaagtgaagcacagagggattaagtgatctgcctgaggtcgtatagttggtaagaggcaaagcttgggtttgaatccaggaagtctgctttcagagtctatgcagttccaaagcagtggcaactctggaagaaaaaggctttcctaggccgggtgtggtgattcccacctgtaatcccagcactttgggtggctgaggtgggcagattgcttgagcccaggagtttgagaccagcctggccaacatggtgtagccctgtctacactgaaaatacaaaaattagccgggtgtggtggcatgcacctgtaatcccagctactcgggaggctgcgtgggaggatcacttgagcccaggaggcagaggttccagtgagccaagatcacgctactgcactccagcctgagcgacagagcgagaccctgtctcaaaaaaaaaaaaaaaaaaaggaaaaaggctttctttctctcctggcctgtttcctcagtccccatcagaaccctcatgagtccttttgttctgagctattgtgcttctggtctttttgtcctgtttatttttaggcactctttctataataggtagatttgctctttacctatgatatgggctccaaatattttttcccaacttgtcattaacttttgactttgcttattctattttctttaaatattttctttcttttcatgtattcaaaagtacccatcttttcttttatggcctctggattttgagtcatagaaaggccagagctttaatcttgtttcttgttctctgtagcgttgactatcatcactctgtgactccccccagggcccagaggccttggggagctgggggaggttgggagggtggtggttagtgagaaagtgggagcgttttcagcctaggcccaagtctcccagggcaggaggaccctgcctgcttcctgatagccgcccaccaaccctcaggacctgggctatcccttggagcttggctatcagaacttcctctaccccagtgagcctgacctccgagacctgcttctcttcttggctgagcgtctgcccaccgatgcctctgaggatgcagaccagcctgcaggtactgggtgtctgggatgtgggcgggggcggtgaggggagaggagggccttctaggggctgtagggctgagagaggtagaggtggtaaaaaggttgatgggtaggggtggcggtatgtgccttcaggagagctaggcaggaggattaggcatcagagaggggctacagggcagggggcagggggctgaggttgagctgaccccggtggtgcgttggtgcggggaggggcctccctgactcaacccctgtgccctccctctctctcacttcgctctaaccacttgggcctcctgggtgctactcaaacataccccagtacactcccgcctctgcacctttgtatcgttggttacctttcccctaggtaccctcatggttcactcccttacctctttgaggttaacctcctctccgcagccctctcctgatccccacctggctgcagtctggatggtattcaggatcctattcatgatctctctcctctgctagcttgccggctccctgagggcagggacctttatccagtttgttccacgaagtagccctagtgtctagaacagcgacctgtacatagtaggtgctcggtgtttgttgaatgactgaacgtgagaacgcaagctggatagatgtgtatctctggatgggggtcaggagtggaggctggtctcctagggtatgcccttttggatttgcagcattgacatctgattcacttcctccctatcccccataggtgactcagctattctcctccgggccattgggagccaaattcgggaccagctggcactgccttgggtcccgccccaccttcgcactcccaagctgcagcacctccaggtgagacccctgactcccatggatcttctcttgtccccgtctgggtgcccagggttttggccccctacccctggcaaccctcatcccacttcaccctggagattctgagcctgctctcccaccagggctcggccctccagaagcctttccatgccagcaggctggtcgtgccagaattgagttccagaggtggtgagcatgaggctgtggggaggggtgaggaggaaggtgggggggaacctcatagcgttgccatgcggcagggccagctgactctgttcctgcctccagagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggtacagccagatgcctggctccctgctgtctgggctgctgctcactgacactcccgctggtcctctgctctccttccccactttgtccctcccttccattgtttcccctctgtgtgtgcttacctagctccccacctgaaagaacactggagtcagaaaaaaggagaacctgggacaagtcagtatccctcctcagagccttggtttcctgtgctaaaatttggggtagtaatagtgctctcctctcagggcagtagttagactgaataatgtgcttgagattcctggcaactggagcaatccagattggctacctgccttcatcattcattaattcattcattcatttggagtcttgctctgtcacccaggctggagtgcagtggcgtgatctcagcacactgcaacctccatctcccgggttcaagcgattctcctgcctcagcctcccaagtagctgggattacaggcttgcaccaccacacctggctaatttttatatttttagtagagacagggttttgccatgttggctaggctggtctcgaattcctgacctcaggtgatctgcccaccttggcctcccaaagtgttgggattacaggcatgagccaccgcacccggccctaatctttctctgtttctgcacttgtcactgatgttcatttttctggtttctaggtttttgcacaatttctgcctgtccccattattctagttctgtgtttttgctgctcctctttcttacctctctgtctcctcgtttctgtactgaattcctctcttgctctgtctatctatctgttcccccttctcctctgtctacttctttatctgtcccctcttcttctctgtgcacctttttatctgtgtccccttctgctctgtccacctctgtatctctccccttccttgctgtccacctatatatctgtcacccctctgcctctgtttacttcttaatctctctcctcttcctctctgtccacctctgtatctgttgccccttccctctgtccccttatctctcccttcttcctctctgtccacctctgtatttgtccctcctccccttctgtccatctctttatctgtcctctcttcttctttttttttgagacggtgtctcgctctgtcacccaggctggactacaatggcatgatcagggctcaaggcagcctcaaattcccgggctcaagcaatcttcccacctcaggcatctgagtagctgggtctacaggtgcgtgcgcccggctaatttttgtattttttgtagagatggggttttgccatgttgaccaggctggtctcgaactcctgacctgaagcaatccacccaccttggccttccaaagtgctgggattacaggcatgagccaccatgccgagccccctcttcttctctgtcaacctctttgtcccctcttcttctctatccatctctgtatctgtcccctcttcccctctgtccacttatctgtcccctcttcctctgtccacctctgcatctgtcccctccttctctctgtccacctctctgtcaccctctccctctgtccatttctttatctgtccccttttcctctctgtccacttctctttttccctccctccattctgctctcctatttctgttccctcttcctctgtgttcacccaggtatcagtacccctccccttctgtccacctttacatctgtcccctcttcctctctgtccacctctgtatttggcccccctccccttctgtctgcctctttatctgtctcctcttcctctgtgtccacatctctgtctgcccctctttttctccacctctgtgtcggccccctcctggtctgtccacttttttatctgtcctctctttctgtcttcacctctgtgtctttttacatttttatttttttatcattattattattttttgagatggagtctcgctctgtcacccaggctggagtacagtggtacgatctcagctcactgcaacctctgcctcctgggttcaagtgattctcctgcctcagcctcccacatagctaggactacaggcatgcaccaccacgcccagctaatttttgtatttttagtagagacagggtttcaccatgttggccaggatggtctcgatctcttgacctcatgatccatctgcctcggcctcccaaagtgttgtgattacaggcgtgagccaccacgcctggctgtctgtttttgtttttatatctgtagtaattttcaaacataaatgtagagagaatattctagtgaatcctatgtaccattttgccaacttttcttcatcttttctctcccaactttttctttgttgctgtattattttaaagcaaatctcagacatcatgtcatttcagctctaaatacttaggactacatctcttaactcataaggacattcagttttcaaggtaaccactggaccattttcatggctaatgaagttaacaataatatcttgtgggtttttttttgttttgttttgttttgttttttgtttttttttgttttgtttttgagacggagtctctctctgttgcccaggctggagtgcaatggcgtgatgtcgcttcactgcaacctccacttcctgggttcaagccattctcctgcctcagcccccaagtagctggaattacaggagcacactaagttttgtatttttagtagagtcggggttttaccatgttggccaggctggtcttgatctcctgacctcaggtgatctacctaccttggcctttcaaagggctaggattataggcatgagccactgtacccggccaacaatgatatcttaataccatccaatacttgagttcataatcagattttcccattatcttgaaactctgttgtccctctcttgcctctctctctctgcctctttctgtgcttggtacctttgattccctgtctctgccctgtcccccgatatcctgtctatgcttctcttggatttgggggctctaggcccacccccctctcttcccacatccttctccagcatggggatctagtgggtggagagaagtatgtctgtgagcaagaggagacccctgtcctcgaggagatcccaggctggtggagcaggagagtagagcagggcctgccttagtgggaaggctggagggtgggggtgacttgtctgtatactcttgtcagggggtccttggaggaggcagggccttgggtgctaggtgggcccctacaccttcctgcttcccccgccttttctccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggtgggtgcgcctgaggacatgagatgtgtggatgggcgtggcaggcttggagggtggctttttgtgtcagcaccacacctttatccacacaggttcctgtgttcccactggacaggccctcgccccactgtgggatgggtacccagaggggtcccctagcttattagggacttgactggagaaaatgtggataggtgggaaccatgcaaaggtgtgggggtgttcttggggcaacaccccctttcctcaggcagtttcctttgagcatatcttctgtcctaagatgttcactctgagggccccccatccttctcatgggcatttgaggcttgagagatggggcaggtgggtaggagctgtgacagggtcagggagatttctccacgagcaagcactctggcccgaggttgcagatggtgcctttacccacatagtcacagtctggccaccatcggtgcttcagtgggcatgcatgccgcactgggggcagttctcaggggaggctgaggctgggccacgtgaggaagggccttccctggcagccaggatgcccctcgtcactccccttaggagccccaggcccaggccactcaggtgtcagatgtgccagccacctcccggcggcctgaacaggtgagcagagtggtttggaggggggtgtcccaggcccttgcttgtctactgggcctgacaccccaaccctgactggcctgggcctcccaggtcacgtgggcagctcaggaacaggagctcgagtcccttcgggagcagctggaaggagtgaaccgcagcattgaggaggttgaggccgacatgaagaccctgggcgtcagctttgtgcaggtaaggggcggaggaggggctgcgcgttgggctaggtcagaaggagggcctcggggtgtgagggactagatggggcaagaggtgctctgtagaggtctgcacatggcagaagggttcctgggagccattagggatctgtgggcctcttgagggtggctatgagaatcaggccagggtgagggtctgtgggcatctatggggcaccgcgggtctgcatgggcaggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggtggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggtgtctgccagatcttgtctgatacgaaggagcttcagaaggaaatcaactccctatctgggaagctggaccggacgtttgcggtgactgatgagcttgtgttcaaggtgtggggcaggttgggcgggggtgagtggggtgaggctgggctgctgccttgtgcatctgctaattggctggctggggtccagacccaggccctgtgcgaggctggaggtgcactgatacccagggctggctttgtttcatggaggatgaagctagtggggtggtgggagagggtggccttcttagggcatggagatggtcaagggcagcccactgatacctttgaggtccctgtgtctggtcaggatgccaagaaggacgatgctgttcggaaggcctataagtatctagctgctctgcacgaggtgaggggagacatgtgcctggggtggggctgctgggggtgggtgggactgggtgcaagccttctgctcctgttgtccccagaactgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagccacacacagccgatggctggacacccagccctgccccttagtgcctgtgacctgggacaggcaagtggcctactgtgagccccagcttccaccccaagggccctcctgtctgcctcccagggccatgggcagaggcttcagcttaaagatgtagggggaatcctgccacatggcgaaggatgctttgggtagagggaacaccacacgaggcctggccatgggacagagcaggctgttggagttggtgggaggggcccagagtggctgtgatgggggctggtgagcaggagctgggaaaggggctgtgtgtgctgagggggcatgtgttcacattgcctcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaa

SEQ ID NO: 2388 - DNA, 27263 bp, Homo sapiens
  source 1..27263: mol_type = genomic DNA
ggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggtatgcggagggggcggcgcgcgggcgggcggcgccggtgttccccgggaaggtggccctgtggttctgcccacctcgaggggcactgacctagcctgcattgtgccaggtgcgagtccgggcagggggctgcggcggggacctgacagcaggcagggaccgcttcaggtcctaggtcgatggaataaagccccgtcgggtctatatcactccacaccccaggttgaggctctttgcgctttgctttgcgtcagttctgggaaattaaaattgaacttggctttgttaagtgggtagtccccaactagaagcgtggaaccagggtggcagacgctagccttcaaatgatgcaagcctggaggtccctgtaatagttttcgcccaaatgaggaaataaattaatttcgggaggggggtgtgtgtgtgtgtgtgtgtgtgtgtgtgtgtgtgtgtgtgtgtgtgtggtttttctgaggtggggacggcgactttctcaaaggatgtccggagctgtgttttgtttccagcaagtcagacttctgttaaagactgtccaggctgggcgctgtgactcacgcctgtaatcccagcactttaggaggccgagatgggaggattgcttgaggccaggggttccagaccagcctgggcaacatagcaagacccccaactctacaaaaaaaaaaaaaattgaaaagtgagccgggcgtggtggcacgcacctgtatttccagttactcaggaggctgaggccagaggatcgcttgagcccaagtgattgaggctgcaggtgagctgtaatagcgccactgcactacagcctgggcagcacagaccccatctccagaaaaagaaaaaaaagcaacttgtcagttcaaatggctgggaactgactggatttaattttcagggagctatgtgtctgcagatgggcacacctttatttcttacaagcattggtgtattacaaattagcactaggaaagaaacctagagacttgagttttcataaaaattacctggtgctacttcagatgtgacttactgactatcgaaattgcctttctgactggtgggcagtatttgcacaatgatgagatcattcctgttcttcttcttattttaaataatagagacgtctcactgtgttgccatgctggtcttgaactcctgagctcaagtgatcctcccgcctcagcctctgaaaatactaggattacaattcctgtttttctaaaaccggtttttgttttgttttgtcattagcatgtgtgacacaagaggtcgacattgaacttagcgttttcaatagctaagatgaaatgtttctattcatgttgtgcttctgtttcctcatgtttcaggaggaaaataagattttattttatcatccaaatgaggtagaaaagaatgagaagattagaaatgtcggattgtgtgaagctattgtacagtttacaaggtaatacctctaagtgtgcttttagcgttcagtgaattcttaaaactgctgctggagaattgtcccaaacatatttttttaacctttgtaggacatttagcccatcaaaacctgcaaaatctttacatacacagaagaacagacagttcttcaatgaaccagaagaaaatttctggatggtcatggtatttacatacacagtgtatctttctgaaattgtatggtgaagttatgggtgatctttactgttcagaatttaggaaagttctctggctgttgcatccaagtaaaattaaaataaaattggttgcaattttaaaatcaagttcttcctatttgctttattcattcttggggctgttttaagaagctatgtttctgatgctgtagcatgttcaaagtttttaaattaaggcaaaataaacatggtctaatgaattcattgtataatttcagtttatcaaactttgtaggttgttcggaatcctataattgaaaaacagagtaaagatggaaaaccagttattgaatatcaagaggaggagttgttggtaatgtgtcattgtttgtttatttatttatttttttaaatgtattgctgagtatgttgaatgccttacttggtcggatttaaactaggaggcttttgcagaagtttctcggggtatatagcaaaggtttatgtttatcatttacatgagcacaatctttttaaaatgtatatgcacccaatctcactaataccttctactcttcatttatattgaaagccctcctaaagtaaggcttactgattcacaaattagagtttaaacacttctggctgggaacagtggctcacacctgtaatcctagtactttgggaggtcaaggcaggcagattacttgaggtcaggggtccgagaccagcctggccaatatggcggaaccctgtctctactaaaactacaaaaactggccagggatggtggcgcacacctgtcatcccggcttctcaggaggctgaggcaggagaatcgcttgaaccggggacgcaaatgttgcagtgagccaagattgtaccactgcgctccagcctggacaacagagcgagactccatctcaaaaaaaaaaaaaaaagaacgcaaacacttttttttcagcacgcaactattgtgggacaaagtttataaacattatactgtttggccaagagttagtgtacctttgccatctatccagtagacattgtttttcccttgaactgagctgtgtgctgtgttttcgcgtctgcaggacaaggtttatagctcggtgctgcggcagtgctacagcatgtacaaggtaagcgtggcgttctttctcaactcagagtccagccacttacccctatctctaggctccagggttgtttaaagagaaatctgtaaatgactgcaaagtgactctgtatttgtcttagagaagaaaataatgaggcctttgaaacaggtagtgaggtttatgcctacatttattcagtaagtattgaactcccttctcttttctcagccttatagtaggaatgtgtccccattgatgaaaaagtgtgtctatgtgctcaaggaatgtacagaatgcagataattttatgatttaaaagtttcagtgaggcagggcacagtggatcacacctgtaatttcagcattctgggaggctaaggtgggaggattgcttgagcccaggagttcaggaccagtctgggcaatatagcaagaacccatctctacaaaaaatttttataaaagttagccaggtatcatggtgcatgcctgtagtcccagctacctgggaggctgaggtgggaggatcgctcgcgccttggaggtcgaggctgcagtgaactgtgattgcaccactgcactctaccctgggcaacagagcgagattccatctcaaaaaaaaaaaaaaaaaggataaaaagtttggtgattccatttattaacagaacactgaaaaataaaaaaacagaaatgtgggtgatattatgtatgtaaattgaaacttcagggtaagttgaaatttttgaaagatgcctagagcaattaggtggtttcataaataagacagcatcacttaacagtattttttgtaacttacatttttaactcaagttttctcatgtaaatattctctgttggaaagaactgggagatttaatgagctgaattaataatctaaaggaaaaaaagaacttgttatactgaaaaagtgagcataggaaactgattttttttcctgcaatcttttacctcactagctttttaatggtacatttctgaaagccatggaagacggaggcgtcaagcttctgaaagaaagattagagaaattcttccatcgggtaagtattttgaatttcatttataactttagtaagcattcagcaggtttttagagaaatatagacagacaagtttgtttcttatatacaaaaaacccagaacttgaaagtggcaaagagcctgagacagaccgtcgcaaaactggagcagcgaggaaacgcatgaggcttgtgctctggaaccttccctccagctgtggtgtaaggcagagcttcctgcgtttgcccggggctcttaaagggtcctggagacatcgtttggcctccctgtgttttacctgcatctgtccttctgggcttactcagcagccatcttttgtgtgatagattagttgataaggaaaacttaattattggagttgcacaatctcagggattggttctgttcactaaacgggcgtgaaccgtcttgatgtaggtaagagttactggccttgacagactttgtcagattagcgattggggagatttgttccaagtgctgtcctctttcgttgtaattgaattttgcatgtttcaccctaccttgtcaagctcagtttatcttttttttaaaaggaaacaaagagacagggtcttgtcttggttgttttgcccaggctggtttcaagcgatcttccctccttggcctcccaaagtgctggggttaaaggcatgagccaactcgcccagcctagtttatctcgaagcaacaattctcaatttattttcttctgaaaataccttctgtatctatttttgaattcgactttctaaaacagctttcatagctatttttgaatttttttgtttctctgaattacttttctttgttttgtcattttaatgaccacagttatccactcgcatattatctcctggtttctgttcttgtcctcatttctctcttacccatcaacatatggatagaactgttgtcctgagtacatatcatttagacatgattttagtataagatggcactcttggctgggtgtggtggcttacgcctgtgatcccaccactttgggaggccgatgcgggcagatcttgaggtcatgagttcgagaccagcctggccaacatggtgaaacctcatctctactaaaaaataccaaaaaactagctgggcgtggtggcgcacgcctgtaatcccagctattctggaggctgaggcaggagaatcgcttgaaccccggaggcgaggttgcagtgagccgagatcacaccgctgcactccagcctgggtgacagaccaagactccatctcggggggggaaataaagatggcactctctgtagtattaatggatagatccctcattaggttagtctaatttgaagagcattaaggcagggagttaatttttttttttttttttttttgagacagaatcttactcttgtcacccaggctagagtgcaatggtgtgatcttggctcactgcaaccttagtctcccaagttcaagtgattctcctgtctcagcctcctgaatagttgggattacaggctaccacgcccggctaatgttgtaattttattagagacggggttttgtcatgttggcgaggctggtctcaaactcctgacctcaagtgatgtgcccgccttggcctcccaaagggctgggattacaggcgcgagccgctgtgcctggccaggaattaaaaacttgaaagtgctagctgggcacagtggctcatgcctgtattcccagcgctttgggacgcctagacacgagaatcacggaggccagaagttcaagaccagcctaggcaacatagcaagactctgtctataccaaaaaaaaaaaaaaaaatttttggccaggcgtggtggctcacacctctaatcccagcactttgggaggccgaggcaggcagatcacgagtcaggagattgagaccatcctggctaacatggtgaaaccccatctctactaaaaatggaaaaaaatagctgggcatggtggcaggcgcctgtagtcccagctgctcaggaggctgaggcaggagaatggtgtgaacctggaaggcggagcttgcagtgagctgagatcgcaccactgcactccagcctggatgacagagcaagactctgtcacaaaaaaataaatttaaagcagtaaaacacaatactgaataaacattaagtagatatgtttgaactttgtatcttggaattggtactgagactgagttggcactcagttacccatgtcttcaccacggcctcattgttgcgctgtttgctagtatgtaattgtaccataaatgtgagtctgacataagattattttcagttatcaaggagcattatattcagtgtactattagtaaattttatgccttattttttttcccacagtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggtaggtacaccccgaggcatggtattaaaagaagaaattaagataataaaaacagcagtgactggattgatgacaggttgtcaaacaggaacttgcagcggggaggatgggtaggaagcatcttcatagatattgtcaaaataaagcagtgattatttaaagcagaactagggtgatttgggttcaaatttccaagcagaggagtttaaaactggttgcatgaaagatgaaaggctgggcacggtggctcacacctgtaatcttagcactttgggaggctgaggcgggtgaatcacgaggtcaggagttggagaccagcctggtcaacatagtgaaaccctgtctctactaaaaatacaaaaagtagctgggcgtggtggtgcatgcctgtaatcccagctactcaggaggctgaggcaggagaatcacttgaacccgggaggcggaggttgcagtgagccgagatggcaccactgtaccccagcctggcaacagagagagactctgtctccaaaaaaaaaaaaaaaaaaaaaaaaaagagaaaatgttcctatcaagtaaggtttaggaatcctgtttttattttggagtttttttttttttctgaaatgataaaagcagaatttttatacctttttttttttttttctttcttatagagacggggtttactgtgttgcccaggctggtctcaaactcctggcctcaagcgatccacccgcctcagcctcccaaagtgctgggattacaggcacgagccactgcacctactttcttttaaagaaactagatttctttttttttaatccaagaaatccaaagtgttatataaaccaggaaattacctgctatcgtgaaactaggtttgtgtcctgcagtaggaacaacgtgggcacaagactgcccagcatatgtgacccctgagagctgggtggcaaccgaggttgtgcacatttggcctagagtaggtggacagaagtcatcaaggcttgcagctgttctgggaccctcaagttttatgttcccgttgactagagcccactttctttctttcttttttttttttttttttgagacggagtctcactctgttgccaggctggagtacagtggcgcgatcttggctcactgcaacttccccttcctgggttcaagcgattctcctgcctcagcctcccaagtagctgggattacaggcatatgccaccatgcccggctaatttttgtattttcagtacagacaaggttttaccatgttggccaggctggtcctaaacccctgacctcaggtgattcccctgcataggcctcccaaggtgcctcgattacaggtgtgagccactgcacctggcctagcccagtttcttaattaggggtgtggccatatggtactactataaggtaaattcagctaatagaaaaggcaaaactagttcccctaaaatttaccttccctgccaaaatcttgtagctccattttaagaagagaaacaagttactgtaaagaaatttgaatccagttaataaacaacttggtgggtttccacatgaactttatctcctaggaagacaacagaaatttcgggtgaaacccatctacttttttttttgtttttgagatggagtcgctttctgttgcccaggctggagtgcagtggcatgatcttggcttgctgcaacccctgcctcctgggttcaagcaattctcctgcctcagcctcccgagtagctgggattacaggtgcataccacaacacccagctaatttttttgtagagatggggttttaccatgttggccaggctggtctcgaactcctgacctcaaaggatccgcccaccttggcctcccagtgctgggattacaggtgtgagccactgtgccccgcctccacctactttctaatttgacaaatagtttatcaggcaaccttacactgtactgactcagctatagttgctttctgtgatatgtacacaatgttactaaagtgaaattctgctgtgaaatgtaggagatgggaggctagttgtgcttctgtagcatcaggtctgcagagggatggctcctccacagatggaaatgacaggacgtgcttgcaagtcacacgcagccacagcgatagggagatgtcatgtgacaagccagaatccagcagtagtggcccatggccttgcttccaccaaaaagagaagggtagctgagattctgatctctgggacagaacacaagccccgccatgggtgcaaactcctgagagtgaggaagagggaaggcttagagcagagggtcttccaggagctcattctgggagaccctggagccagagtgaccagcagggttggccctttgaagcctggagtcacaggacaatctggcgcccagctctggggatcctgttggcatcgtcatcttggaatagcatctgaggggttgagcagggcacagctctggtggctgcacagaactgttctgttgtcacctccagtgtgctcgtggggaaaggtcagtcccaggaagtagcaacaaaaataaccttcaagcaaaacaggcgccaatgcttacacctgtcatcccagcactttgggaggctgaggcaggaggatcacttgagaccaggagttcaagaccagcctgggcagcatagtgagactgtatctacaaaaaatggaaaaaaaaaaaaatagctgggcattgtggtgtgcacttagagtcccaactacagagactacagaggttgaggctggagaatcacttgagcctggaagtttgaggttgcagtgagctatgatagcaccactgtactccagcctgggtgacagagcaagaccctgtctaagaaaaagaaaaacagcacgttttgacggaattgcttattccaaagctgttatattaaataccaaaaagacttttaagccaggcgtggtgcacatacctatagtcccagctactggggaggaggaggcagaaggatcgcttgagccaggagttacttggagaccagcctggacaatataatgaggctctgtctctaccaaaaagtggaaaaaaaaacttgtcacaagcagagtatatattacccttatgtatttacttagtatattgctttgattttttttttttgagactgagtctcattggcttggttgcccaggctagagtgcagtgatgtgatctcagctcacttcaacctgcgcctcccaggttcaagcgattctcatgcctcagtctcccaagtagctgggattagaggtgtgtgctatcaggcctagcaaatttttatattttttagtagagacggtgtttcgccatgttggccaggctggtgttgaacccctgaccttaggtgatctgctcaccttggcttccccaagtgctgggattacaggtgtgagcttccgcgcccgaccaccttcacggtatttcagtgatcttgaatagaaaacgcccagatccagcctcattgtctgtctccttttaaaaaaccggttccagagtctgatacctgctagtttctctgtgctttttccatgtgctgctccttcctgcctcatttcagatcaggtggtttgcctgaaagcttgtttttctcctcctcctctttcttcaccgaagatccggagaattaaaatccatgtacatttctgagacctaggatcacgttccctgtctacagcatacccatattttcccaggggactaggggagagaatgtggcattaccatataacccaggaagctaagagacatctgctcctaaaatgaaacagtgtggctttggaggtttcctgcataatcctacacggaattcaaccagcgagtccaatcccttgtgactttttttttttttttatctcaaatggcatgtaaaatacaggactgtaggagtagccttttgcaggtcaggataaagttccagtgcctggactcaagtttaaccctttaccttccttaacttcgcagtcaggtggtgagcctcttgatataatgttaaagagaaaagcaccagtagtcccagctactcaggaggctgaggtgggaggttcgcttgagcctgggaatcggtggctgcagcaagctgtggtcacaccactgtaatccagcctgggcgacagacgagactcatctcttgaaaaatgaaaaaagatgaggccaggcacagtggctcacatatgtaatcccagcactttaggaggctgaggcgggagcactgcttgagtccagcagttcgaaaccagcctggcaacgtagcaagacccccatctctacataaaatacaaaaattagctgatggtggcgcatgcctgtagtcccagctagtctggaggctgagatgggaggaccgcttgagccctggaggccaaggctgcagtgagccatgatcgcaccactgcttccagcctgggtgacagagcaagaccttgtctcaaaaaaaaaaagaaaaaaaaattttttttaataaaaaatgagttttatccagggcttcaaattctttggaaaagtttgacaaagtataccacgtaaattcagatttacctcaatgctaagaattatgtttaggaaaaaggaaactcattttgatctcaggtacaaaaatagattgctttgagttttaagtagctttagactttaaaaagttagaatttattctgtgttactaaaaatgacttgaaaaaaaaatttttgtttaatgagctttatcacagcagtggaaagacagaagacagttccaaacgtttaacccagtgcttttctgttgttgcaggagtggattagaacaagatgacatgagaattttatacaaataccttaccacctccctttttccaaggcacatcgaacctgaggtatgatgggtaccatagctgcgcacaattacatgcaggggcacagagagggcaggtggagtgagatggtggtgcatgggggcgtttctgatcgtttctgatgtatgttttgtcttactgtgatatttgtgtcactgtatatcaattagcacagaaaaccacatgcagctctcctccagtatgtgacattcagatgtgatacagaaagcatcgttttgtgtgtctgtgtgttggtttttttgtgtgtgtttttgtttgtttggtttttgagacggagtctcgaactttcgcctgggatggagaggttcaagcaattctccttgcctcggcctcccaagtacctgggattacaggtgcctgccaccacgcccagctaatttttttgtatttttagtagagacaggtttcactatgttggccaggctggtctcgaactcctgaccttgtgatctgcccaccttggcctcccaaagtgctgggattacaggcgtgagccaccgcccccagtccacaagcatgtttttaagaggagtgagtcattgagtagaggaaaattggattttactttacttttaatttatgtattttattttatttatttatttatttatttatttatttatttatttatttattgggacagagttttgttcttttcgcccaggctggagtgcagtagtgcaatctcagctcactgcaacttccgcttcctggattcaaacaattctccggcctcaggctcccgagtagctgagattataggcacctgccaccatgcccggctaatttttatatttttagtagagacggagtttcaccatgttggccaggctggtctcgaactcctgacctcaggtgattgacccgccacagccttccaaagtgctgggattacaggcgtgagctactgctcctggccaaaaaattggattttagatcgggttctaggaacctttaaaatgccagtgatctttaaaacaatcgacttgtgtagtcttttcctctatcaacaggagacctaattttcagtagatgttttagtgcctacccggctttccactctagtacttaatttcccggtttcctgcagagaacttttaaatgatatcactgtgttctccccaaagtattttcagagcttaacatacaaaaatcattttggctcagttgaactcactctcttcgcttgttcgttccctccctcttgtcctcctgctttccaagtttttttttaagagacgaggtctcactttgttgactcgcatggtctcaaactcctgggctcaagcggtcgtgtcacctcagcctcccaagtagctgagactacaggtgtgtgccaccacacctggctaattttttgtagagatgggatctcgtcatgttgcccaggctattctcaaactcctgggctcaagtaatctgcctgccttggcctcccaaagtgctgggattataggcatgagccacctcacctggccaaaaatttaaaaactagccaggtttggtcacacatgcctctatcaggaggctgaggtgggaggattgcttgagcctaggagttcaaggctgcagtgagccatgatcatgctgcacgcattccagcctgggcaacagaacaagatcctgtctctaaaagaaaaagacaaatggcatggaaccaattagtagataatgctgtttttcaaagcttggaaaataaataaaaagtctgataagtcattctcaacattaaatgtatttgcagttagcaggaagggattctccaataagagcagaaatgccaggaaatcttcaacactatggaaggtaggacttctgttctttgatttatgatactgggttttctttcttttttgactcagagtctggctctgttacccaggctggagagcagtggcaagatctccgctcactgcaacctccgcctccccgggctcaagtgactgtcatgcctcagcctcccaagtagctggaactacaggcatgagccactatgcctgggtaattcattttgtatttttagtagaaacagggtttcatcatgttggccaggctggtcttgaactcctgacttcaagtgatccacctgccttggcctcccaaagtgctgggattacaggtgtgatccaccatgcgtggcctattatctttttggtaaagataatatggacattgaaatatctttgtgccatctgattgacagtaatcaacaaaggaaagtttgttgtttccaatgagttaaaacttacttcagcataccctttttttttttttttttttttttttttttttttgagatggagtgtctctctgtcgctcaggctggagtgtggagtacagtggcacgatctcagctcactgcagcctccatctcctaggttcaagcaattcccctgcctcagcctcttgagtagctgggattgcaggtgcccaccaccacgaccagctaatttttgtagttttagtagagacgaggttttgccatgttggccaggctgcccttgaactcctgacttcaggtgatccacccagctcagcctcccaaagtgctgggattacaggcatgagccaccacgcccagccagcatattctgatatggtgtttgccaaatagcacctggcatcaaaagcaactggtgtgtatgaagtgggagtgtgttctgtttctagattcctgattctccttcacctcgttgaatcaagtcatgtctgttcttgcttttaagatttcttaccggacccttgaacctcaatgatccagatgcaaaatgcagattccccaaaatttttgtaaatacagatgacacttatgaagagctccatttaatcgtttataaggtaacaactgttttccttccagcgttaatgattgtgctgaagtggatctttcttgcatgtgtacacgagtgcatgtgcaaacctcttaaatgtttcttggaaaagatattggaagttctgattatggtaaaactcaaaatgggtgttcttccagcgtaataagtttattttcagctccttttaaacagttttgttattagtgaaagaggaactgtttaagattgtgatttataaacgtgtgaagtctcacgtgctctcaaaccaaaggctgtcagaggttggtgctgcctgttctcgaaatggctctggatgggggccgtagccacgtgtctgtgcatatgctgcttttgctctgattttaaagctgtaggcttgctaattccataaggattgtattttgtttctgtcaggacatggtcttgtaaggatatgtactcaggttgtgtttctaattaaaggcagtttttgattcaagaaagaagacggagcatgtgcacgtgtttctcctctttcctgcctgaggctgtggagaagttttcatttataaaggctcagaaatgatgccgtgggggaacaggaaggagcgggatgtgtcaggatgagggagtcctgtccctctctggaaggtagacgggacttgtaaaccatgcctgatagagggcggtgccggagcaggcctggaatatgagtggcaaccctgtgctaaggcaaggacccacagccctgtggaagcccagagaggctcctgacttggaggaggtcacctgaggagtcagagtggggcctgggcctggaaaggtggggaagggaagtgaagtgtggcagagaggccagtcagcctccccttcccccatccttgcacagacaggcccacagctgagcatccatccctgggtgacaatcgagggtctgtttaaagaaaggaaacagtctgaagagacccagagtggctaacgtggatgtctgcccctgagaatgaggccctgctcattctggcatttctttctcccagacagaactgagaccttcatcctacactcagagtgaagcctccatctctggtcagccttctggttccctcattgttaaatatggctgcaaaaacaaaactagaggtctcgaaagaaacatgattccgaggacagacaagaactttaaaaattagtatccactaattagaagagttgtatctattaatataaaattgaaatgggccaggtgcagtcccagcactttgggaggccaaggtgggaggatcacttgaggccaggagttggaggccagcctgggcaacatagtaagaccctgtgtcgacaggaaaatgtttaaaaattagccaggcatggcagtgctcatgtgtagtcccagctactcaggaggctgaggcaggagaaccgcttgagcccaagagttggaggctgcaatgagctatgatcacaccactgcattctagcctgggtgacagagtgaaaccctctcaaaaataatgaaactggtatcaacagtttcatatccagcaccagacattatgtgacagtggaagagagactttcaaagttctgagagaaaatgaatttgagcgtagagttctttgccatgccaagctgtcaaccacagataagacaaaagaaagacattagccagggcatggtggctcatgcctatatcccaacactttgggaggccaaggtgggcggatcacctgaggtctggagttcgagaccagcctggccaacatggggaaaccctgtctctactaaaaatacaaaaaatcagccaggcgaggtggcacacgcctctaatcccagctactccggaggctgaggcaggagaatcacttgtacccgcgaggcggaggttgcagtgagctgagcttacgccactgtgctccagtctgggcaacagagcaagactctgtctcagaaagaaaaaaaaaacacgttcaacatgaaaagcctcaaaaagtttaccgtcatgcacctttcctgagggtgttacacagggtcatccgtcagcagaataagtgagcacaccaagaaggaacacttgggaatccagaacagtagttctcatgtgtgagacggtacaaggaaatcttggggtgataaggctcttcaggtctgctggcggcaccccacctccagcagctccgtgacagcaggaggagggagggctctagggttcaagccgccaagataaaaagatgtttcattcatcacatggtgtgcttgagagtcacttaaagttgggctgtgacagactggcagggaaggggagattgcaggaagagcatacagaaagatgtggtctgaaaaagcaaaccaaaatgttggaggtgtaattcagagcaggaattggagtaggaagaatgtccgtttgtgtatcgagtgaaagtttgagaccccatctcaagaaaaaaatcatcctcctttgaatgacccaggtaatggctgaaatctccataaccctggtgtgtaatatgctgtcggctgcatttctatttttagagtcaatctacagacatattgtggggtgtgatgatgggattgtggctatgttaaagggtccttacctttttcttaatgactttgagatacaatgcacgtaccatacaactcaccctcgtacacttaaaatgtacagttcagtgatttctagttgcaaagttcatgagtctccaagaccatcctcacttctgacacccactgcgagtttgggagtccccgtgaccacctttagggtaagagttctctagaagtactacaggactcagaaaaggctttctacagcagtacccccgagccaaaggccatgtgttccaaaacccccgggaggtgcctgaaaccggggacagtaccaaacccttcacttgctgtgttttttcctgtacatacatgcctgtgataatgtttataaattcagtacagtaagcgattaataaggctgggcgcagtggctcacacctgtaatcccagcactttgggaggccgaggcaggcagatcacttgaggccaggaacttgagaccagcctggccagtgtggtgaaaccctgcctctactatagatagaaaaattagccaggcatggtggcatgcacatgtaatccaagttactcaggaggctgagtcaggagaatctcttgaacttgggaggcggaggttgcagtgagccaagatcgtgccactgcactccagcctggacaagagtgagaccccatctcaaaacaagtaatagtaatcataattggacgatgacactctactgcaataaaagtcatgtgaatgcggtttgcttcccccttccctcaatattttattatactgtccctcacataacagaaaccatgggaaacaaaaccagggggaaggaagaatggcggcactcacagctgcggtttattacagtggaagaatacaggttaaaatcagcccggggaagaggcgtgtggggcagggcgcaggagccaccaatggaaggaccaggagtccttctatttgctttaggttggtttgggttggtttggttttttgggtttttgttttgttttttgttttttttttttttggttttttggtttttgagatggagtcccactctggtgtgagcttccggctgtcctctcccgttggggtcatgtggacagcccagtgagtgtttccccatcgaggatgtgtggctgtctctatggagtgttgacatccagggaagctcacctgagcctcgagatccagagatttgattgggggttggccacagagacacagctggccccacatggccagccttagtctccagccctccagaggtggagcgggtgctgtgcgggcttgggtgtaagggatattggcctgtagttttgttttcttgtgatatctttgggcaatgctggcttgataaaatgtgttgggaaatgttccctcctatttttttggaagacagtgaaaaattggtgttaattcctctttacatgtttcatagaattcacagtcaagctctctgcacctgggcttttctttgtggcaaattttaaagttaaccatttatgcccagtgttccattattggaacactaagcttgtgagagttatttatatcctgctgaaggtcattgccaaggtctcatttttcacaaaaaagatttacaacctccagcataaatgggttaatctctgtacttgttacaggtttattttgattttgtttcttcttgagtcagctttggtagtttgtgtctttctaggaatttgtcagcttcaattaatttatttgatttgtcggcacgtggtttttcatggtattgtaggtaaagccggatactccttcgtttttcctgtaaagtcagtagtgatgtctcctctttcattcctggttttagtaatttgagtcttctctctttgttccttgttgtatagtctagctaaaggttcttcatacttctggaatcttcacaagaaaaaggaaaagtttttcaatgttgggtcttttcagagaacaacttttggtttcatttattatctctgtgatttttctctgttgagtttgtttctgctctcatgctttattatttccttccatttgctttaggtttgtttgggtttttttgtttttgtttttgttttttttgagacggagtcctgctctgtcacccaggctggagtgcagtggcacagtctcagctcactgcaacctctgcctcccaggttcacatgattctcttgccgcagcctcctgagtagctgggattataggcgcaccaccacgcccggctaatttttttgtacttttagtagagatggggttttgccatgttagccaggctggtctcaaactcctgacctcaggtgatccgcccacctcggcctcccaaagtgctgggcttacaggtatgagccaccacacccggccccacttgctttaggtttagttgactcctgttgtccaggatcttaagacgaaaggtcaggtcactgatttgagatctttcttctcttgagacaggatttcgctctcggaagtgggaagaggtactggggcaggtgggaatgtgagttcaggagcggaggctgtggctggtggaaggcggccagcggaggaaatagaatgctataaaccatagaggaggagggggaaggcagacgaggggtcacacctgtcatgacatgagcaggaagtcagtacgatgcccaaagaggatacgttgaagagttaggataacgctgttgtctaatgacagtgtaaagtggttgccggggaggagggtcagagaacgaaatctgtggctttcatcatcaggcctggtgttctgctcagcctctcttaaccatacattgctttgataacttttaaacatttttggttatctgtggtcctggttgttgtcggttgctaggtctaatgtcataactgtaattacttgctataataaagtgagacaggatgatatccatttgctgtctttgtaaacgtgtgtcaatggaaatcgtcacagaataatggacagtttctgccaattctctattctctctggactatacacagagagactagaacagtgaacccctaagtccccatcacacaagtgaataagattctggtcttcgttgcttctccatgttgtgttgtcgggtttgcaagagcattttaagtcatcacgtcagtcacgaacacttccctgtgcctctctgatgaggacatccgtggtaacctccccactggcgctgtcacacctgacaaggtcaacagcactcccctcgcatcatggaatgggcagtctgtgtccagatggctctagttgaccaaaaagcagcttcttacagttgacttctccccattgactttgaacagattgttattatacgaaagtctccttttttccaccatttcataacctctggtttgttctgtcttcccaggccatgagtgcggctgtgtgctttatgatcgacggtgggtacgcgcctttgtctgatttcagcctaagctttttgtactttgctgcatcctattcttaagtgataaatatgttttgggggtttcggttgtttgggctttttttgttggagacggggtttcactcttggagtgcagtggcatgatcatagctcactgtagcctcgacctcctgggttcaagtgatcttcccaccttggcctcctaagtcgctgggactgccagtacacaccgccggacccagctaatgtttttgtggttgtttgtttagacagggtctcactatgttgcccgggctagtgtcaaactcctgggctcaagcgatccacccatcttagcctcccaaagtgctgggatttcgggcgtgagcccccacacccagcccattaaatgataaatgtgttgtcataagcaatatagaggcatagagaggagccctgttccccatctgggacccccctgtctccttaactagccagtgctcatattttttaagtcctagttttcccgctagtcagcagtagagtgtgggcatctttctgtgtcccaccgactgcgagctggagacagcagtggtacctctctcgggggggttctgaggatcgaatgaggtcatgtctgtgaagcacctggcccatgagtgctacgtaatgtttgttaaataaacatacgaccttctgaggtctttctggggtaggcaaccgtttaccaccctacagggtgtgcctcggtcagcttttcacggtgagataggtcttcgcccttttttcatctgaaatgtaaccggttttctatcttctgtttctcttctatttgaggagcagaagggggcctgagcattcattgtttgttttcccagaccagtgaagttttcgtttgaatactgttgttcagcgtcgcacagtaaaatgaatcttactggtattttttgtcatgacttgccagcctctgtccacccaacgttggatttttgccgaagactggacagcatcgttgggccccagctcacagtgctggcctctgacatctgtgaacagtttaacatcaacaagaggatgtccgggtttgtactttgctttcggttcactttcaggcattgaacggcttttgaaatacacgtagttttcacttacaaatacgggtggtattaacagtcctgtgttctcgtggactgtagaggatggtgctacgtgccattcaggcctctgtctgaaagggtcccggggacagtcaccctgagtgtttctgccccacgctggcagctggggctgggccttctggtaaataccttccctcagctccccccgaatggaacgtcccatttcaccagcccagattgttacgttcacttggacagtagtcatcggcgtggtcttggtgtgcacagactgaaagcattttgcctctcgttgtgtgaaaatgtgtaggggaaactggctgggatgtggggcactgggcctgggtactcagtctggcagcctgaagtgtctacactgagtgggagaggcgggattcactcctccggctctctagacactgaaatgtccttgaattctttctccctggctttttttttttttttttgagacaaattcccactctgtcgcccaggctggagtgtgcagtggcttgatcttggctcactgcagcctccgcctcccaggctcaagcgattctcatgcctcatcctcttgagtagctgggattacaggcgtgcaccaccatgcccggctcctttttgtatttttagtagagacggggtttcaccatgttggccagattggtcttgaactcctgacctcaagtgatccacctgcctcagcctcccaaagtgctgggattacaggtgtgagctaccgcacccggccatgcttatcttttctcaatataaaatagttattataaagtgaaagtgaggcgatggaaagcactttgcgaagttgaagtcctgcttttaaatgggctctctacacatttgagaagttactaaaaggctgtgaatttctgcatacgctcatggtcttaatgttcatacgttgttttttgggttttttttttttttttttttaagacagagtctcagttgcccaggctggagtgtgcaatggtctgttctcagctcactgcaacctccgcctcccaggttcaagcgattctcctgcctcagcctcctgagtagctgggtgccatcatgcctggctaatttttgtagagactgggttttaccatgttggtcagactggtctcgaactcctgacctcgtgatccacccacttcggcctcccaaagtgctgggatgacaggcgtgagccaccgcgcccggcccatatgttatttctgcatggtcttgtataaccgtgggcctctaagagcgcagaagcgagcaaaggtgaaagcacctctaggttttgtacaacagtgtgtggattactgctgtcaacagcttacatctttgttgctttttgtttttattttttgagacagagtttcactctttcacccaggctggagtgcagtggcatgatctcagctcactgcaacctccagcccctgagttcattcaagcaattctcctgcctcagcctcccgagtagctgggactccaggcgtgtgccaccacactcagctaataatttttgtatttttagtagagacagggttttgccatgttggccaggctggtcttgaactcctgacctcaggtgatccacccacctcggccttccaaagtgctagcattacaggcatgagccaccatgcccagccaacagcttatatcttgacagtgctgctgaatcattgaatcctttggccgtgaaaataccaggttttcctttgtgaaggaggcaaaagtgagttaaatcggtttggatcatgcaggttatcaactaacagatggaaagtgacaaagtgtagtgaccatagagaacgtgtcacctgttttgtttttttgtgggtttgtttttggagacagggtctcctgctgtcgcccaggctggagtgcagtggtgcaatcatggctcactgcagccttgacctcccaggctgtaagtgatcctcctacctcagcctccccgggagctaggactacaggtgtgtgccaccacgcctggctaatttttgtatttttggtagaggcggggtttcgccatgtggcctaggctgatctcgaactcctgacctcaagtgatttgcctgcctcagcctcccaaagtgctgggattataggcgtgagccactgctcctggcctcacagagtgttttgaggatagaagcttacacccgatttaagttccttgtctacccagacaactaaatttacaactctttccaaacagtttttcttgtcattatactttccttaaccttagggaactatgaaaacaaattctggttttataagaagtttctttacatgttcctggaaactcaatcctccacgttctttctttgcctggacgtagagtatttcatgagtaccccattggtccggaggtcggatttctggtacccccagccctccagaacgtggctgctaaccctgaagcaagcagaggaggcctctgagcccaggggcggggctgtgctcaggccccatccaggccccagggtggacactgagggtgcagggaggggaggggaggggccccaggagcagtgaggcccagcttttcccactaggtccccgaggaggtcacagactctgacctgggaggcagcgtcgtagcactgcctagtcagtttaagaaataaaaaggtacatcccatttaaaatgttcatcagactgcagtggaaaaggcgactgcgttttacagtgatgtccactggggatgatatgagggaaagcttcgttacatagtgtcgtaggcttccctcatgaggcaggttaatttccacgggacactcattccccgcactgtgggaggaacgaggtgttactctcctcaagcaggggtcagcagacttttacggtaaaggacccaataataagtatctcagatgtcacgggctgtatgtagatacgtgttaaaactactcaactgtcattttggtgggaaagcagacagacaacacatgaacatgtggcaatggcgaggttcccgtgaaactttgtttagaaaaagagggccagggccgggcgcgggggctcacgcctgtaatccctgcactttgggaggccaaggcgggtggatcacaaggtcaggagatcgagaccatcctggccaacatggtgaaaccccgtctctactaaaaatacaaaaattagctgggcgtggtggcgggcgcctgtaatcccagctactcaggaggctgaggcaggagaatcgcttgaaccagggaggcggaggttgcagtgagccgagatcgtgtcactgcactccagcctgggcgacagtaagactccatctcaaaaaaattttaaaagaagaatctagttgtatccggcccgagtgctactgtcttcgtgacatgttttcacaggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccaggtgattccagccacttctccaatcaggcgtcccctttctaagacgagaaaagacacagaaaatcccttcaagccctttccatggggttcaagcgtgaaccaccttcatgggcgccgcttccaaacagacccgggagccctgaagtcaccggttccctcgcgcggcactccctgagccttttaaatgccacgtgcgcccgttccatttcctgttcttggtttggaacgcttattctcacagtctggccgtatgagtaacgaacgattgcattttgaccctcgtcttgcagagtggatgaagatgaggagatcattgtgaaggccatgagtgattactgggttgttggaaagaagtctgatcggcgggagctctatgttattttgaatcaaaaaaatgcaaacctgattgaagtaaatggtaagtaggatttggtatttcaggagaatttgagaagttgtcttttcattgcattaagaaacatggttaaaaaataggtaaatagaacaaatcatgactgttgagattctaagcaggtgcctctgctccacatttgatccattttctgttccttggaaaactatgacaagaccttcctgtagcacaggaaacttggcaatggcagaaagaaaattattttctacaattctaaaaaaaaaaaaaaaatgactttatattaagaaatgtccccctttttttggagacaggttctcactttgtcacacaggctggagtgcagtggtgcaatcatagctcaccacagcccccaactcctaggatcaagcagtcctcccacctcagcctctagagtagctgagaccacaggcatgtatcaccaaggcatgtgtcaccagacccagctaatttctttttttttttttgaaacagagtcttgctctgtcgcacaggctgggctcaaactccaggcctcaagtgatcctctggcctcccaaagagctgggattacaggcgtgagccaccttgcccagcccaaaatgtccttttttaatatcctgtgataaaaacatatcttttgtagggagaagctgccgggttcacgtagccgtttacaagtatccctctgtacacaggcagaaggaggcagacattttctcctgccttcccgccaaagcggccagccttgcccactgcacggggtgacccggcagctgcggtgctgatagctcggctgccctggagagaggggacctcacctcggcagagctgcccccttgggagatgccccacgtgtacactgtgtggaaattcagtgtaagcgtttttttccccttgtatcttgggcatactacatttttctctttattagtaatacctgtgttagtcattgtgcgcactagaaacatcagttaatgcaagcctgatctaaactgtgaatgtggtaagatcaaaatcctgacccctctgcggagcacttggtctgcagctcaaggttgctgtccgtttctttgttgttccattagttgtcccaggatgacaaccttgtgcttggtgtgtgtcaccagccttgtgcttctaaccccctcccctgggtgtcccgggcactttgcagtttctcaggccccgggcagcagtgttgataggctcaaaactcctgaggcctggtaggttttgtaggtggattttttcccctcttctacttgttaacatttcttggctgggcacagtggttcatgcctgtaatcccagcactttgggagaccaaggtgggcggatcacttgaggttaggagttcgagaccagcctggccaacatggcgaaaccctgtctctaccaaaaaatacaaacattagcagggcgtggtggtgtgcacctgtagtcccagctacttgggaggcagaggctgcagtgagccaagatcacaccactacactccagcctgggtgacagagcaagactctgtctcaaacaaaaaaaaaaaaaaaaaattcttgcctagtcttctgggatttaaggtcaaaatcaatgcaaatctctcttcctaattttacccaagaagaatttaattatatatcatgtaaccttttaagtgactgcctcttccttcctcactgttgtgtccttgttgcagaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaa

SEQ ID NO: 2389 - DNA, 18193 bp, Homo sapiens
  source 1..18193: mol_type = genomic DNA
acttctccttttgctctcagatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcagtaaagaatcttacttaagccaggtgcggtggctcacgcctgtcatctcagcactttgggaggccaagttggggggatcacctgaggtcaggagtttgaaaccagcctggccaacatggtgaaaccccatctctactaaaacaaacaaacaaacaaacaaatcagacgggtgtggtggcacatgcctatagtcccagctactcaggaggctgaggcaggagaatcacttgaaccctggaggcagaggatgcagtgaactgagatcacaccactgcacttcagcctgggcgacagaagaatgagactctgtctcaaaagaaaaaaaaagaatcttacttaactcttttaccctgcctttctcaagtgtatgtgaccttgaagatgttttttgcatgtgacatgatgagtacctgcggggctgatgtcagctctgcctggggaatctgcctcagcttcagaccctgcaccccaaattcatgcttagcccaggccagacccccttcctgctgtcggcaagcagcttagctttccgcacacccatgaacagatacccagcagcctttggcatgagccatgtggcccgaggagataaacagacagagagaggaacattgatgcgtgtgaaatgttggcaggtgagtgggaggggcttgggttggtgctgagaccggagacacactctgctgtcacatccttcagggtccccgggggccagcacggagggccatgatcatgtaaattgggacttaaatttaactctatgtaaatataactctatgcagaggtcagggatggtagaggacaagctcactgcagagaaagaaagaaagatgggcaacagttgcagaacctaacccacagataggttttgtttgaccagctctgtacatttttagtttattttttatctttttgagacagggtcttgccctgtcgcccaggctggagtgcagttgcatgatctcggctcattccaacttctacttcccgggttcaagcaattctcctgcctcagcctcatgagtatctgggattacaggtgtacgccaccacgcctggctaattttttgcattttgagtaaagatggggttttgccatgttggccaggctggtcttgaactcctgacctcaagtgatctgcctgccttggcatcccaaagtattgggattacaggtgtgagccactgcgcctggctcacccatactttgttactggttttagaattcctttttacctggtctttcaaaccaagttttgaccatgtctgtccctgagtataatccttgatgagtagcaccagagagagctccacgttacccggggcctggcattcaaagcactcagtggtctggtgccactcaaagcctgtgagccaggcaggaagtttataaaattagagatggatgaatggatggatgggaaaaagcaagcaagggaggaaggaaggaagaaaggaaggagttctgggaagagagagaggctgcccccgcagggctctcagtttgaaggagaggtgcagcacactcagaaaaaactcccggccaggagtggtggctcacacctgtagtgccagcactttgggaggccaaggctggcagatcacctgagatcaggagttcaagaccagccaggccaacatggtgaaaccccatctctactgaaaatacaaaaatcagccaggcgtggtggcacctgcctttacccagctacttggggggctgaggccagagaaacgcttgagcctgggaagcagaggttgcagtgagcggagatcacaccactgcactctagcctgggagacagagcaagactctgtctcaaaaaaaaagaaagaactccgtgagcatcccaaatgccacatccccataatgcaaccagacccggtcctcccggatccaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctgatcactgtggtgagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctggtaaggccttcggggagcgggtcctctgctctgggcaggggtgagtgggaggcaggaaatacctgactcctggcacagagctcacaaaccgagcttcctgcagagctcaggcaggggacgccagcggatgacgatggcgatgcagcagcactagacagagctgcgggacctcggatgtcccatctgaccctcagttcctgcccctctgggacctggattccaaagttatcggatctcctgatctttccctctttctttctcaccatgtatttttcagcttttgtgacaaactcgtgtttggccttagtactggaaccatccaagcaccgcattcctttagtggggtgggtctgcatgtaaccagcctcagctctcccccaggctggaccgcccccttcagacattggggtctgaagctgcatcgctcaccccaaacttagggctgctcagagctccctatagaggaaactgggtgtggaacggagtaaccacactccctagggcagaggccccagacctgtgtttgatgggtcaaatccacccctacatgtgcagtgccataactgagcctgtgttataaaaatcataaaatgtttgttttactttttttcctcttcttttccccttccccttcctttccctttttatgagacagggtctcgcactgtcatcacccaggctggagtgcagtggcgcgatctcagctcactgcagccttgatctcccgggttcaagcaatcctcccacctccaaagtagctaggatcacaggtgcatgccaccatgcccagctaactttttaatttgttgtagaaatgggtcttgctatgttgccaggctggtcttgaactcctggcctcaagcaatcctcctgcttcaacctctcaaagcattaggattacaggcatgagtcaccgcacccggcctgatcttctgatttttcaagagacgatggaaatctagattttccagtgaaatctcccagcatgttaatgttcatggcaagttctcatgagctcttcaaggtcagatgacactgttgttgaaccccaaaggccaggtttgagctcccgatgcgtagtcagccaaacactgacacctcagtgcttagaagctgagataggattatttaatttagccaaagcaaggggacagaagagagaaactctcaaatctgacctgactttgagcgttagtgggggcttttatgagtaaagtaggtgtgcaggaggtgacctcccgatcgtcaaagctgttgtgcccctcggctcatcaaatttctggatgtcatcaaggaggtctgtgtgacctaaggatcattgttctttgaaagagagacaagttcatttatcttgcaggcagctgccagggagtcaggatgtaagttaaacaattatgagtgaattaatggttacctgctactgaaatgaccaaatgtaactaatcatgcatggaggaaggaaaggacaaagagaaaagaaaagaagtaaaacgaacatcttataatttttataacataggttcagttatagcactgcacatgtaggggtggctttgacccatcaaacacaggtgtggggggcccctgccacagggagtgtggtcactccgttccacaccgtttcccggatgggcagttctgagcagccttaaatttggggtgagcaatgcaacttcagaccccgctgtctgaaggaggtggtccagccttggggagagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacgcctgtaatcccagaactttgggaggccgaggcaggcggatcacaaggtcaggagatcgagaccatcctgactaacacagtgaaaccctgtctctactaaaaatgcaaaaagttagccaggcgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgtttgagcccaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcaggagttcaagaccagcctggccaacatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaacctactaggtaccaggccttattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaagaaaaaaaaagaaggtgagcacttaagctgactggaacggagggagtggctgaggccggcacatatttgggagaggaggatttcagggaaagagaagggcaggttcaaagctttgaggcagcagctgggtgggaggacctcagaggctgaagttcaccgcctctgagggccacatggtaggacaggaggcaggagatggagcaggactctggatcccgagggctgaggtgagggtttgggattctatgcaaagcacagaacccgctcgtggtttccagcaggattggcgaggtctggtagatggtgttaggaaccctgcgtgctgctggtggagaccaagaagtagaggaagtgggagggggaagctgagagccgagttaggaggctgtgaccatcacctgggtgaagggactggcaggccatggctttgtcagaataaaagcactttccacaccctccaccctctgaggattccccgccccctccccgactgcccctctgctcctccagacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtgtgagcccctcggagctggggacaggccaggcagggaggtagcaggggtggacccggagaggggagccacgggggctctcggggccgtgtgcacaggttgggggtgctctcctcacccctccactcgcctctgccccctcttccagatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtgtgagtagccacggagcctctggttctagggagagaagatggacacagggaacggggaaggcagatggggtgcagggcattccggggtcctggagtcaagagcaaggagcagccagggtctcctgttcacaactgctgtctcagctcctagcatagggcctggctcatggagggtgcttggtagatgcttgtttttttgtgttttagttttttttgagatggagtctccctctgtctcccaggctggagtgcagtggcacaatctcggctcactgcaagctccaccttcccgggttcatgccattctcctgtctcagcctcctgagtagctgggatgacaggcgcccgccaccacgcccggctaattatttgtacttttagtagagacggggtttcaccgtgttagccaggatggtctcgatctcctgacctcgtgatccacccgcctcggcctcccaaagtgctgggattagaggcgtgagccaccgcacccggcctgtagatgcttgttgaatgaatgaggccaggtgcggtggctcccgcctgcaatcccagctctttaggaggctgaggcaggagggtctcttgaacccaggagtttgaaaccagcctgggccacacagcgagataccatctctacaaaaaaatacaaaaattagctgagcatggtggtgcgtgcctgtggtcccagctactggggaggctgaggagggagaatcacttgagcccaggaagtgaaggctgcagactgaactatgttcctgctactgcactctagcctgggtgacagagcaagacctgggtctcaaaaagaaaaagaaaatgctgggactgggattataggtgtgagctgggcacagtggctcacacttgtaatcccagcactttgggaggccaaggtaggcagctcacttgaggccacgagttcaagcccagcctgggcaacatggtaaaaccccatctctacaaaaaaaaattagcctggcatggtcatgcatgcctgtagtctcagctacccaggaggctgaggtgggaggatcacctgagcctggaagtagaggctgcagtgagcctgtgatcatgccgctgcactccagcctgggtgactgagtgagaccttgtctcaaaaaaaagaatggattggccaggcatggtggcttacgcctgtaatcccagcactttgggaggccaaggtgggcagatcacctgaggtcaggagttcgagaccagcctggccaacatggcgaaaccctgtctctactaaaaatacaaaaaattagccgggcatggtggcaggcacctgaaatccacctacctgggaggctgaggcaggagaatcgcttgaacccaggaggcagaggttgcaatgagctgagatcatgtcactgcactctagcctgggtagagtgagattctgtctccaaaaaaaaagaataattaactgcaagataccaggactccatgagggacacagagacttagcgtccctaggcagtggctgagtcttgagagatcttgaaatttttaatgagaactggggcaaactgtctcattacctctccattgtaagacccttttaacacagtgaatcttgttaccatgtagagcacaggacaaaaagaacacataagctcgatccttggaccctgagatgtcatatgtgctaacaggacaggggtgcccaaatcctgagcatctcagacagctggatgcgtgaccacagcagccacagtgatgtttgtggagtgtttgccacacgccacactctgctctaagggagtcatctcatttccttcttgaaacaattcccaggaggttaggaactctcaggactcaccccccacccaccccgcactgcctcttgtttttaagatggagtctccctctgttgcccaggctggagtgcagtggcttgatctcggctcactgcaacctccacctcccgggttcaagcgattctcttgcctcgaccacctgagtagctgggactacagacatgcaccagcatgcatagctaatttttaaaatttttagtagagacagggttttgctgtgttggccaggtctcgaactcctgacctcaggtgatctgcccacctcagcctcccaaagtgctgaaattacaagcgtgagccaccatgcccggcctcaggaccccatttgacagacgtgtaaactgagacctgcagcccatgcccgtgcgcctctcagcagccgtctggcttcagcgctgtgccctgaacccctgcaccaaaccacagccaggccagagagccagggcagggtttctgttctcacacagatgcaggaaggacgcacaagcccccctttgattaatttaggacctgtgcagatgcccgggacaggtagcgggagaagaggaagcaggagggaaggggtactgtggacagctggcttttctttactcacctctctggttttcttccagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtgtgagtccctgggctaggcagggggatctgggaggtggcccggctgggatgaggggatgaaggcaacgaggccggagcctgggccagtgtcttcaacagaattgagggacaggagcctggcgtcagggccaaggggaggggaggcctggggacagcaaaagggacagggagcggagaggtcagcttgggacccttgccctccagatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtgtgagtgagggccggaggctgggagtggagcagagaagggaccagtggcctgcctggtagtgacttcgcaccccctccccctgcccgccatgcagatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactgtaaggcctcttcctgctcttgttcttcttggtggtggtcagtccttccttccttccttccttccttccttccttccttccttccttcctttctttctctctttcttttcctcctcctcttcttcccctcctcctcctcttcctccttcttcttcttcttctgctttctccctctcctcctcctctttcttctccttctccttccttcttcttcttcttatagagacaaggtcttactctgtcacccaggctggagtgcagtcgcataatgacacctcactgcagcctccaattcctgggctcaagcaatcctttcgcctcagcctcctgagtagctgggactatagacatgcaccaccacatccggctaatttttacatttttgtagagatggggtcttactatgttgaccaggctggtttcaaactcctgacctcaagtgacccttctgcctcagcttcccaaagccctgggattagagccatgagccactgtgcctctccctgtttcctctcatgctcctctctggccctgtctcctccagtgacttcccgaaaagccttccagaccagctggccccttcttccccacctcactgtcccctttcccattcacaccccttgctccaggccatctgccgctgtgctggaggagtcgtcttgtcctgcgtcaccagtctctctttttctacctcccctgcagtctctcctgcctccctctagggtcccctctcaggctgctccaccttccagaagtcctgagctcctactgggtccctgtctctctctctctgactactctgtctctctcagccctgacaggctccttgtttttatcttttaaaacgtaaatgattttttttttaaacggagtctcgatctgtcacccaggctggagtgcagtggcgtgatcacggctcactgcaagctctgcctcccgggttcacgccattctcctgcctcagctccccgagtagctgggactacaggcgcctgccaccatgcccggctaattttttgtatttttagtagagatgtggtttcaccgtggtctcagtctcctgacctcgtgatccgctcgcctcggccttccaaagtgctgggattacaggcgtgagccaccgcacccggctgattttttttttttttttttgagacagggtctcaccctgttgcacaggttggagtgcagtggcacaatctcagctcctgcagcctcgaccccctaggctcaagtgatactcctgcctcggcctccacagtagtaaacttgagtggtttttaaacagatcatacaagcacctggtaaaaaaataaaatgtaagcatgaaagggtaaatagtggaaagacagacgcggctcactcttgatccctgagaactctcatccccaccaaaggtcctcactgcacacagtcttcccatctcactgcacacagtcttcccatctcctccaggggtatttttcacacgcacaattcacacacagaggtctgtgcctatatacccttcctcatgacacagacgaggcagagcccacactttgcctgggaattttctttgcttttttccatgtaataatactgtttggacattgttctgtatctatgcatacacagagtgtctaaagtctggaggctgggcatggtggttcatgcctgtaatcccaacactttgagaggccatggtgggaggatcacttgagcccaggagtttgagaccagcctgggcaacatagcccacacctcatagcaggatctcatctctacaaaaaataccaaaaaaaattttaaaaacgaacaaacaaaacaataacaacaacaaaaaagagtctgaaagcatatggaagatacctaattaatttattgtactttttcagattaataattggaaacatggccttaaattgagggaacctgaccaggcacagtggctcacgcctgtaatcccagcactttgggaggccaaagtgggtggccacaagcactttgggaggccacaaggtgggtggatcacttgaggccaggagttccagaccagcctggccaatggtgaaaccccatctctactaaaaatacaaaaattagctgggtgtggtggcgcgcacctgtagtcccaactactcgggaggctgaggcaggagaatcgcttgaacccgggaggcagaggttgcagtgagccaagatctcaccactgcactccagcctgggtgaaagagcgagactctgtctcaatcaatcaatcagtcaatctagggaaccatcaccagcacggccgaaggccaaaggaaaacatctgaaacatgttatctggaaatgtaacagacacatcccatcatataaaaccattgttccctgggtatcccctttgcagacagcctgagagcctcctctttttcctggggccatggagtcctcgcgtatgaaggttgcatacatcctcctcccagtgccctcttcagggcctaggtctgcagcctcttgttttgggcacgcctgcaaggacagttgcaagatgcattcccatgtggaattgctgggtggaagacaggtgcactttcagagctgatcacacagctatactgccgtgaagagctgcacccatttatgcgggtgcgggtcacaggctctgggcgtgccacgtctgtgggaaaagcagctcctcaggagaattagtgccttattcctaaagggaggcccagagcaagcaggggccgttgtcaccctcttcctctgcacccctgcacgcatgcaggggagaaggacgagtctggctgcagagagaagtccaggatgccttccaggcaaaggctgccagggagagctggcccctcagttgattaaggtctctcctttctccacccagatagcccggagaccatcggcaggcgagtggctgtgggactcgggtcctgcctcgccatcctcatcctggcaatctgtgggctcaagctccagcgacggtgagctcctgccatcccccaccacctcctctatcccttggcagaggcccgtgtccagttgctccatctcgaagcctccagcctgtggagtccctgaccctcacacatgtgcctttatttctcagttggaagaggacacagagccagcaggggcttcaggagaattccagcggccagagcttctttgtgaggaataaaaaggtaggatggggctgggcacgatggctcatgcctgtaatcccagcactttgggaggctgaggcaggtggatcacctgaggtcaggagttcgagaccagcgtagccaacatggtgaaaccctgtctctacaaaaaatattttaaaaattagccgggcgtgatggtccatgcctgtaattccagctactcgggaggctgaggcaggagaatcgcttgaacctgggaggcagaggttgcagtgagccaagattgcgccattgcactccagcctgggtgacatactgagactctgcctcaaaaaaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaaggcccccactccctgggatgctacaatccaatgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagtccgttcttatcacaaagatcaagacctcatgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggagggtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctggcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacagggagacgtacgtatcagcggccccttgactctggggactccgggtttgagatggacacactggtgtggattaacctgccagggagacagagctcacaataaaaatggctcagatgccacttcaaagaa

SEQ ID NO: 2390 - DNA, 18193 bp, Homo sapiens; identical to SEQ ID NO: 2389
  source 1..18193: mol_type = genomic DNA

SEQ ID NO: 2391 - DNA, 18193 bp, Homo sapiens; identical to SEQ ID NO: 2389
  source 1..18193: mol_type = genomic DNA

SEQ ID NO: 2392 - DNA, 18193 bp, Homo sapiens; identical to SEQ ID NO: 2389
  source 1..18193: mol_type = genomic DNA

SEQ ID NO: 2393 - DNA, 20065 bp, Homo sapiens
  source 1..20065: mol_type = genomic DNA
ggcgcaacgctgagcagctggcgcgtcccgcgcggccccagttctgcgcagcttcccgaggctccgcaccagccgcgcttctgtccgcctgcaggtagggagcgttgttcctccgcgggtgcccacggcccagtatctctggctagctcgctgggcactttaggacggagggtctctacaccctttctttgggatggagagaggagaagggaaagggaacgcgatggtctagggggcagtagagccaattacctgttggggttaataagaacaggcaatgcatctggccttcctccaggcgcgattcagttttgctctaaaaataatttatacctctaaaaataaataagataggtagtataggataggtagtcattcttatgcgactgtgtgttcagaatatagctctgatgctaggctggaggtctggacacgggtccaagtccaccgccagctgcttgctagtaacatgacttgtgtaagttatcccagctgcagcatctaagtaagtctcttcctgcgctaagcaggtccaggatccctgaacggaatttatttgctctgtccattctgagaacccaaaggagtcctaaaagaggaatggaggagcctaagaataaaaatagtataataaaacatttcttagacacattgaccttggcctatgtcaaagttcagtctgggtttgtcttataacacaaggagtaaaagtaccattgttctacctctttttttaatacttgaaaaaaatttactgtggatgcttttctatgaattaaataaccttctaaaaaatgttttcattgctgcattcgattagattgggtaactaaatgaaattaattcctcactgttgggtataaaggttatttacagtggttctgtcttagccattcactgaactcattgcatatatatctctggaatattgctgattgtttccttcaagtaaacttagaagtgtaactacttagtcaaagagcctgaatattttaaaggccttttgaagaaaactgaaaatgctttccagaaaggatgtatcagttgacaatgacagtcgtcaacagtatttaaggagaactatgatactctgaagaaaaacttagcctttctcagtaaaagtaggtaggcagaggccacatgacagcagttagagtgtggtcttcaaggaagtcacagaaatactgtggggaattgaaaccccatgtggaaaatgtacaagagtgtctcagtgtgactgagaaggaggttgggcatggggtttcatggagtttaataaagtttggtcacttagtagaggtttaataaatcaactgtcttaatctttgatcctacttaagaattttttttttgtttttgtagagatggggctcttgttatgttgcccaggctgttctcgaactcctagcctcaggcgatcctccctcctcaggctccagaagtcctgggattactggcgggagccaccatgcaggcctcttgctcctacttttgagaaaggaagtttaaccggttttttttgtctttttttttttttttttgagacagagtctcactctgttgcccatgctggagtgcagtggtgcaatctcagctcactgcctcccgggttcaagtgattctcctgcctcagcctcccgagtagctgggactacaggcacctgccaccacgcccagctaatttttgtatttttagtagaaatggggtttcaccatattggccaggctgatctcgaactcctgacctcaggtgatccgcctgcctcggcctcccaaagtgctgggattacaggcatgagccactgctcctggctgcttaactttttctctatctcatcctcctacccatcctacccttggaagatagagaagtagtattagttccatagtgttatactgggcttcccccagggacaaacccacttccccaacctgaatgagccatcacttcttccccagtttacatttcattgctctttaaatgtctccattcggatatgggaattcacatatggtcataattcttacctgaagaagatgtcagtcttcttctcttagaccaactgccctgatatgaggtttagaggttaaagaacatgtgtgtatttacatgatctttgtattctgccttttcgtccctcactaatgacagctgcaccccaaggaaatggagctgtggaagagagggtttgataagaaattaagtaaatattggatctaatccatcaccctccaggaagcctttattactcctaaaaatttcaaccaaattcattaaaggacaagaactccaccagagtaggccataaacattggcaaaattagttgtaatccatgactagatttaatgtccctttgttttattcccatatggttataatgctttgcttggcattaggggtattttaagttttcttctgcctagtaagtgaatttgtgtttataatacaataatcataaaatatcacattaatattttataactgtacagttataaaatattttataagtaatatttatattttataagtaatattttataactgtacagttaactctggcccaaggaaaagatagtctgatagatgctgcagccccattttagcaaatgtgacctcacaggcctgaatgccatcgctattccacatctacaggatagacggaaaggaaagaaataaaaaaataggtacctaacactggcaagaggatgatgactcatgttatttcacttaacctttttatcttttaacatgaaggactcatacaggttgataagaaaccagtgacataaacagaccaaaaaatgatcagatctttcaaattagcaaaaaaataatattttttaaacaatgggtgaaaatacagtgtaacagtaccaattatcaacatgtgttgagaaccagaaaaatgttctttttctttgatcagcaacactatttgggaaaatctatcctcagggcctagcctggggccctggcacacagtaggcactcaacgaatatttgctgaacacacaaatacttatgatattttaaaaaattggcaacaatctgatacctaacaatagagggattaaatattatggaactgttaaataagatgcttatgaataccatgcagtaagatgggcaatatttatgccataagctttaatgaaacaaatgggtattaaatgtatgataaggttataaattactttttaaaagattacagggaaaaaaattgaaagatatacactgaaatgttttttgctcacagtggtgacaaggtttctcagcactggcactgttgacgttttaggctgtatgtctttgctgtgggaggctggcctgtgcactgcagggtgtttggcagcactcttggcctctgcccctagatagcaatagcagtcctccctcaaccagcccaattttgacaaccaaaaatgtttccaggcatcaccagatgctccctgggtgagagtgatgaaatagtaggggattttccccttcttttcttattttctgtaattccattatattactttaataataaagaaaaaaacataaaaaataaacgaatgttattattctacgtcagtttggatgtttggactccattttggggttctttccattatatcacttggtctgctaaacattctacggtttggtaaggtgaagtgattcatgaaattttggttttatttttttcctgatactaaaaataaaacattctttcacttggaaatttggacacagaacaccaaaaaaaatccataatctcatctctctttttctgtcttttccttccttttttccctttaaaaacaataaagagtgaaacctacctgttctccctctaatttaattcctaaatataatcactgtcaatatcttggacatttcctgtgtctaaacacacacacacacttttttttttcagcaaaagtggatttctgctacatgtagtgttctgcaacttactttctatgtgtttacaaaatcagtacatgtacatatgctgaattcagtccttaatggtattatattttgtgaatataccaaaatttgtttaaccacttagacaatctaggatattctcagtttgctgttatgagcaatgctcttcctttacatatacagacatatatatatatatgtgtgtgtgtgtgtttttgttttagtaggatagatttctaggagagggtgaaaggtcttatgacatccgcatttacgattgtaataggaagtatcaaagtgccccctaaagaaaaaaatcctcccattagtgggtaagaaagcctatttgttcatatcttcacaaacactaaatattagaaatatttacaattgtggtcaagctcataagtgaaaatggtatttcatatcttatattttttattgtgagattgaacatctttcatatgtttacatgtcacctgtatttcttattctctgaactatatgttatgacctttcactttttttcctcatgggttatgtgtagtttgtatagttgtcttattgattgttaggagctatttatatattaggaacattaatctcctgtcttatatatacgtggcatcgattagttgatcatttgtgagttcatgtctgtatacaaagattggagaggcactaagagggaaaacttacctctttcttatcaaagtttgtaaatatatgtataacagaagagggagaaaatattaataaatgcacagattggctgaaatagagtataaatcttttactcccctacttcaacataaactgcaaaaggagagtgacttttctttcactctgacttccgtattcctcatgcttaaaatagtgcctagcacagaagaggtgctcaatcagtgtttgctaaacgaaataattagtcacatttcaagcaggatgactaaatgaagaatagaatctaggcagatactctggaagagtggctgtgagtcattcatatcttagtatgaattagtcaaatccaactctctccccttcccactccccactgttagtagaagaatctgtttattgagagaatagatttataatttagaataagtgagaggggcagaagaggagattttgaaggatggcacctgaaggaggactagcatggctgagacagtgaagtggaagccttgaatagctaaagggtaagatgaaagtatttagctgtagggggaaaaagcattgacaggttggaaaagtaaaagtcagattctccttgctctgaaattttgtacagggcaggttctactaggtatgttacaatgcagaaaaaacatgaaataattgagaggaatttggtgcaatattatcttcttggcttcttttgagtgggcagatttttttcacggcctgtaactataataaatttgaaacttctcatcttttagtaacttttttcacttaagtttatgtggctgtgggcaatggaatgaagatattgaacttccaattccctgttgggtttccacaattacaagtcaatcatgactggttattagaagactatttcagttagaaccaccaagtcccatattgtcatattgtatgtttaattattaagtgaagcagtcttcttttcgtgttttccataattagggcattccagaaagatgaggatatttgctgtctttatattcatgacctactggcatttgctgaacggtaagacaccaaatccttccattaggttctatattttaaatattttaaccatgagtttaaaactaaaatgatcatttaaaatgcatgcaattttcttatagagagaacattctattctttcttctactttacacaatggcaaagtcttctttctactttacgcaatgataaagttacctgtgtcattttgtaaaaatatagagaatatagacaaattgaaagacacaaaataatctattacccatttcccagggttaactactgaaaatatctggggaaatggcctgtatgtatacatttatttgtttgctttcaacaaggccaagatcctttgatctttcagtcttggttgctctgtgacatgcctttcctgatgaggatactttaaggaagaattgtaagatacatggaaaatgtcaggctaacacagtactggcatcaccctgtgctctttcctgaactccataccaatgtacttcttgccagaaaactgatcaaaagtttagggaagtaaaaagagatgactgttagaatctaccattccctctatgtaggaagcaaataggtgtcctgtcaaaggacattctggggatgtctacatgaaaccaactctccctggttgtaaggactccatctccatataatatttatacagtaatatatgtttataaattgtgggggcaacttgtttagctaattttattattctgctattgggacactgtgtctcagcatgagatatagtgtcccaaaacatatttcaagcccattggataaaatatgtgtttagcaagttcttaaatataatgataacataaccgaccagataaagtgatttataaacgctgtgccaattttgtaaatgtttcgaggaattttcccttttctgaagattgtccttctttctttttagcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatggtaagaattattatagatgagaggcctgatctttattgaaaacatattccaagtgttgaagacttttcattcttgtaagtccatacttattttcaaacagaacagcatagtctgttcattcattcattcaattcatgaattcattcacataattatccaatttcttgagcacctatttgatagtcactggaaatccagagacaaacaacacagagccatgttctacagtatgtacagttttccaaaaagaatttctagtctttacttttttattacaaatggaatacgtatacttgcaaataattcagatactgtggaagagatcaaatgaattgcaaaagtgtccctcctcccttcaccactatctcccatggcatgcagagagagtaaccattatttgtgtgtccctccagaaatttttttattcaactactatttttttattttattaggtccgtcagttttccttttttgagcctctctatatcaaatgcaaataaatatattcagaacaaaccccactgtaaggttcacattaaaaaagacttgaagtcaccctatgaagacaaaaaataatcacattaagtgtgaaagaacctattcttccagtacaggataagccatacttactgggcatatattcatcttgaaaatctatactgatgttgtcttggggaattgaaaaggaactaggagtgttagttcctcggtattgacccacagttatgttatcaggtcacttgagttcaaagttttgtgttggcactagctaagtaaaggaaaacacctctgctttcattgttgagtttcacagaattgagagctgaaaggatcccaggcaggagcagctaatccaaactcccacaaagaacaaaaatcccccagaggatcttctgttcttatatttcctgcaatggcgtccctgtcatatcccacaatggcctccctgccatttggatatcccttccatatcctgttgaaattactccctaatagtaagctgaaatctgcccctctagttgtagtcttgggattatttcatttacatgatgaccttttaatatttgactagaattaaatcatctccccttggtctttccattcctgggctaactaccatcaatctgagggctaacaatacaagtagaaaaagtatacatttgtcactgatcactgatcaattattaatcaatgatcactgataactataaactcaaaaacaaaatcatgtggggattaagagaaatgtatcagttttatgttgtatttctggtccctgatactggctcaggtaatgccactattgtcaagaagataccacttgtaaagtagatttaattttcattatattttaccatatgcttctccattcatgacatctcttgagatgttgtggtttatactttcagtttttctccagtccatccgcaaatatcaggcatctactgtgttccaagatattaaagaaatcatcatgacttagcctcatcaacagcattgctagatctgggatggaaaggaagagtataatcctggcagtcaggaagaaggcagcataaagtataagtttctgcttccaaaaaaggtctctcatcagcctgtagggagtgtgtagggaagggacagctgtccttgtagtagggaagggttttattcaggtcgtctgggctccataatatcccttgtgtatctgcagtctcctttgccatggatcaacacaataggaaatcttccggcactgatggtttttccaagggggagttcttcctggagcaaagcaaatgaccaaccaggtttgaggacctgatttgtttgacaattccattttgtattgtaaattacttaattggcattctactcccaatccatcttgtcatttgcatacagtggttttgggattgagttcagctataccaaaagtctgaaccttctgcacttagaacaaggcaaccaccaagcttcacttgcactgaggccgtgtctccaatggaaatgaggcagctggcttgcaggagcttcccaactcagggaagtagaactcctgagtcacctccatatgcaaatgatttcacagtaatgctgttgaacttcacttcccatcacagcaaatgtgtggtaacatagcttccccacaggagtttactcaccatggtattttaaaggtgaaacatttcaaaactgaaatttgaaagaatttagttttggattcactcaattatcactatcacttcgggtgttattgcacctttcttgtttgtgagtttaaatgccagactctcaggccactaactttcaattaaaagtgtttttctttaatcgctgaacctaacagcagggaaaacgaaatgttcattcagactttcagaaccttcaatgagattaggcagctgaaagatcaaagtgttgcatagttgtcccgataaagctatttggatcatatggaccaaatcgactgctgtcattccccaccaaccccatctctccccaaaattcccagccctgtttaagtgttctctgtagcatttatctctatctagtatattgtgtagcatatcatatcatacttttctgttttgtttattgtctctctcctcctagaatataaactccacaagcacaaagatttgggcctgttttataatattgttgcatccccagggcctgatatacagcagagtggtggtacgaaaagagcacacaaaaaaatatttgttgagtcaatgaatgaatgatttcctcaaataggattagcctaaaattttggaaacatgaacagatttggatatgtgaaaatttatttccagactgttcatcaggaactgttagcagcttctaaagggtacactggagcagcagtagtaaaaggaggaagaggagcagctctgctactgctactatcgagtactactacaattagcacttgcttattctgtgtgttaggccctgtactgaacactctgtctaaattagttcatttcctcctggaaatgactctagggggtaagtgcttcatcatgtaagatgagtatttttcacattttgttgtgtctgaaatctgagtgtgtctttcaatgatggaatctttgattccatgataagtggtattattcccattttaaggatgaggaaactgaggtccaaagaaattaagtaatttgcccaaattcacccagcctagaaaatgataaagctagttctaaacccaagcagattagctctgaagtctgggcccttaataaccactttttattgcctatatttgtacctctggtgtacgtatcaagttatatgttgacttcaaaactatcatgaccttttcttggttttgattgtccaacattagtatagtgttctgggtctgcaaaaattttgattactcatctcatctgtaaaacattttgaactcgtgtgtttgtgcatgcacatttgtgtgtaattataaaaattttactttctgttaatatataagttgtatcataagaaactgccgtttttgaagagcaaaaaaaggttgaatgttaccagttacatctggttcaacctaatagacatttgtacaaaaacagacattttaagaggttgaaataaaaatttaataaacaatattttcagtttttactaattgtgatgcttcactatcattagctaatatgtcaaggcataatataccttagggtgaactttatcattaacaaaggtggatggtgtcaataatcttgaggtttgtgtttttttatataacactgcgaggtctaattaagtacttactgtttaccacctcatacagtggccgataaaaagtgtcacttctgctgtttcctctgggttgtgcttgaattattagtattatcttcagtcctcagtttctttgtgggaaactttttaattagttgtttaattttgtaagatggttagtttagtcaaaattagataagagaatttgaaaatccgtagctaccccaaagcaacctacacataagaactattatttttgtgttttgaaatcataattttattgatttccagtgtttccactggtagtggtttcattgatataggagtatcaaaacatcactcattatttatttcagtttcatttgatcctagccgttttgtattaactctctgtgaagaaattacctcacaaatctattgctgtccttggtaaaggaatggagaattaaggctctagatcattagtggttacactatagtattagaagtaaaaaaaagattataccaacaaaataagaacatgttaatgtacttgtaatgaataaacatgaataaagctcttatgctatataggtgcactaaacaatctactagaattgtcagcaaactacgtatcttaatcctgaaagggtcccaaaccaatgatctaaaattgaatcaaactttcttccttgagcataattacttaaatgatttattaaaatagccagcatttaaaagcttaaaatgtaaatatcataatgtggtatcctagatagcatcccagaacagaaaaaggatattagggaaaaactggaggaatggaataaattatgcagtttagttattaataatgtactaacgtccttagttatgacgattgtaccatggtaatgtaagatactaacaatagaggaaaccgggtaaggagtatacagtaactctatactatctttgcaacttttttgtaaatttaaaacttctaaaataaagaacaaatttaaacattaaaaagtatcaccaggaacatatatcactgtttacagatgaaatactatgtattttcatatctaatttctgatcattgacttcaaatcagaaaagtgaatgacacctcaaaatcaggttttctgtttactgaagtctaagaaaagaaagcataccagctggagagattcatgtttataaagacagatttataacaacaaaaataaaatatccaagaataaatttaagaagaagcactttactgagaaacatatgaaaacctgaacaaatggagagggatattttgtatttgaatagaaagacttctggtttaaagataattctctttaaattattttttgtagaaatttaaggggtacaagagcagtgttgtcacatggatatattacatagtggtgaagtctggggttttagtgtaaattaatctttacattttgtttgagcccaataaatgtaccaacatgatttttatagaaagatagtcattcctattaatccaaacttgtcccaactttgaattgaattgaggcagagctagcaggtgttccccacggctgaggcatctgaacattaagcatatccctctgagaaccagcctgcattgatactctttctaatgtggacagcatcaagctatgtacgtagttctgtgctcagcaaaagccctgacttctttttgtttatgtcctagccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataacactatgtttacaaaatatatcctaattcctcacctccattcatccaaaccatattgttacttaataaacattcagcagatatttatggaatataccttttgttccatgcattgtagtactcattggatacacatagaataataagactcagttcacactcttcaggaaacagataaaaaactaagaaacaaacaaaaaacaggcaatccaacaccatgtgggaaatgctttcatagccgggaaacctggggaatacctgagaggaatactcaattcaggccttgtttcaggaatccaaatcctggcacatcagagctgcttccctctttccagggtggcaggaaataaatggaacatatttttctatcttatgccaaacatgagggaccctttctccccggtgcctctcccaaggtagtctacaatatttcaactctagcagtctgcttagtgcatagaacatgaggctgtgtgtccctgggcaaattactagacttctgtgtgcttcactttccctgtaggattataatctactgagcaagcttattgtaagggtcagattagcaacagtgtatgaaaatgatttgagaccattgcctgcacaaattcaactatttttttttatctcactactctacagaagtaggtagggtgggagacagagtctgatgagaggctcagaatgtgaaagaaagtgaggcgagtgagcatgatatttaatataaacacaaagatattctgagaagagctgctcactgccccctcccccaatacatgttgataggaaaatgccacgtacttcagcaaaaacaactgaaaaattagatagaaaagtcaatcaataggaaaagataatccaggacggtgttgtgaacagaaagagggggaaaaaactttagaaaatgatggggatgctcttactggggtacgagtcctcaggtattgaactggctttcagtaaaagctagattagtgggttcctgccatttacaagctgttttatgacaacttacttgttgggtggcctacagtaactcacctaactgcactgagtctgtttcctcatctgtaaattggggatttttttttaaatacctggcatgcctaactcataaagttgttctgaaactgaaataaaacatacgtgaacaggcattgtaaactgtaagttacggaaaaagctggctgttgttgtgtctttaaagtttcacctgggtagtcaaagatggatcatgggtctcagtggagagctgagccaggcaggagctgactaagggtgagaggtgggagttagcagcctctgaacatctgtgtaccatgggaccccctttcctcctgcatggtaccccagacaaggagcctagtaagagatactaatggcttgttgtccagagatgttcaaactgcagagaaagataagacaacaagcattggcctccaatcatgatgacagataggaggaggtgggagctccttagcagtgctggttggccttccatgttctactgtgggccatctctgccatgtactgtaggctactagcttctatattaaagaatgcaagaggggccaggagcggaggctcatgcctgtaatctcagcactttgggaggccaaggtgggcagatcacttgaggtcaggagtttgtgaccagcctggccaacatggtgaaactctgcctttactaaaaatataaaaattagctgggtgtggtggtgtgcacctgtaatcccagctactcgggagactgaggcacaagaattgcttgaacctgggaggcggaagttgcagtgagcccagattgcgccactgcactccaccctgggcaacagagaaagactctgcctcaaaaaaaaaaaaaaaaagcaagaggaagtgaaataatcaaggccgccatttaatagtgagcagccactccatgtggtactgtgcaagcacattataaatattagcctcacaagaaatgtattagcatttgtattttgtacactggttaagtatcttgcccaagacctcaaaactggttaagggcagcagaatttagccccagcaccaccttttcaaagcctgggcttctcacacttctccatgctgttcccattttaacacaggtatctcgccattccagccactcaaactttggcatttaagaaaattatcctaaagctaaactaaacttcaaggatgaccattctcctgaccccttcccatcaaaattttatctttagtcagtttgttttcgttttgttttgtttttcagaactacctctggcacatcctccaaatgaaaggactcacttggtaattctgggagccatcttattatgccttggtgtagcactgacattcatcttccgtttaagaaaaggtagtatttccttaattgcagtggtctccactgggggtgaggaaggggtgagaattggatcatggctgcaaggaaacccgacttaacctctgcaaggtggtgcaaaggcattccactgttcaacagcaattatattgaagctgagtgggatcactgggtgaagatgaagcgtaaggggtgaggggcaggagaatgggtatggatggaggtagaagatgcagtgtcatacagtttttttctatcatgaaaataaccacagacttacagaagagaaagagctaaaatgcccgtcattttcagttgcattttagtcttgcattagttgcaaccagctggtttctgggtaccctaagtaataaaaatagttcctctgtagaactgtagtatgtttaccatagagtattttgcaaaatttttggtagaggatgttacataatttgcatgtgttcatttctccatttacctgtgggaacaattaaaatccaggaaaatgagtatattcaaataatttcctcccatttaagatgagtcagagtaaataattcctccaatacttagagaagtataccaagagatccagtgatggtatagagttgtctgatgttaaatagggaagtagaatatggaaggggattccaatagtcgttgaaaaattccccataaccccttacatgggggaaagtagtgttaactgagagagtagagataagctgtttccaaaaattatattcttaacaggactgagatagccagaatataaggatcaagtttcaatgacagtaagatcctgagatggagttgatttgcacaaagaaataattgttgccagcatgcattttgaatatttctctggaaaaaaagattagttggcagtagaaatggatagaaatcaatagatattaaaatacctcagaatttggttcatctctgggaaaagatgaaaaataaaagtgtatactcctcaagaacatctaggatcaaaagcatgtgccctacactattgaattaattaacctcataagttgggacctgtggaataaggatgtccaccagacttcctagggattacaaatgtttcacagaacttgaaatttaaacttgggtcactgtatgggatgtagagctgtgctatatggaaataaaaatgatttctttttctcaagggagaatgatggatgtgaaaaaatgtggcatccaagatacaaactcaaagaagcaaagtggtaagaatatcagaaggaattgggaagtaaaagtcaaaggaaacaaaaagctaaagcaataacaaagagaaatccatcagtcataatctcctctccttttaaagaatgctggttcccctttgcctcacagctaacacaagaactcctccaccgtctgaggaggtttaggagcagggaaggggaaggagtcagcttcatttgctaatcttctgttgccctgcaccctagcagctccttgcagcaggggacaaggatgacttaggtggatggataattaattgattctaaaatattgtgtgtcagtattgtaatactatgttaattgcaccatgcacggtatctcatttaatcccccaccccttgccattaccaaagagagagagagagagagagagagaaatactagaatttatcctcattttacagtagagaaaacagagggtcaagaagataatgtaaagtgcccaagaacacacagctgatcacaaaaatcaagcttgggggccattagcctaaccacagacccttactcttaacccatctgcttcaatccattttgctacaaatgtttacatttataagcagggcagaaaaacctcatccaggttattgaactaagaagaaagttatattaaggtttctaatttttttaatgtagttagaaaccaaacttaacaatgagcccaagtttaaagcagtctaattaacctggacaagctcaggcaagtttcattctgtggcccatagcatcatctgtgttgtaaagctaagtagcaaatgttgtttgggtcatgctgggggacaagccatcccaatttgctcaggactgaggggttttccaggatatcatgtaaggataattgggtacaaatataacctgctgctttctctcatttcaaatttatcatttatcatatcagcaactatgagttatgttttttattagatttcttgttactttttccccagaccacttcccatgaaattaatatactattatcactctccagatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagtta

SEQ ID NO: 2394 - DNA, 20065 bp, Homo sapiens; identical to SEQ ID NO: 2393
  source 1..20065: mol_type = genomic DNA

SEQ ID NO: 2395 - DNA, 20065 bp, Homo sapiens; identical to SEQ ID NO: 2393
  source 1..20065: mol_type = genomic DNA

SEQ ID NO: 2396 - DNA, 30238 bp, Homo sapiens
  source 1..30238: mol_type = genomic DNA
ccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgccagatagccgagatgtctcctcctctgtgcagtccttactgagcctccccagcccccagtgaatggcttgaccctttcatccaggtttaagcctactgcctcgtccattcccacaataccttgtataaatgtgtaccaaaaaactggtcatattctattttaatgatatatttgtttcctaaaccttttttctatttttaatatgaaaatgtgggattttaaatatgccatttagcagctctgtaatcttgagcaagttattaaatctctccatccctgaatttactcctcggtgaaataggataataatagtacctacttcacagaattgttgggaagcttaaatgagttaatatgtgtaaaagcatttagaacagagcctggtgcatggctttcaacaaaactggcctatgttattattatttgataaaagcaaaataatatatataacatgggtaacttttgaagcataataataaacatacctcccaacttgagaatgagaacccctgtagttgaatatttatatgtacgattcttcatctccattcatattgcatgcatggccaatgcctggcatgtggatcatgaataagcatttgttgaatgaataaatgaacaaatgccagaagacttgagacagggaaataaccagttttatggggaagatggtagattatgggaacaacagatcgataatcttgttcttaatccttgacaaagtcctggaaccaatgagcacttgaagaagagcccactagtaggcacttgcatggcttcactggggttttgaaaatgcacttcttttcttgttcttctccagttgattggtccccagccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgctgggattacaggcatgagccactgcactcagcctgaaatagcctcttaactggcctctcccttgccctgatacaatccagtctatgctgaggagctagagtgggttttaaacattgttacctagattatgtgtgattaaaatgctccccagtgattcccattactcatagaaaaacccaaattcctcactggtctctcaaagccctgcttgatctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcacttgaggtcaggagttcgagaccagcctgatcagcatggtgaaaccctgtctctactgaaaacacaaaaattagctgggcgtggtggcatgcacctgtggtcccagctacttgggaggctggggcaagagaattgcttgaacctgggaggcggaggttgcagtgagccgagacagtgtcactgcactccagcctgggtgacagagcaagacactgtctcaaaaaataaataaaataaaaataaagtgatttcattgaggccattgttgccaagcacatttcacagacgaagaaactgaggtccacagagaagggggaactttcccaaggtcacagactggcacagcggctctcaatctttgggggtcagacccttctttgaaaattggataaatgatcaatgcagcagtttgcacataactctggagggttcgctgcctctctaaactcctccgtgggtctgtagacctgggctccagtgccctgcagtgaggagatgagccatgatcagaatccaactttggcctctcagcctaatttcctctccttcccaccagccagcctcctgtttctgttagagcaggtctggcctactttggagcccttggcctgtattttgcttcgggcagctttgtatcatgtcaaacattctgggattcagactttcagtcctccagctggtctctcccgtacctgatgaagttagtgaagttgtgtgctgtgcagagcctcttggagggggatttatggagcaagccctagagacgtggcctgagcctgtcctttcttgggtgaacagggcaaatgtaatttgtgttccagggacaccaccagttaagggggaacatagagaccctctgcttgagtatttccatggctctgccccctcctctgctgtcagagccccatgatgggatttccagggtggttattgttttttaatgtgtgctctgtggatgggccctcttggccacatcagctgctgccctccttttctgcacacctctcttcatcactggggtgatggatccctgtgcttccaatggccagagcagcagttttgccagcagtgcctattgaaggtgacatctgcagatccatgcacgaggtgcatctatgctggggtctctgccgccaaagggtccatagcaccgcgcactgcactgacagggcctcctgcagaagctgctgaggccctgggtgtgcatcgtctccagacagcaaaggaaagcagcactgtcttttgtcaggcttttcctctcaagacttctccctaggacccagctgggtgcaggggctgggctagaggatggtatgtaagatggagtcacacaggctgtgctcagaacagctcctggccctacccagctttgggtcctcaacttcatccctcttgacgtgacagctctaagaggaggggcctcagtgtttcatgttaatatccccctggcaaggcccctgcagacctacctgactccttggggaaactccaagccctcactccagccccgtcagtgacctcatctgtatgtaggactcagcgaacattttctgtaaatggccagggagtaaatgtttttaggcatcgtgggccacacaccatctctgttgctgctgcttctccttctgttcctcctccgccttcccccatctttttttggtaaccctttacaaatgtaaaaaccatcactagtttgtggactgtacaaaaacaggccacaagccagctttggcccatgggctgtagtttgctgccttctgatccatagaatgggagatgtcaccaggtagggctgaagcagtcaaaagagggcctctggaggaggtgaatattgagctaagcagagaatttgggaaactgatagcattagtgcagaggctggaaggagccagttgcttctggagagaatggttaggacaccagtttggctgaagctgaggctcctacagtagaattagaaaacttaggggagggtaagcagcagccaacttctagaggtccttgaatcacgcttgaagcttgaagcattattctaaagtcactagggagccatagaaggtacttgagcatcaattcaaccacaggctcttcagcccttcctggttgaggcgtgtccacatcagccagggttgtatcagggtttggggagtgtatggcgaagggactgtaggaacttaagtgagctttattcatagtgttagggcccagtgagggtgggagcccctgttcacacttggagccaatggtgctgtcctccgggacatggggccaggcatgacagtctcactgttgctacttttcctctcagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatgaatgtggatgagtgtgactggaaggtggtgggagtgtaaggccaagtgctacaaagggatgagtgtgtgccaacaagtgtgcctgtgaaagtgtaagtcagtcacgtgtgtgtgagagagcaggccagagcatggaagctgtgcggcacaaatgtaggcatgccaggggcgtgcatggcactgggggtgatcgtgcctgccttggagtgagtttgaagcagctgccatttgcggggctgagggtcagcccgagctggcattggtgactggtaagtgggtgagaggacattggtgggtggtgagttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggctactgagcgagcggatgggtgaggtgatgggtgggtgggctggtggagggtaggtggatggtctttggctgggtgtgtggcgggggctccaggttgagtggatggtctttggctgggtgagtggtgggctccaggctgggtggatggtccttgactgggtaagtggtgcactccaggctgggtggatggtctttggctgggtgagtggtgggggcgccaggctgggtagtttttggctgggtgagtggtgggctccaggctgggagccccttcatgttgtcacaggctcggctctgctgtgctctgctctcgggctctaacccgtgtctagcatttggtccgcaggtcaggcccactcaggccctgttcaccagcttcctgcactctcaggtgggaaagtgctggcatgaaaatgggcttgcaaaagatttttgtttattctgagttcttgcctttgcaggagctgaggaccaggatggggagggagaaggctccaagacaggtgagtctgaacttggagctggccctcttggctgggagagggacatatgggaaaggagagaggactctaggatctggaggggccagatttgctgtaaggtttgaatgaaatgtgttctgtggactcagacctccccaccccggtgagtctgctctttgcccagagttaggcaggaagtggatcacccagttccctcccaggtgtggcttcatttctcctgccaacctttacccatctgccagggccgattccacctgattggccccacaccgtggagtctggtggcttcctaggggtgggagcaggggctccggagatagggagtctgggtttaagttcctgctccatctcaggtaaacagagtggccttgagcaagatgctttgcctctctggcttcggtttcctcttatgtaaaatgaggataatcacagattcataggttgtttgaattattaattgagataatgtatataaaggacctagtatcatatctagtgccaagtgcttaatactctggagtcctattactattaggcaaacagcttaagacaatactgttctagttacagactgtgtagctttgggcaaggtgccttgctcctctgggcatcagtttcccatctgtaaaatgtcatcctgaccctgccctgatggcaccagagggctgttttgaagctctttcaggtgactggagagggaggtacttgcaaaggacataggagcatggcacagtaagctgggggcccagcttgggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 2397 - DNA, 30238 bp, Homo sapiens; identical to SEQ ID NO: 2396
  source 1..30238: mol_type = genomic DNA

SEQ ID NO: 2398 - DNA, 35903 bp, Homo sapiens
  source 1..35903: mol_type = genomic DNA
ctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaaggtaagttgtatgatttttctttaaataaaaaagattaagggatttttcccatcacccagatgacgggaggtgacactactgtataaatactcctaagaagttatataggaggacaggaaaaaaggtagtaactgttttcttagtcactaggctttatctaaaaatcaggtttgcattattttcaagttatcaaccttcctatattttatgcttaaaccatacccaatggcatttcatgtcgtatgtataagttaatatttaaagtgatttataatccaatttggattattataaaactttcattttatacttaggctatttatacatgatgtttaaatgatgaagatcattatactgcagaccaatataatgaggttagatgttataaatgacttacagctcttatgtcaacatgttgtctaatatgcaattattaactattactttacagagtcattagcttgtttaattttcaatctgaattgcacaacttttggtatacctgacttgctctacatgatcaaatgcaatgtgtattttggatatgtgctttttaagttcttttctgtaatgaacaaagatattgtcattgttactgggaatagcaaagtatattacttttaaataatctgaaatttaattagtgtaaattagtagaataaaaataaagttaattttttttcgattcaggaagcttattacaaatagtactgaattattagatgatgatgccaagttgaagtaaaggagaaatcaatttggaggaattaagtaaaagcctcaaattaattatacattaactaaaattataaataactgtaaatggcataaattctctagagtacatcccagtttctgaaatcatcaagtagcatattgaaacctgttttgtaaagatttgcatgtactttttagtctttttctgtgtggtttgaagtcagtaatgtgtgttgaagctaaaaaatattgctttaaatattggttcacaaggaagccaaaatgaaatatttaaaaatgtttgttatatagaaagtccagtggtcctttggaatttacaagaaaataagaactaaagtagaaatcatttaatttcccagactcattagtgaaccagaacaataaaccaaacagagaaccatcagataatgggttagcctgggaagaatattaattacaactggaggtacttgcacagagtgtactgaatttggaatttaccttggaagttatagttgccaccctatttttttaaggaatttttttaaccttgtttactttaacacatttgaaccctgcatgtgtgtgtatttcctgtgtgtttcctgaaaaggaaagtttaagataattctgtaactatcagatacttaattctgtaagtatccttgcatctaatcagaagatgtttttgttcactggcccaagatgtgtctgaaacttgcaagtagcattgttctaaactagtagctgtctttccatttgcatattttaattccatacatatatgatcacatttcattataatctaactattttgcaaatactcatttctacttttgtaaaatatacacatttattagatttttaaaacacttggccaatatgaaataacactttactgttatggtttgaaatgatacttcatagtaatatttcaaaataacaataacattttctacaatataaatatatattattttacttcatttaatacttgcaaccttatttgatgtaagtaaactcattttagagaaaactgtatcacagacaaacttcaatactaacacccagaactgaatctacatttcttggcttcaaggtccagcatttttggcattacaaactttatagtgtctgtttatagtagaatttggggtgtggaaaaaagacattagcattcttgtctaaggttcaaaaattaagaatgggtctagataatactctttaagtcagtatgaacttaagggaataatttcaaacctacagtaatccctggttcataagtctttaaaagacgggacttgtttctagaaggatcccaagtataatatataaagtccaatgtatttattgcattagtttttaaagactaccatcaaaacaagttacaaattgcaatatttgagaagtatgtaattattttatattacagatgtctatcaagttttttcctattttacatttttaccatcatatattctgataggatagaaatggacatgagataatttcagtaagataagattctggagatctcatagtccagttatttgaaaattacttgtggagcccatgggttctttggagatgactcagagcccaagtgaagcgtgactgggaaagggaagaggcacagtttctgctcctttcttttaccaaataactcttctttgaactatcttttatattggtattgtgcataaaatttaccttgaaaggagaattctatctctaaacatgattttataaagaatgacctaatgaccttatgttgatgaaacataatcatagttaaatgattgttttacacccatttctactaccttgaatttgaatctacatttttactcatgtatagggaactgtgtctttataaacatacatagttatgataatgtgaaaaaagtaattttaaaaactaacttctatactcatgcaaaccgttgaatgaattcccccaagtcctccaaaaactagattttatggacagatgctgtattttttaggtaaggaaaactctctgtatcaagagaatggaaaacaagagtgtggtctggttttctatcctaagaaaaagtgggaggaaggcttatagatagaaaaaaaagaaattttagcaatctactgatcagtaagaaaatgtcatttaggtctggcaagtgtctatggtacaagtaccctggaaatctaaaacttttcaaatttcatagtttacatcccagcagatgttacttcagggccatgccttttctgggtggagtttccaagggaacacagctttataaacacaagggattaattatagatgctctggggacttgctctaatgttctaaactgtttactgaagaggcttcttatatctcagtctaatgcaggctttgcaaaaagcttagtctctgtttctactgggttcccaatatagtgggagggtattttgcttaaaagttcattacagaaacactgttgacctgataaccaaaaaaaaaaaaaagttatatttttcctccctctttcaaagatgacccaacggaatagggtccactcatgaattctacaaaaggaataggatttataatctataaactggacagaaggcaactgagctgcctatagaatcaagaaaggcatgtaattagttgcctattaaaacacgtcttcttattttccctttcttctttatacaagtctcaattagttttctgtatcttggctttctaaatttaagtattttaagcaggaagtaaattattaccgatacagtatcaatatcttgtctgtttcttataaaggacaagtaacaattagtaaagaataaaatttaatctacaattagcaaatgaaattaattacctattttcatatataaggagttgtgttattaagaaaactgagtaagcataacccaaatttttttatgctttagacagctaaatttggtggaatggtggagacaaactacattctttctctgaagataaatataggtggaaaagctgtgtgactacatgtgctatttaacatgaacttttctcttttgtatttggtgcacgtcttacgtagtatgggtggttctcctttgcctcaggtgaataaaactaattataattttgtcatatgcagcttaaggatagagtatgattataataacaatacttcattactcatggtgtcaaggcaccgagtgataataaatgaacccaactagtgtcacgtattttgcctattcttaggaaaaaggtagaaacttaaagtaataagaggcaatcaatcagttgaaaatttgaacaaatagacaagttcagtttgtctagctcttttttcaaaatatcagcacatggattgaagttttgttagattaatacttgtaattttgcttgtatatcatcctgaccaatgttagattgagaactgtctaaccatagaattcaacagaataaattacttgatacttctgttttctaatgtatgtgactctacagcagtgggatgtgtacactatctcacttcagttttaagttcaaagcagacagagctaggcagtacccaggcctgtccattgctcaacatatctaggctcagagtccatagaagttatactaatcagttttcaggtctagagagggagccattggagcgcatgcactactccctggtttcttcagtggttactgttggaactctttaccccttgcagaaactcttctctgtagtgcatggagctacttgattgaataaagaagaatgatttgggaaaaggccagatagattcacaactaggttgtggcatagaatctggagaagggctaatatatgcacatatacctattctaacagcaatagagttataattttaaatcattttgtatcacatttgtcagagttgcaaatgacattaatattgaatgagtaatttttagtgaagtttatgtggaacataaaataacttttccagagagataacttaatccttgagttatacatgttttaaatagattttcatactatattaacaaaactggaatgtgacactgggggtttcctgctgcattttttatgtgggctcataaagctgtgggtttctacagaggttctcctagagcttcctaacagtgaggataaagagtgtcaggcaggaacaggaagacaaagttaagaaacagagtctctgggtttcttaactgctgtggaatcagtcattttacctaatgcacttccacgtaagaattgaaaaaccagttcagccgcttaaattaaaaaatgctgatctcattttatcatctcattttacgcatgaggaaattgaggtgtagagagattatgtggcttgtctgctttcatttagcaagacagtgacaaatcagtctttggtttaatcttgtcccttcatctcaattgaaccagctgggatcgctatattttaattgcttcgttaagtataacttgcagaaaatatttggggatggtctatgaaatgggcattcaataaaatattatgtacctaataaactaccctaaatctcattatcagttcacaacatacagaacaccagcatgacattctctagttggcgattactgtggttgcttaaaagatggtttcaagaaaagtttcaagtgctttacaattatgcattgcaaaggaaattctatttgacaatatccagtcctgattaccagcattaaattactcattccattgcattaggacagccatggacaaagccatatgaggtagcatggtatacgatttccaagggcagggaaagctattgttaccactccaccctgaacaattaataaaaagccagccctacttgctcagtgagacagaaaattccacaggaaaaacaaatcacttgtttagacttatgtgcattccctttacattggagaaaaatgacactaaagaactagtcagtcttcttaatcaccaagaccttgatgtaaatgaagtttattgcatcctatggtttatactggaaagtatcctatgtataagggaataggcaaaggggaatcccaaaggttaagggaacatatgtaaataataaaattgccaagaaaaatatttgtaacatttattcctacattttgggggaaaatatcattttcttattcttttcttagctctacaggtaatatttttgaaaaactatatgattactaaagtggaagtaaatactaataaaatcataagagtggtacctctgttgcaagacagctgtggagggaaaacctgaaattataacaaaccacaattattaatacacttacaacattaacaacaatattctatgtgcccttttttgactgtagccttcattccgttggcacatatgttttctttggccatgagcatttcaaagtagagaataattgtttataaactataaagcgcattctgactataaatgacacgccaaccccattattgacaaaatgtcattgcaacaacaaagaagttcaaataaatgtgttttcaaatactagttagaattaactctgattattacagtaggatccactcatttcacaaactgtattctttcttccaatctttttttttttttttgagatggagtttcactcttgttgcccaggctggagtgcaatggcatgatctcggctcaccgcaacctccgcctcctgggttcaagcgattctcctgcctcagcctccggagtagctgggattacaagcatgtgccaccaagcccggctaactttgtatgtttagtagagatggggtttctctgtgttggtcgggctggtctcaaactcccaacctcaggtgatccacccgcctcagccttccaaagtgctaggatgacaggtgtgagccaccacgcccggctctcccaatctttatataataatcacatactatggctgggcatggtggctcacgcctgtcatcccagcactttgggaggctgaggtgggtggatcacgaggtcaggagttcgagaccagcctgaccaacatggtgaaaccccatctctactgaaaatacaaaaattaaccaggcatggtggcgtgcacctgtaatcccagctacacaggaggctgagtcaggagaattgcttgaacccaggaggcagaggttgcagtgagccgagatcgtgccactgcactccagcctgggtgacagagaaagactccgtctcaaaaaataataataatcacatactttatgaagacaccaaacattagattgacaaatatatactaacacaaactacctaattttaacagaattagcatgaatcaactgcaaatgacaaactatattgtagttgaatgtgtagggaaaaaattcttcagtaagagagcaatgccatggttgaaacaagacatcctctacattttatatttgcttcaaattctttatacctgtagtctatccaaagtcatcaataaaactgaaagtaagatactcttattttaaaaattccatgttttaaacagtttttaggacaagccattcaggcctgaactcagtattcatgaaaattagactttcttttaacagttattttaagtatggtgatattagagagtgtcccagtataaaatttctgagaatttttttctatttacccatgcttttcttattttcacagatagctttccaatgattagacgaattgattctttctgtgactcatcagttcatttcctgtaaaattcatgtcttgctgttgatttgtgaataaggtatcgtaaataaaacatctgttaccatacttgcttatcatttaatggaaaacacatcagtcaacccacattctgttcgcaggagagctccagaaggggtgtggaaggttgtgttgggtggagaaaccagatagtgaggatgcaactaagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaaggtacaagtagtccaaagaatatgccttctcattttgattgattctaacttctctttttttgctttgtatttacctgctttatatttcatggtaactgctaattttgtatctttgacataaaggtaattatgaaccactgcaactctatatgatgcgactttatgtgaaatgttataagtataatgtatatttaacatgactccattgctgtcttaaatataaataccaaattctattaaaagctgtctacaggtatgcatgttagtagaaataattgttttaagttatgtccaaagagcatgttggcatgcttttgagtaggaaataagtgagtatattttgtaaaagcacatttataaaagaagttgcactttagttaatactgagaaaagtaaaactgtgtgtgtgtgtgtgtgtgtgtgtaatgtgtttaatattgaaacataaatccttattaaattgtaggtaaacttgtttggtaatacactgtttagtaatccactatttttatatatgtgtaataatctcatctcataaatattttctatttgtgaagcttcatattggaatcttagaaaatactttcagaaatatgcagaacatgtcttagtataaaacaaattgactgtagtgtgaaaaaacagaatgattgaatagatgggctttgcacaacaacctagaattcatctcccaccctagcttattcgaattagctacacactcactcatcagaaacgttgattgatagggggaagaagagaataaagggaagcagttctgctgaagttctaaatcagggatggcaaattcaaatggctgcaggagtttggatacaggggttaaacaaaatttaaggtgccaagaacaagataaaatgaagaacaggaactgctgtgaactagactgtgtgtttactgcctgaaggcataaatgttcattttattaaacataatactggccaaataaaacgagttctgccttcaactctctacctggttaggatggcaatgacctagacaaagggttagtaagcatagtgcacgatggagaacaggaggaattgaatttttattaaatttttattgctatattgttagtatttttaatatttttgatccacagttggttgaatctgcagatgtggaacccatgaatacagagggctgactgtattgtgtttattgctaacatattgcagaacttcagcctcatgcatttaactgaaaaaacatatgtaaattagtatcccctgccttggaattcttagttttcttgatagtatttttaatacaggccaatggaaacagacaggtaatagtgaggtgtggggcttatctaatagtgggatggagtggccattgatctgacatccttcctactcataaactatgttctcacccagatcttatgcagagaaagtacaagatcagtgtctgtgttaacgtacagactacaacatcatttggaaaagttttccaaattcaaaaatcacaataatcttccaatgcacagcgatttagactacttttttttgctgacacataattattggtcaataactgagtattgatgatttaatttttttctttgtcatgcaacaaaactggtacatgtagattcttttgaatagcatgtgaggtgctagcatttattttaattctttaatatttatctttatgcttataatagttaaccatgagaaagtaagttttctgacatcaaaatgtgcttttgtataatgactaagagaataatataatctcatctattgtaagctataaccaggggaagatatattataataaaaaataccgagacctatgagactctagaattgaattggaaaagtaaatgctgtaatactttgaaagagaaatctctcagagtattcaagaaacttcaggaaaaaggtaggacttgattcagattttaaagaagtgtagaattttgaaagtctcaaataactgcagtaaccatattaaaggactgattgatagtatgaaaaaccctgtgaaaatgctaccaaatgcagtgaagatggaaggaagaaggtagagaatgtgcccataatactggattaacagcagaaaagattagaagttaacatggggttagagttaggaagcaagcttagaacatcaggcagaaaaatacttaattgatgatacaatacacaatagtcgtcggtatgtttttcagcaagtgtaagatatgataaaacctgaatttagagattagatggctaacatttaattcttactaagagtttcctatatactagttcacttaatcttcaaaaatatctgtgagaagttgctgttattttactcatcttacaggcgcaagtccttaaatcaacttgccaactcacctagccaatagggaaagaagtcattctccaaatgtaagcaatctgtaggaagagcctagatgaaaaacctggccttgtatactactctacagcagaaaggttgcaaagtgaggataccagagataggaaaacaaacaaacaaaaaactgtaggatatgaccactttcaaggagaatataagattcccttttagaaagatatttgcataatctgcacattatataacaaaaggcacactggtctggcatggttgagtatatagaaaaaaaaaactgatagataataggatgaaatggaagcttggagagacagattaaattagaggagtaaaagcatcaaactcaagatgtccagtgagttattgatagaaggtatgtatataccttacaaagtaaaacagaggttttataagtgatgttttatgaacatcagtctgtgtttcaaaggtcagagttcaaatagatttgatcattgctataaagattaaaaataaaactaaacagtagatttacttttagagagttttaatggagagaggaaaaagcagaagaattattacagaatttgtaataattcagaggcaggaagacaaaagtagaaaaggaaaagaatgatcttatatgaagaaacaaacaaagagtacaatcctagaagttaataggaggccagaactcaaggaaagaaagcataaaatgttctcaggcagatgaaaattaagaaaataatgattagaacatggtcaccaataattttgaaagtatactttgagtagggtaataaagaagggggaattaaatcaatggagtgcttttccttcttgtttttgaaataagaattatccgtgcaatcttttacaaggaaaagagaagattcagacttcctagtgtagattcaaactcaaggaggtggtacaacagagactcataaaaactgtcaaatgacagtgcacattgtaagccccctacatgtccatagactaagactcatcatcagaatccttatattggtcaagatgtatggtacatttaaggctaagcttctttttgctctcagattcctacacaaccatgttgaccttgttaatttagtcatatgaagtaggtggaatattgtttgaatagactgtttcttttttcttcagtttacagactattttttaaatgatattggcgtatgtatatctttggcatagagtaggagtcaaatatttgaattttgtgtaaacctagagagccaagtgtcttactgctgcctcagaaatacttagagtaatgctatttcacaaacatatgggttttggtactgttgacttcttatttgtgtaccattaaaactcatttaatattactttgtttagctgactaatagcaaattaagaaagctattgtatacaagtgatatttggaaaaaaataattaaacttcttaattgagaatgatgagaaaatcatttcatatttagtgtagagttgcagtgctgtgataccttccaattctgaaagatgtcattaccatttgaagtagtctaaaacagtttagcaagcttatttgtactttatttttgctctttattttcaagggatgtctctggtatcctcatgctttttatggattatagctgcaatctttcttaccagtatttttgaccgtgattcttaatagagttgtgtgcagccagcaagtttatgcagtctttcaaaaaaaaaaaaaaaactaaaaatcaatagcaagagctgccatgaaagtagaaactaccaaagcactgtggaaaagggtcaaaattctaccaccatttacaaaagataatttatcacttgacattattaatgtcagttgataaaaagtttagtgaatattgtataacataacataggtagttgtatgctaagcagattaatgcaggaacagaaaaccagataccacatgttctcacttgtaagtaggagctaaatattgaatacacgtggatataaagaagggaacaatagacacctggggctaatcgagggtgggaagggggaggagagcggaggatcaaaaaactacctatcaggtactatgcttattacctgcgtgaagaaataatccgtacaccaaacctccatgacacacaatttacctatataacaaacttgcacatgtacctctgaccctaaaataaaagttggaagaaaaaaataaaatttaaataagttctatagttctaactatagaacaccaaaaaaggaattataggtttctttgttcctgttagagaactaatattaaatatcatcattcaattataccatttttccttctcccattcttgaaaacaatgatccttctgtagcttgtaagaaatgccttcagacaaaataaattgaaatcatgattcattaaaatggttatacatggctgggcatggtggctcatgcctataatcctagtacttcgggaggctgagacgggtggatcacttgagctcaggagtttgagaccagcctgggcaacatggcaaaaccccatctctacgaataatacaaaaaaattagctggatatggttacacatgcctgtagtcctagcttttgtggggctgaagtgggaggatcccttgagcccaggaggttgaggctgcagtgagctaaggtcgcgcctctgtacttcagcctgggtgacaaagtgagaccctgtctccccccgcaaaaaattatgtttgaattaatagtccatattttaaacatataatttgtttatattacctttataatgtatgcttctagtatttccagatataataaaataatttgtactttttcatagtatctaaaagctcaaaaataaatgactaaaaatattaaagatggtaaagtttgttttatatttaataacgtaagaacaacccaaaatatttaaattaaaatagcagtataaaaacgaattaaacactatgtatatgtgcatatagctgtaataacaaatgtcacttaaagacaatgtttcaagaaatagacaagcatatatgtttcttctactagtccaatttaatatcaacatagtttacttttcatgccaaacacaacatagtttacttttcataccattttaggtacttacataaattcttggaggctaatttctaggtttcagaaacatattaaagcttactactccaatacatttcacctaattttattctgggttttagttgatgatgatgttctgaaactaaagccattttcagattctctgcataactgtcactacaattctaattcattctcaacttacacacacttgcataatgcaaaaacattagaatttcttttaacatggggaaatgattcgttttaggcccaattacaagcaaatggtagcagctagtgggaaggatggaagtatgcttctggtttttaagaaagtttttactttactagaaagagaaatattaaaatgattaaataacagaaaaataattgtcacaggatattatataagttattggcacatgactggcttagacagtaaatgctatgaaccaagcaattaaagcagaatggagaagtaaatggtattagagttcttcctctaaaggatggatagaatttgtaaaatactaatagctgacatttattgaatgtctggtttgtactaacactgttctaagtgttcacgtttattgatccccataacaacctatgaggataaatatttaagccacatgaaaatgccaaaattcaactttttttgattttcaaaaatactaagtctatatggttcaatctaacattactgttataatttcacagataaggaaagtgaggtacaaagaaattaaataatctgctcaaacttcaatgatgatgattattattaagtgatcaaactcatagcatctaatttcattgttggccacttcagtctatgctttagggaagaagccactataccttgttagggtggggatagggtaaaaaaatctaactcgtagattaaaatctgctaaacatacttctgtctcttggtagaaatgtgtaaagtccttgaaaagtgaaacaaaatattttctacatttgtactctactccatgcgtagcaaagtatgaagggcattttaataatgaaagttgtcagttatgtagatgattattgctgttgcatgaaaacagtattcaagtgagtgcatgactacatataggatattaaggtcccaacaagcatctgttttcaaattaatgtagcagaatagaagtttcaaggtcagtgctttcaacccagctatagaacatgctatgtgagagtcaccaggttgaaatccagttgttgttggggcttggtagtctgcatgcttagagtcagggacaaatacacacatacacattagccaagtgagaaaatcttatatcactttttctgtgtacatacttaccagctttgtacttcaaatttagtaaaatatttgcaaaatagtctagacagtccaaattcaatttaaaatcaagttcttttaaattcacaaaggacataacatcttttgtttcttgtgacatatttagtcttggtattcaaggagtgactacaatttaatacatatagtagtggtagcgtcagaagcatattattactacttcgactacttcaatatttttctctatgtctctaaacaaatcatgatgctatggaaactatataaaattgaagtgaaaggacctgatttttctattatctgctagtaaatttgtcacataacattgagtcagacatctcttttctctagaacccattttccacctctaaaaaaatggacggggttagatagtcctgattctaacagttgataattcaacacattcatttcaaccctgtgtttcacgtttgccttatttgtcgctagagatattttttaagggaaaagtgatttgtggcctttagaaaaaaaggtctcatacacgtacaatgtcttttggtgtttagatggacactcattgtagagttaggaaggcattcaatcctgtcaagcacattctgtcacagactctcttcaattctataagagtttgttgagtttctttcattaagagatattaggtcggtacaaaagtaattgtgatttttgtcattaaaatcgcaaaaaccgtaattacttgtgtacaaacctaatatgtaccttgagaggcacttgatgaataacaggtattgtttttgagcattaagattctaatagtgtgaggagaataatgtttgtgtttgtgtgttctcccttgttaagtctcttgaaatggagaaatcaaccgttttcagcttctatttagctttgagcttcaacatcctcaccaaacatatttacatttagaagaatatccataatgctttaagcaattttgtcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgaaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcaggttaagttggagctctttaacctgggcattcttcccaatacttcattagaaataccgcctgcttcaaaatcacctttgtttgcactatctactacagcgtaatagacttctggctcagagagtgaaagctgtggaagaaaactagaagaatatttatgttaactcccttattttacagctaatgaagttgaccctagggaggtttgatgactctccacccagtcccaaagctcctaaagcaaggaatcgagttcctaatgtaggatttttaattctcttattggtgtattttccacttgtctatctttaccaaaggagcatcagtgatttttagtggatttcacaaaggagtaataggacagcttccttgtcctgtttttttctttaaaaactacaacccaataatgatgagtgaggctgttgtaatttttggaaacatgataatgggttgttgcaaatatattgaaagttaggggctgtgtgcagtggctcacacctgtaattccagccttttgggagtccaggtcaggtggattgcttcagctcaggagttcaaggtcagcctgaccaatatggtgaaatcctgtttctactaaaactacaaaaactaggtgggcatggtggcacaggtgagaggatcacttgagcctgggaggtcaaggctgcaaggagccaagattgtaccactgtactccagcctgggtgacagagcaatatcttgtctcaaaaaaaaaaaaaagaaaagaaaaagaaaaaggttagggaagccagattgagcaggattttgaagacacggtgtcaaatttgtgttcttcatgtagatatttttattttcttaatgtagtgagtgttaagtaccatcctctgaagtgtccaactcttgaaggaaaagaaaaagcttccaataccattagatttttcactcagtttttgtgttttgtttcatcagtccaacttaggggcagagaagaagttcaactcagtaagaacttttttgaacttcggtaaaatttgcttaataaattatgttgactgttgcaatattttcaaagcgtcactctaaagcttgccgaagggtcactttaaagtttgccttaaaatcaacagtcgtgtcttcagtattacacactgattctctttgtaaaaggctaaaaagactgctgtaataataatttgttgaaaacatttctgctgcaagtgtatggtaaggttgcaaaggttctcatgaatgaggtacttgggcttggtccttttattctggctgactcaaggctgcaaacaatcttccagaagtgcctgtacttactacaaagacataacccaaacttattttctttttcatagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacaggtgagtgagtccccacaaatatgagacactcttaccttgaccatgtatttctgagaagtcttctacttggcaaatgtcattgtattgaaatgtacttattattttcttgccaaaaatatactttaaaatatttttcctgtctgtatagaatcctaatctaagaatttaatgattataaggtatttattttgaaaaaagtggaagatatatacattatccaaatatttattagacaatatatagaaaagataaacagattttattataaacttaccagtatcaaataacttccctatgtttatgaagttagtgttttgttattgtggcatatattctcaacaactctgaaatattcctgctgaggaaaaaaaaatcagttttcacatcttaaaatttaaagcatattttaacagtggttctcaaagtgtagctgggccacagcaaagtgctgggccagctgcatcagcattaacagggaattgggaaacatgcaaatccctccaccccatcccagaccaaatgaatgaaagagttgaggcccactaaagagttttacaaatcctgggtgatttgaatacacaattttgagaaccaccgtgctaaattcatttttcctaactgcggtacctactcaagatttatattcaaattaacttctgggtcatatagatgtttacattgatctattttagtttcactcttatatttcctctagtgttgagacaatattttatatctttcctctgccttccctgatagtttaacacacttttgaacagaatcttagagtattagaactagaggaaatgatcagccagaatctgtcattttgtgagttaaaaatgcctgatccagtggatgtgaggtcacttgtccatgttcacacagatgtaggtactggtagctcctagatttttgtataccttttcttccatttcaattatagacactctgtctttttcactaaaaagggaaaaaagggggagattgaggtgccaaaaacactaccttaaccaaggattaggaatatatttatggtatccatatggaaacatagttatgttctgctatagaatttgttacctaaatgtgtattttccctcatggataatcacaactagttatacaccatgattagttctcatcacaaagttttgtatttctaatgattttttataatttgtagttttagcatcttatctgttttggttatcggatgattgtataattttccttcttccccaaagcattactatgcttccagattgaaaattcacacccaaaataaaatgaaataacaggcatggtgagggtggtgcctactaccatagcacatgacatataagccccagagggccttggtgcatgtcctgtcttagcagttttacccgaatcgggtgtctctgtgcgcatctgtgacaattcataattttgtcaatgaagacttagtttttatgggtacaaaaacatcttaccttagaattttcttcatggtcttaaagtttttatattattagcaagagtctatacaagtatcttgttgcaaagaatgttgttaggtgtaccatatatatatacacacatatatatatatgtattcataggtgtatatatacttatgaaaatctagaattcacatatgacctaaggagagtatcagcataattgtttaagaaatagaacctaagtgaactgagtaagtgtgaggaaagaaaatagttgttagaatttgagaactcatcatgattttttttgtttgtttgggggaagttatatttttcacttctgtttttaattttgtttattttttgaggcaaggtcttgttctgtcacccactctagagtgcagtggcacgatcacagttcactgcatcctcaacctcctaggctcaagtgatcctcccacctcagcctcctgagtagctgggaccacaggcgcatgccactatacccagctaatttttatgggttttgttttgtagacaaggtttcgccatgttgctcatgctggcctcaaactcctgggctcaagcaatctatgtgccttggcctcgcaaagtgttgggattacaggtgtgacccaccatgcccgaccatatttttcacttttaaatatattatttgggatatgagaaaacatattattgaaatagttctcctctggtagttgacagctgatctatattttattcttaaagcctttaacctatctctctaagggacaaaaaggggatgtgttagatatatttggtttgcttagagaggcaatggagcaaagactggagaagaacagttgcatttacagctaaattttagaatccataaatagctctttctgtaacaattttaaagggattcctgattatctgtaggtcatcttgtctcagcatgtcaccaaaatagtcttttattgtttgcctgagtgccttaaataatggaaaaacaaccagtaccttttagaaaaaaaattaacactttgatagtgcatgtgttgagctaaacatgctttttcataactaattataccctaaatccatctgacattggaagtatgtgagaatgtccctcctcaaacagaaccacaggctgtatttggccattgtctgctaaagtaagcttgattacactttgacaagatatgacctgaatcaaagcacgaaattgcttgggttgagatcttatgtgtgtttctacctacaccatctctatgaagatgctgtaattccttcagaatattcttagatctgtaattcattttttgagttactttgctttggaaagaatataaaaagtaatcttgagaaaagcataaattccttcccttgaccttataaacaaacacgttccaaaacttccatacagtctaacttttaaacaaaaaattcagtaattatgttccctttttaaaacaacattctaaaggcagggctgttttaaggatttttcttctagtgactgccatctactggtataatgttgtcagtacactttaggtaacgtgacaattatgttgctattgttttaatatatgggcatatttctgaaaattgaagtactttgatttgaaatattagtaatatgcacactaatttaaaatacaattgtcctgagtgctgtttcagatttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtaggaatttacatttttattataatggaataaaatgggtttttaaaaaattcagtccaattgcttaagtctttaccttggctatctactcacttcacaggcattcaaatatgacagtgcaattatgatatatatcttatttcttctcagtgaatatcttccacttgtgaaatgtatttttcctgtaataatcacccttcaccgcgttcctaaaatgtagttggtactttgcagcctagatatgttagagtcaggagattagaactagcaaaagtattcaatatacttgaggggctggggaagttagtctataacccttaaaaatggaaattatattcttatctctaattctcattaaagaagtcctgaaaaagggaaaaagcagtgctggataggccttgtattttgatcattctttctaatataagaaaatgtgctctaaatattcccctgctgaagcccctgtactttttcctccttatcctcaggataaagtctcgtttgagtattagatgcaactcttttatgtttgagatcttacttgtttcaataactttatttccactactctcctcacctcttactctgtaatccaaccacactcaaatatctgcatttcccaaaacatattatgttcgttcttatgcatgctaccatctgccgtactttacctaactaaacttgtatttgttacatagaccatttatgtagacttgtactaaaaagtgttttaaccctcacccctaccctgaccattctaaatctggatctggatctgttttgtgttttcccatggagtctccattataacaatattccttctctctcactattttaatttccagtttgccagtttaagaccccttctcgttagtttgctagagaccctggctgatttctcattttaacaccattgcttacatactatctatctggcatattctgtgtgttcaaaaatcatttgttgaatgaatgacatttgagatctaatgttcacatatgacaaatgttttgaattttgtttactgctatttctttagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagtgagtagacaaacaacaaagttatctattttaaaatactctagaactcatgtaattaatcctatcattagaattattaggttttacttgtttttccatttttatcaaaacgtattcctatatcattattttgaatggaggcatggtcatttggaaagtgacaaaatcataagaatcgactgcattagaagaccactttatttttttcattattttttgtcgaaacattctctatatttaatttcaattttataacagattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatcctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggctttttttttttttaagttctgggatacatgtgctgaatgtgcaggattgttacataggtatacatgtgccatggtgctttgctgcacctatcaaaccatcatctaggttttaagccccgtatgccttaatgcattagatatttgagaagaccactttaagtgtatcgttaaataaatagagcttaacttggaatgtcgtcttcttgtggctggcactgaggcaaagaaatgtaatcatctaggaattagacgaattgcattttgagttttggcaggatctggcagtaattttaaagataagctttaaaaagttttgtattaagctcaatattagcatttaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagtcttattgctgatctggagacatatatcctaactttttaaaaagtccacttctcattatagcttcagctttcctagttgggaaattcatctgaatttaacaattaaatttaaacctgaagaatagatttaataaggtttctactcatttataaatacacaattttttttaaattagccggtaagctagtctgtaaatctttgagcactgtttttggcttttatttccctattcacataatcaagtttaataccatatttttatttgttttaaatatactcctcattcctccttttctagacctcttacaattttaatttatatttaaaagttagcctaatgttcacatctcaatactgataaggtaatagacttcattttaatgggatttgtaaataagaatttttagtagtccataatgtcatgaaatggcagcttgaagattaaggaaaatgtgaacttgatggtgtacttgattaccgcttaatgttttgaattacaaataggataagctaactactgaattggaagttggactatgacttcatttggcactatatgtgaatattatgttctctagttcattgttttacttttagatactgttaggattacaaggttatatatcaattataaatgaatgtagaaagccataatgaatcaaattcattctgattttaactcaatactcatagctctttctttggctaatgctttaacttttggatgtctaatttttatcattttagtaaccacttattatcattttagtaaccacttattaatgactgtaacatttagaatacccctagaaatcattgttcttataggtttgttcaatgtccctcacctcaacatagtaagaatagtgatcaaaatgccctcattggcttaattatgacagagtgctagagttcacatcatgtcagcttctgatatgtatcttctttgtcacagcatctagcacttatttctaggcacctttcacaatttttaaggccaataatttaaaaaaatgtattgcagatgtatttcaagtcatttgagtaaccagtgattgagaaatgtgaaagtgagttatgtattgtacaactttgaaaaaatgacttgtagaagtaacattttcccatacatatatttcagtacaacaatactgcagatggagtttataaagttttcaatggaaaagataacataagtaaagttgccataatcgacacatataaaggtaaaaggtaagtattctggtaaaatgtgcatgtatgttactagggtactcttaagcaggaatagtattcatttaacatctcataagacataggcatcaacctatagaacagacctggttataattcagctctggaaactcctgttctgctaggtattaactctttagttgtggtaactggtgagttcacaccagtgcatagctgctgactatcagctccactttaaggtttggttcacctttctgcacaggttatggttgtgttacataaatccccaaagggactattttttcatctctgctacttatccagcattacagtataattattcttacaattagataaccataaatgaaaaggtaaaaaaaaaaaaaacaacacatcaactgattgtgtagtagatggaaactttttttttactttttaaatcgagcatatcgaattccatattccagtggcatgacctaaatgtgtctataaagatggaagcttaatgaatccaggcaactgctttcatgaccttccccctgcaaatagtctttaataattttccatattgataactcagcttttttaactttatcaatgcaaaaatagaatgaatatttcaagtgcagttctacaatgtaaatacaaaatgtgaaaatgaagactttgccaactttaaagtggtaaaataacaaatcagcttcctaagccattatttcctttttttttttctagctccagcctattcacctaaagaatttataatttatcatatatgtaaactaggaagaaccctaataaatatcagaggaacaagctttcttctccataaaattaacaattgtgtgtttgactagtttttttctgaaaaagaataaagtgatcaaaaccaaaagagatgaaatgtttttattaatataaagtaacccctacctcaaactgagtctatctaatgattgcttttaacagctaaatattactagtggagtactttttcttctaaagagtccacagttacatatttttatagaaaaagtcagtagagggaaaaaaacacttctaagtattcacttaaaaggaaatcacagcaattttttatattgagaaataacgagcatttcactctaatattacagagagatgtggaggggagttgcaaagcactcctagttagagtaagaatttcacatcattttaagattgtaaggttgatttaactcatggcaagactgaacatgattaaccacttattttgtttaagcaatggcttgtcttgacatgtcactgtcaggagtggaaaaaaagtttttccatcaccaaaaagtgaggatgcagggaaactattactattgtttttatcacttccagatatatatagcttatttagacagcaaagtataagttagtaaactctttcctactttaacgccagtccatgggagaattaaagggaggaaggggcaagaatataaattaatcatctacatgttttgaatgtttgctgatccaaacatctgcttctttcctcttccctgcttctctcttctgcctgccttgtacttagcttatatcagttacccacttaacactttccttctattcattctgaacacttatactactgagtaattcatgtatcccattggaaaaaaaaaaatttcccctaagtagagatctaagtttctgataaatgtttttaatttttttcttattccaagatgtttctaattaacacctggcagtttttattttatgatctggctacctaatggcatcaggtacattgcaataagataaaaggttcaaacaaaacataaacagaattgaacatttcttaaacttagtacttgtcacatttaaatgcatcatattaacagaagtattgaattataatagaaaaagtaatgtaagaaaggtattctttaaataagaatgtttattcattgtctttttctattcctaggaatctgtcctattgggaaagtcactgcgacatgattaatggtacaggtaagaatatttgttttgtggtcatcacagttaatccacctccctttcccacaaatccaccgttgtactgacagtgttctgaaagttgagggtgtgtgtttacttgcctttatatccccacaacaaaattcagagtcactatttgtatataggctaaaggtctgttcaatgtgatgggatttgtaaagattaatcataaaaaattagcccttactgcatgattcagagaaatgtttgctttgtaaaaactttactgccatcctggcaacagaagtaaatggtaaaaaacaaacaacaacacaaaacactttagttacatttcaaatattttataaatagtatacagataagttagaattgaaagaattaaaaaaagctaattacaaaatagaaaacatatctaagcaaggcttatagctgagatagaataaagttgcaagacagaaccatccatttttggataaggtggtcagaatgagagagaaaacaataacaaagtcagatgtcttcttaactgtgaaaaatatatgtaaaaaatgagcattcataaacttagatttaaggtatggttagatcaggcttattctccttcaggaaaagcaaagtacagatatgcctattagtttaagaattaagatttttaaaaagcaatgggaggctggtcacagtggctcatgtctataatcccagcactttgggagaccaaggcaggtagactacttgtgccccggaggttgagaccagcctgggcaacatagcaaaatcccatctctacaaaaaaaatacaaatattagctgggtgtgctggcacacgcttttagttccggctacttgggaggctgaggcaggaggatcacttgattccaggaggtggaggctgcagtgagctataattgtgcctctgcactctagcctgggcaatagtgtgagaccctgtctcaaaaaaaaaaaaaaaaaaaaaagtggtgggaatcgaataccatgaagtaattaatatccagaggcaagctttcaactactaggaaacaaaagcatgaagtttagaaaattagggaatatcccataggaaaatgatataacaaagataaagacacttaagtaaaaatgaagtacagagaatgtttactttgccaaaggtatgattattgacttcgtatgcgtacttgattctatcattgccttgtaggaaatgataaacaaaaaaagcaaacaaaaaaaacagcaaaaacactgttggatttgcaggggttttcttttgtttttttttttttttttttttgagacatagtctggctctgttgccaggctggagtgcagtggtgcgatctcggctcactgcaacctctgcctcctggggttcaagtgattctcctacctcaatctcatgagtagttgggactacaggcatgtgccaccacacccagctaatttttgtatttttagtagagacggtttcaccatgttggccaggatggtcttgatctcttgaccttgtgatccgcccccctcggcctcccaaagtgctgggattacaggcttgagccaccacacctggccaaggctttgcagggttttgagccataggagtgggcaaataagctattttctaagtaaagcatttctggaaataaattttcaagtcctcaatactaccaatgctagtagttgtataagcggaatacttagtccttagatgcagagataaatatactgtgttaatcctagtaaaggattctttaaggagaaaaatctttaaaaagaagattcattgacaataatagaaatgcatgagcatcaggcatgatgttaaaaatatctatggggaaaatagggctgatacaaactaggaaaagagggaatttggacagagcaggggatgatccctgtgagagagattcttgcttatggcactagcgaaaagaaagtaataaaacagtaaggttctaatgtgttttcatcgtaatttagaagtgcatcctctttaccttcttcagtaagtttgaaaagacttaaaatgaaagtattggtatacatttagaatgtttcttttgggaggacagaaaaaaagctctgcaaatatcaactatgttgcagtcattgtccatggtagttgctgggtataattaggacataatcttcaatgatattttagataatgatcttaaaagcttttcaatgcatttttctttaattattaaggaaatggaaaagcagttgttgtcaatgtccatatgggggcttatattttacttgtcacaagagtgtaaactaatgaaaacaaggtcacaaggttgacacacttgccagagaaagaacctacaatgcataatcaaagatgagacttaccatttaaaactcattcaatgacggctcgtattagtgatattcatgtgagaagtacatggaggagttaactatttcttcatatatccaatgtttgccatggatcatagctgtagcaaaaagtaaattcaataaatgacttttttatacactttcaaagcatttgaagttctgtttagtgagagaactttagtaaatatttttagaagtagtaatcagccattaggacaaatgagaaaaaaaatcactacaaataaatgtggacatggcaggagatccaaatgaacttcactggaagaaaagtgccactctactggtggggtagggcatttcaaaaaacaaacacaatgttagccttaacatttcatgtttaagtttcttttattttgtaccattaaatatgtatagtatgtagatttgttgttgacaatagcagccgccagccatatgtaactgttaaggactcaaaatctggctagtatgatttgaaatgtgctgtaaatataaaatgcacagtagattttgagactttaagaatttaaaatattttataatggttacatgttaaaatattttggatattaataagttaaatatagttttgttttgtttgagacaaagttttccacttgtcgcccaggctggagtgcaatggcatgatcttggctcactgcagtatccgcctcctgggtgcaagcaattatcctgcctcaggatagctgggattacgagcgcctatctcaggatagctgaggcaggcctatcctgcctcaggatagctgcctcccaagtagctgggattacaagcgcctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccggttatttctttttaccttttaaaaatgtggctgctagataaattacttaggcagtttgcattacatttctatggactacactggaggagagatttctaggtttttttctagaacacacattacatctaatcatttgccactcgatttttaaacagatgcagcctcatttccaccttttgttgagaaaagccaggtattgcagttcttttcttctgatatttgcaggtaagacagatactgaagtataagtatgtctgagtcagaccccaggtgacaaaatgcagaccaagaaacttaaacacagcataggaaattcatcatgtttattaactaactctttgcaaaatgttcttctgcatcttccaatttttaatagtacaaattttttttttttttgccatttctatctaagcaagaaccattttgccttttaaaaactaaactagtagtctattaacgatcaagtccagaagggcgtgcccaatctttctaaagacatacagagaagatgatgcaaatgtaacagaactgtgttaatgtgctctgctcagatttgtggggcccagtagataacacacaagcactggagcctttaccactacccttgagcccaagctctgtccctaaagactgtatgcttgtgggtaggcatttaacatctctgaatttttttcttatctgtacaatttaagacagcagtatttcttcatatacgtgtatctggggataagaaaaatatgtgtattgaaccctatgatagacacttggtaaacgatggaaatgtaccaggtatatatccagcatgtatatgcatacactccagtgagtggtctttctttccaggattaattaagccgtgaaagaaactatttcatttaaactgatcacaaataaagtatttgaaggaagtcctataaatatttactctattggataaattgcctgtgagaagtaacttgagtataaataaacatggtacttcacaaacaagaatagttcatgcttggctattgagttttagtatgtgttaaaatttcccaatcactttttttctaagaatgaaacaagaatttaaaagagtatatgatgtttctaagttaaaacaagaataagaaaaaatgaatctccagaatgtaagttcaggttcctggaatgcagctcttttttctctgtatttaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaaggtgagtaaataacctcagtagcacagtccataccataatttgtgatattctttaagatgagaactttaccataatcctttagcaaccaaaatttaaaatatatcataatttgtgatattctttaaaatgagaactttaccataatcctttagcaaccaaaatttaaaattaaagtaagaaagtaattagggcagaagaaagaatggtggcagaaaattttagtgctgattttgtattttgggaagatcccacttgtgtttcagtattacaaaatttagttaaaaccacaccagtatttccttgtggctgcttttagatttagggtgaaatgaaaataattccgagaacacattaaacatcctgttattcatctgtcctaacttttttcactagaaaatggtacaggtaaatgtattttcagtatgtatctaaagctagagttaaacataaaatttggagactagcttatcctgtacatatttatcatactaacgtgggtgtggaagaagaaagaaaaaactagtgttaaataaattcttagtccatagacatattactgcctgaaagctttacatattgaaaattaatactgaaggagtttatagtagaaatcaactgacataattcttccccacccatgttaaaaaccatgtattttttaatgcaagaagctttagttttgtggaaatattttttgagttatatgtgaaatgaaggaagttattaattccaattgactcttaaaacttgtcttcagggagacctgtgtacatttcacttcctcattttctgtatgcaagtcctgatgtttcagaacctattgatggattaaacccaaatgaagaagaacataggacatacttggatattgaacctgtaagaaaacaccttattgatctgatttggttgatatttttaaaaatacaattgaaataaaaataatcttgtcgatgattatttattcaataaataatcatatttattgaatcacattcttgaaagttactgaaacttaggtcgatttcttcctatggtttatgaagtgattctaattggcttaaaataattttatataaatatttatgtttagatgaggagttattgtatattatgcaaaagtcaaagagtatatgtgagtttgactatacttattgtcaaaatctataaaattgttgtagcgcaacagttttaatcatctttatttttgtattttccttttcaaaaagtaaatgaaattctaggattttagtagttatgttttagtttaaacaatgacacatggattctaactgaatatatatttgaccaggaattatctgagatcttatattttgttgctgatttttgattttttaaaaaccatttcaagtaactcacaaatctaactaactaaaaccttgacattcgattgggcaaataaattgtgtgtatctatatggatgcatgtgtatataactataactatatatgcagttttaaaagtttcaattagtcctgtttaaccttaagttactaccttctcttctgctgtaagaaaaataagttttgaatagtataaaataatgtttttaaaagttggtaattatttagttgttctctttttagataactggattcactttacaatttgcaaaacggctgcaggtcaacctattggtcaagccatcagaaaaaattcagtgagtctcttgaaaatggttattttgatatgatctgtagtatcgtagtatcttcttgtaagaacatgagtaaatctatgtaagtaagtggaaataacatctgatatcaacttatctttagcttaatgtcaccaatcattattaaatgcttatgactaatttcacagattttggaatggttttatggttttatttgagcatttgatagcatctcttattttgttagctgcccaaatatttctatgacaataattaatttttggaattcatatttcagttccccgagaatttattgaaaggaaaaatccacacttgtgaaaaaaaatcaatgtgattagaagacatataagagcaaaggaagtcaaaaacaactatattaaaatttaaatgagtcattacaggaacaaaatcaaattagcaacagcaactaatttatgaacatttattttaaagtttgttatatataaatattagtttatatgttcataattattttcaacgtatattacagagtattaaagaatctgaagaggaactatattgtgcctattctttggcttaatgaggtttgtatttgcagctgttagtcattaaaaacaaccttctttgtatataaacaagctcttgatgtttcaaaagaatgtatagtatttaaagctatatgtatttccattacccatatggatgagtatacatttatttaacctatttgagatgatccaattgaacaaaaacatttcctatcatttaagattttcttcaaaaatgcatctattaaacacattttcttgttgtaacatttgtcttctattgcctgacaaggtatttttactataaatccatgcattgatagctataaaaataggaaaaacattgaataagtctttggagcaaatgaaactgttgaccctttgatagttctgaagagcaaatgaatcctagtacattgaagagtaccgtactctatctggcacttaattgcctttcttgacttgcaaaaggaattccattaacttgccttatagatactgatgactaacaccaatagaggtgttagaaaaaagggtgataggcaattgaagggtttattttgttttactaacgtacccaaataatgttgattattaacttgattacagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaa

SEQ ID NO: 2399 - DNA, 72231 bp, Homo sapiens
  source 1..72231: mol_type = genomic DNA
gaggatgtcaatggctttcagatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttggtgagcagaatgctttttgtttagaagtgtggctataaatgtctttgtagttgatgcactctcatctagtaagtaactattatttttgggctctctagaaaggtaattattatctgatataatagtttagtctgtgatgcttcttttaacatatttgtaagttttaaccaaatggttaaagaaatttgctttttaacccttaaacctcacatatccacaagtctctaaattccataggatgctatggatttctagttgcctagttcatgtcttttacttagaaaacgtcagaaaacccaaacttctcgtgacttcaaaaagtgtaattgtacctgaaacttcttttccttcagatttcttatttatgttttctgataggtttttaagattaatcttttcagaaggatgctctaaaaatctggccaatttgattatcctcttccaacttggaaaaaatatgtatttaaaatgagactagaatttgaatgaccttctttcatggaactctgaaaatgttttttggcttgctgtcacaactgacaaatatatttaagaaataacctaaaagaccaatcttaacaatttgactcctagacagaagaaaacaaaaatctttttatacataaaacttactaatcattagtgatcatagaaattttcttgagtgtgggtgccacatgtcttatttgtggggtgggggcagattttgttacatagcagaatttttattatatggtgtgtttcataatatggctacataagatcagacaacaccgccaggaatgacagagtcgttacttatacagaaagtcaacttaagttatgcatatttcgagacacaattaaggttgatacaaaaaaagaaaagcagttccttctgtttctccatgctattctgctattctacaagccctggaaaagaattagataggcttctttgcctttacaaaaaaggtcactttcttttattatttggggaatggttggttggtgctagactgaattctggggaaccatttaaggctaatacttccaaaggggtaaacttgttgacactccttgagagaactcacaattcagatgggatctctatctcaaagagaaataggcaacctatcttgttttcaggtgtaactgactaaataataaaagtggatttgtggggcaatatatgagacttctgtaatcctgacaagaggaaaggaaaaatattttcaaatgatgtactatgcaaatactaattatttggaatctgatacttttgtaaaggataatgataactgtgtaattaactgttctaagagttcaagaaagctaacacctgaggataataaaacagttttcacctggggaaaagataagctctggaactcaagaattacagtcaggcaaaaaaaaaaaaaaaaagagttttaaactgctgagaaatgattgaaaaagactgcttaaggttgtagagtgggatgattaaatggaaggaaatgtttcagagcaaagaaatataaagttcttgatgtgactgcggctcattttgcttttggcacaaattactgattaagatgactacttaaggaatttaatctgatattcttagtatttacaaacaaagcttcaggttaaattgttttgaaaaataaagaaatgctataaaatgagtgaagtgcacttcagataaaaattgtgaagtgtgtgcaacgcgcttcacaacaggttactttattgccacctgtgaggagcaagaggaggtactagaggaggggaatgaggttgggtttccatatcatgtgactagaatcctcagtcatgtctaatccacagtggttcaatcacaaacaataaatgctcatcaggaaaagtaaatgattgcaaacagatataagtgtgcaatgaatataaaaagaatatagttgagtaaatagttttagtgttctgttgtatatagaagtacagtaattggctaagccactggaattttttttttttttttttttttttttttttttttttttttagcaaagtatgccattggttccacaataagctttcaagtcatttctttatggaaaagggtaaagtgaattctgatttgtatcttctgacaaaccacgtggagaagtaacacttttagatacgtgcttgttggtaccctgctaaatagctaaagatgttttgaaacatactcagagacctttgtcacacaaacactatagtacaaagaaggaaatgacagaaaattggcaagcattagaggggacataggagacagcttggctcattcaccaaggactccagactgtgctcaaatggaaaaccattgtttgcccttcagtgcttgtgatgtttaaaggtgaaatgaggatagtttttaaaaataaattattattagtttcatctcttcattaatgttgttccttctcattaagtcttataaatattacttttctcatttaaatttttagaaaattaaaaaaatatatattagtcatgtcatgttttacgaccatgacttaataagaacacttcagtctaattgaaattcatttggaggttcctttggtcccatgttggaacttcactgtaactttatgtaaaatgtagcaaatgccattgcaagatctacttcttgtatctcattctggtcagttttagaagtgaagtaataaaaattagtgtgttcaatacaatggtctcagaaaatagaacccaaagcatcctgtctttccagagaagatacaaaattttaagtaaactggatatctactttaagactgagccctcaaacatgaaatacctattttgtttgaatacatgatggagttgctatctttcacatacctttattcattgacatactctttcaaaaatatttaatgaacacctacactgctttaggaaatgctattagaagcaacattgtgctaaacatttataagaatctaggatcattttacaggtggttttctgaaccttgttcatatagaatgaaacttttgatgaaggttaacaaacaaaaactgttagttaatggtgaaagcatattcatcattttatggacacttttccccatgaccccacaacaacagctcccttaaagtgttatcagtctctgggggaaaaaaaatggaccaaatgagtgacagttatatttccagaaggactagaaggaagatactgtcagagttgtttccattgcttgctctaagcttctcgtttttgcatcatttactcttaaaatgctaagtaacttcacacaacataggaagcctctccagaataaaatatctgtagtatggactctaagctttaggattgataacttcctaaaattatttcttcttgaactatttcatctgaaatggggaataaatactagtcttgattttatcttggtctcctgggaagacctttaatttctattagccccatccttttaagagctgtttgggcaataggtacatctaagcagatgcatagacaaagaattacagtgcagaaaggtatgagctgtgataagcttaatatacagggataagagcattccttacagacctttgctattgcctagagttggagcatcttgccggcatataaactccataaaggtaatggagctattccatttgtaactacttgtgttagtaacagcaatgtcccagtacctgactcatacataataagcactcaatagagagattttattcatttatttaaaatattgtctaaatatttcctaaatcaaaatattcatcttctactaaggactatgactaaaattttaagaattttgaatcacgtaaataacttagatacatttctttcttatgtttagcactttttctaaaaatatccaaattgatgtagagctctactgtaacataatacgtagatctgtgcaacttttttttttgtattaaattctcaggtaggtagtttaatggaatgttactactgctgttcttcccagcatgtctggctgggtttgtttatttttacaatataggacagatcctctactcacaaaatgaattatgggatttaatagagaaatattctataatttacaagacgctaaatatataaactcacagatgctgagaatgtctcagtgaatcaattcatgaagctcattcatttcacctaatgcctctcaatgatgtcctagtccttttccccagtctgcatgcaaaacttagatgtgcttgctactgtgctcagtctcttagatgtctttgccgcatgtactgagttttggatgaagccagagagaaacatttagctcagtccatttcactctgggtccgagggtcatcttggagatttgctaatctttcctccaggaaagggttgtgatttctccacttttcacttcatgaacaaccacagcatgcacagtactgttctttgctagcctagtcacgtatcccctcaaaaccctctctgaaattgggggatggttaccagctggtggtaaaagtacaggcatcacccattttctttctccatcccttagttcctttctgacctagacagctgcttgaatgttccttccccttcagtcttccaatctttgtgtattttatccttgtactgcagctctgttataatcattcaacaaaattctatatggtttaccagctgaagttgggaaacacaggattaaacaaagtgaaaaataaatcctattattaagaggcaaacaggatgcttactataattcctcccattatcttctccactccattaatattcctcttgagtattaaaggtagcattttgttctgtcaactctcccatgcaaaacttctgtacatagtaacagcaagagagtttctgaagctgaaatcctgtagaataaataaaagcaactgaaacaatctgaatggtcctttgaaaaaaagaagaaaaagaaaagcacttaattatttaccatggcaaagcaacagctatgaagcttgccttttctttttttctgaggcttagggctggacgtctactttcagctgctctgccaaagtttacatttttttcatagcaaaagctacaaataggagaagtggggatagtttttagcacactctaaaactaagatctactgattttttacaaataaggacatggaggcttgtagaagttagtgaccttttatgcctttgtctagccatattgctttcctcagtttccatttctgcagattttctaggttcccattccccatcccccactttctaagtgatattatcaattttcatgacttcacctgtaatctgaatgttgaggagaccccaatctacatcttagggctccaatcactcttctcaacttcagacccatgtatctccatgccagtaggtcaagttctcaagctgaaagtatctaaactctttttgttgttgttgttgttgtcattgttgagactgagtctcactctgtcgcccaggctggagtacggtggtgcaatttcggctcactgcaacctcctcctcccaggttcaagcgattctcctgcctcatcctcccgagtgctgggactacaggtgcctgctgcctcgcccagctaattttctgtatttttggtagacatggggtttcactgtgttagcccggatggtctgcatctcctgacctcgtgatccgcccgcctcggcctctcaaagtgctgggattacaggcgtgagccatataaccttgttaatgtgttctgattcaagatgtacatttttatgttcaaaattaaattataatccccaaatgagtgtcttttactaggcttgaatttatcccagcattcaataatatatatgcatataacatatcccctgcaaattattttaaaataaaatggttaaattttaatagctatttattatctatgtggtacctgcaaagcactctaaaaataattatgcaaagtgcctagtatttaatgagaagtaaattactggttgaggcatactctctagtgttagactgcatatgtttgaaacttagatctctaactttccagctctgtgacctctggcaagttagtaaacttctttgtacctctgcttccctatctgtaacacatggataataaacatgcctacctcatagggtaactgttcaagataagcaacttaatgcatataaaatactcatacaagtgtcttgcatatggtaagttccatagaagggttaaatattatttaagttttacaataattttaaagtagatagtgttatctccattttacaaatgagtaaacagacttggggagattaaaaaattggctcaggatcttgcagccagttagtgaaaatgtcaatattaaaccctgacaggactaacttcacaccacccctaaaactggtcctatgtttcccctccaggttaatagtacctccttttgtcttgttactcaagcgtaaaacctgagacttacgattttttcctctctacctaactaattagtcaccaagccgtagctattcatgctaacttctaaatatcttccatatccactaagtatttctgaaatctttcccacatttcccacccccacccccatagccagtttttaagttcaactacataatttcctttctagattattttgataggcgtcctctggccttccctccaatccattcttcatgctgatgccaaggccatctcctaaacccaaattttgtcatgcgctccttctctaaaaatccttgagtagtcctatgttgctttcaagataaacccacgagagaatgaattccaggtaatcaaggcacacatacaatataaagtttggtatagtatgtgttacattagggcttcacgtttgtggtcatttgtggccacttttctggtgtcttgttcttccaaaactcatacactgtaccgaatccttactgaaacatgtttccccagttgtatgtttattattttgtatgtttctttatgtatctgtatttggggaaatgcttgtgatccactataccctctcccactctgtacccggagctgtacaatgcagtcctggcataaggaaccacttcctccaccactgtcctttaacaccttctctccctcaccattcactcttcctacctgagtgtagatgtcacggcctattagaattgtctgtttatgaatctgccttcctagacctgctgggagctacctaagcggggtgtcaggtttttgttttgttgattctcacgttttctcccaatcagaagtccaaactaagaatactttaggaatgtatttaagtttactcttgcaagggctactgattgataaaatatttgccaatgtaattggggggaataaaagcatgtataaataaaacaaagttgatgattcaaactatgatagcagaataatttcacacgtaatctgaagatttcaacaacaagagcttgataggagacataatacagtattagagtcagaaaaaatagttacaaaaagcctgagttagtatttgcctgtcttttggcttgtgatctgttggtgaagggagccagatgagaatttggttcaggttacaagtatgatcacccagcaggtgcttgctatgtaggcaaagggttgaggacaagataagattaggaaaggacatgcgctgtgaggggtgagccaagctgtgggtctgatctaggtttaaagccttccttggaaaacaaggactggcaagtgaatactggaaactgaagagtgagaagtattatccaaaagcacacagctcacttttaacagctgattaaatgagactagatttatcacagtagttctcaaaaattggcatgagaatgataaaaaatgtttaacttggtattcacaatgcctttttaaaaattgttactatattgtcattgtaattatcatcatcattactcttattttgagttttcctgatctatatttgtgctctgtatgtctcacctcagactacctaagatttttagtcccttctaggaagttatttaaaatctacccacaattattttggtagccatttactgagagggtaatttagcttcctaatattatggtatttttatgtcatcttttgtaaatacaagaatagtaatatcttcagtgtagtcgctgaggcttctttcctttagtgaagttttagcgaaacagaattttcctctatcttcttttgaacatattttaaacagttattttaattttatttatttatttattttttatcttttatcttttttgagacggagtcttgctctgtctcgcccaggctgcagggcggtggcgtgatctcggctcactgcaacctctggctcctgagttcaagcgattctcctgcctcagcctccccagtagctgggactacaggcgcccgccaccacgcctggctaattttttggatttttactagagactggtttcactgtgttagccaggctggtctctatctcctgacctcgtgatctgcctgcttcagcctcccaaagtgttgggattacaggcctgagccacggcacccagccagatttttttattttttagagacagggtctgctctctctgtcagtcaggctggagtgcagtggcacaatcatagctcactgtaatctcaaactcctggctttaagtaatcttccccactcagccacccaagaagctgggactacaggtacacaccaccatgcccagctaatttttgtggttgtttctttctgtagaggcagagtctctctatgttgcccaggctggtctcaaactcatggcctcaagcaatcctccctcttgggccccacaaaccactgggattataggcctgagccactgcgccctgccttgaacaaaattataataaagctcttgagtgttttgtggcctttcagcagatgctctgcccccctgttgtgacctggccatgtttcttgtctcagcctgcttttttctcccatacatgacacagaggccctaacctcaaaatcgtcgtcccgtgtcattttgcacacccataataatctctcctatttcttatcactgtggcatcttctaatttttcttctttgagtttctctttagtcatcttgaaaattctgagagattgtgctagcatatacatgagagcctcctgatagcactggagttaggagccaagtttcttagatgctttattactgccaatgtcctttctttaaccaaagaccaacaggaacacacctgtagtgaaacaagttcattactcattgaaaagagaggaaagtgtaccatagggaactgacagtgacccggtaagaagatgttaggaaaaatctattctagaatttggacttcggttggttggttggggagggtcgaggaggtgatactgaaggaaatagagatttgctctgaattagatgttgtcaggaggcaggataattttatgattgggtgtcttaatcttggaggagggaagactagactgaagctaaagctgtaattgataaagaagcagagtcactcatagtaagtgagaagggaatgtgtagtatctgtggcttggacagtgttgataatcgttttgggttcagacataaaaggtctcattttgtcttgactcatcatgatcacagaatgattttatctaaagtaaatgctctatgaattgtttgtgttcagcagaacaaacaccaaggccaagcagtgagtgctgggcctgtgcccagaaacagcaagacctagctaataatatcagcccagctcctgggtgatgggctgttttctctttacagtacaaagttctttgttacttcagtaattaaacgtgcacacctgaaatccaatttccactactttgatgattgttgaaatgagattcttttgaatgtccttcttaagttctataatatgctcaatacactgagtcctgtaatataaaatatcattcctgttatgctagcaacctgaaaaatcacaggagatcagtccctgtataaaaatgataatgtgcacaaattgtttgggggcatttattcttttctttgcacatataccataaaaactaatttgttatataaatgaaaaaattatgcctttggcatatataaaatacaatgaaatgaaattttaataactcaaagcttcttatgaagaaattaaggggtctttctacttactatgtagatgaacagcatgctaatcagattgtagaatcctgcagttgggaattatcttaaaaagtatttctgaaaatatgcacctctgtggaacttatataaatgtggttaaatatatatactcaactttctatttagatattccagataccacctgaaatagaagagataatctgactttttctattattcaaccatatactttcttttgttgtttttatttctttaattttccacattgacagatataattgtatgtattcactgtgtcttaaatgtataagcattgtggaatgggctcaatctagctatttaacatgtgtgttatatcacatagttattatttttgtggtgagaacactttatatccactaagcattttttaagaattcagataaactttcatcataagctttgcttaaataaaaaatctagtaagtgattcaagtctgtgattgaataatattccatatatttaggtagtatatggattcaaaatgagtagaaatattgacaaacatcccatgctaataatctactttgtaacttctcataaatctgtagaggaagtagtagtagagagaggaggggagataaggctataaataaacttgattccatgagtcacacaaagaaaaagtatcttttctttatggtaatgtaatatttaagacatttgtaatattcataattgtattactttctttacattatacatatatgctttttaaacatgagctgcatgataaattcaaagtttcagtgccatatgtaaacttaagtttctctattttttctttttgcagggaggtgagggttgctcttaaaatatgataaaggcaatacaagagaaatagtgtgttttaaccactgctgtatttatcatagtatcttgttaataagctactttgattctactttatggagatttttcctttagttactcttgaagatatcatctaaaccaagaaagatattcattcttctctttctccttaaggtctatcttttcacaagatcctacttcatctttcctattttggaataaaacatgcagctctgttttatgtgagccagaaataatttactgaacaggaaactgtagttaagaagtaaaaatcacagtgaaaaattttaacttttaatgggacaaagaggcttgaatcttttacggatgagagatgcttgtcaggggcctaagagatggggtttatttaagtctagtcagcagttttgattcttaaatttgaatagttcaaaagtcaaattagagtaggatcctgataactgagttgattccttgttaacagtaataaaaggtaaatattatcaataaatataaaatatctaccagttacttgggaagttaatatagtacttttggagtatattttatacagaaccaaatgcatataattagctaatgtgcttttgggtgtctatattttgtaataatactatctgaaaagttgttacagataaacatttattatttttctgaaagtcaaagggatattttgtatgcccggcttagcagcagttgtctatttgaaatgaaaataaaagagcattaatgccaatcagctttcttactagaaatattcctgtacttgatgtttttccacaaactcttaacacatcacagatattcttaaactacttgtataaattataccagaataaaatgggcatcattctcttttttgtttacatcgaatgtttgtttctccagagcacatccgtattgtggagaaacaatggtgactgtttttaattgcaaaaactacccagattctttcttggagagcctccttgttttccactgggtttagacataggttctctttcactctttatcctacatttttagaccatcataatgtatttatattttatacacccactggccaacaagagaatctatatatatgttcactaaaaagcaggtttatacaattagtttactcattccttcttcctagtaaggttcttctttacttgagtccagttcctgactccagaataaaaatgaaattatcaatgtctcttgtacattagtctgtgatttttttgcaggggtgccctctgtatcttaatctttgcttcttcttcgcggctccatctttccctcaaattccccaccatgacactgaagtacttccccgattctgcccttccttggaaaccacatctgagttcctgaccccaattccaataccccagtttataatgtgaagtgggaaattgggggattaaatatttcctgatatcagttgaaaactgtgggtgcccttgttatttgctctgctacttgttagctttatactgtatttgtcgcttcaacgaatgccaatataaaagaaatgctaagtcctttgttcctttgaccttttgtgtttttttcccctctgcttgcataggggcgtatccagttttcattacttctcttctgtctacccctgctgttatgttccagaatgccaccaagatgaaagctaaccaaaagtatttctcccacttgtgataatgactcttagggcttgctttccagttttacagccctctttgccatggctgccactacaaactgcaagcacattcccgttaatccaaactctgcctagaatgagaccacattcccttcatcaggctgaatacaagttttagttcagggccttgtgtctttcccgcattcatttattagtcatcgagctgaatttctcaacccaatttattgcttttcatgtgaccttttaaaagtacaaactcgtatcctgtcactcctccaacttataattatttaattgttctattctgcttacagaataaagttcaatctccttagaatatcatgcagggggcttcaaggtctggtatccacctgttttcctcactttttgcaacttccctgaaaaccatttttgtacatttgcaagcatatcacttcctttttgcctctgaatttatgcatgttgttctttctgcttctattgccctttttccatcttctgtgattagaaaatatctattcatccattgaagcccttctgttattttacaatctatctcctatcaacaaaatcacaatctattcaagaccatattttattcatctttgcatgccagcgccatgctcaaagcctggagtatgattaaaggtcagttagtgtttgaatgaataagttagttctttagtacgtttcctttctcttaactcacaacttgaagttgtattatttctttactcttcagaatttctcccaaaatattctaaggcgggaagcttcatgaaaactcttggagttttctctaatagtcttaccaaaacaaatggaagagtctttcttggtttccatgatagctttctttgtttcagattggttaattttatagttcacttttcatttgtcaggataattctgtttttaggaaggatagaagcttggacttaattttattttgaattttgatttaattttgatttgattttatagccttaacagataacactttcttcctttaaagaaatctatctttccaggcaataggagatcttgttgtatttctttgttctttagagttgattctatagatattccttgactttttgttagggttatatcccaataaagctagtgtaagttaaaaatatgaaaatatcattgtaaaaatgcatttaatacatctaatctactggatatcatagctcagcctagcttatcttatatgtgctcagaacacttacattagcccacatttgggcaaaatcatctaatacagagcatattttagaataaaatgtggactatgtcatgtaattaatcaaatctagcattgaactatggtttctactgaatgtatattgcttttacaccattgtgatgttgaagggttgtaagttgaatcattgtaagttggggaccatctgtgtgtgtgtgtgtgtgtgtgtgtgtgcctgcacgcacacacacacacacacgcaatttgagcagataattgtgttatcaagatggtatgacagtccagtattttaaagtgatttctctagaggaaagttattatttgacaaatactatgaaaataaatctcaaacattttcttaagtctccagttgttatcagttgggatgattttgcctgcaagtaacaaagtccaaaagaagcagtttcttgggtactttttattttgttcatataataaggagtcaacagactgaattaaccagcttggaatcatccttaggctcactgatattacttaattcatagggctctaggttggtttttcttactgttaccctacaagtgcaaagtggctacggcgattgtaaggatcatgtctttatataacaatgcctaacaacagtaagaaacaagtttctgtcttgtttcagtcttttaaaacagaaaactatcactacagctctgtagctgacttgtttttatgcctcagtgtcagcattttgttatatgcttgctatacatctcattatcaaggagaattgtggctaaaactaatcaatattcaacctctgtagcttgggagaggttttataatcacatagacatgaaatatctaacacaaaatcagagctcagtgaggagagatgaggtggaaagagtggaagtaaattctgtcatagtaggtcctattctaatttacatgagttcaatttttgaaaattaaaatatatgtgtcctcacacacaggggaacaacacacatgggggcctttcagagggtagacagtggagggagagaatcaggaaaaatcactaatgcgtactaggcttaatacttgggtgacgaaataatctatagaacaaacctccatgacacagtttacctatgtaacaaacctgcatgtgtacccctgaacttaaaagttaaaaaaaaaataaaatatatgtatcctcaaaataatttttaaaaagtaaaattgctgtgaagggccaggcacggtggctcacacctgtaatcccagcactttgggagcctgaggtgggtggattatctgaggtcaggagtttgaaaccagcctggccaacatggcaaaaccccatcactaataaaaataaataaattagccgggcatggtggcaggtgcttgtagtcccagctacttgggagactgaagctagagaattgcttaaacccataaggcaaagcttgcagtgagctgagattgtgccactgcactccagtctgaacgacagagcgagactgtgtctccaaaaaaaaaaaaaaaaaaattgttgtgagaaaaacaagctcttcaaacgtacattggatgctgaagtttctatttctcacttgactatgatattcttttcaattacatctgtgctgcggtcttctaggggtttgtcattagagaaaggtcagactgataagatagtaaagtgccaaaagttggtcatgcctaaattcattggaaaaattacttagtttaggacagaattttattccatttatgtaaagatgattactattttctgtcatgcacagtacagttctttcatgaatattgttaggagaaattttataaatttcataaatgcttttggttttttttacactgtttcatatggatagtaatagattatagtgtgatatatatatttagaccctgcattcagggtctgagtgcagcagccagcatttaactcttagctcagcactgtttgactttgagcaatttagctaacctcacagagcatcatttttgccatttgtaatactgtgaaaatagtgacacttaaagagtgttgtgtattgtttgtgttctgactgctacactgttcccctttcttgttccctttcctggagccaccgtagtccctgagacatgactatattgaaactaggtcaatttataaccctacaatggcctctaatgttcaagtgaatggaagtgtcacacatctctttaaataaaaaaactagaagtgattaaacttagtgaggaaggcatattgaaagctaagataggatgaaacctaggcctctgacaccaaacagttagctaagttgtgaatgcaaagaagaagttcttgaaggaaattaaaagtgctaccccagtgaacacacaaaggataagaaagtcaaactgccttattgctgatatagagaaagtttgagtggtctggatagattaaatcagctacaatattcctgtaagacagagcccaatccagaggaaggtctttactcacttcgattctgtgaaagtaaaagaggtgaggaagctgcagaagaagagtgtgaagctcacagaggttgattcatgaggtttaaggaaagaagctgtctccataaaataaaagtgcaagataaaacatcaagtgaagaagctgcagcaagttatctggaagatctagctaagatcattagtgaaggtggctacactaaacaatagattttcaatgcagacaaaacagccttccattggaaaaaggtgccatttaggacttccatagctggagaggagaagtcaatgcctggtttcaaaccttcaaaggacaggctgactctctagttaagggctaatgcagctggtgactttaaattgaaatcaatgcttacaaccattataaaaatcctagggcccttcagaatgattcaaagtctactttgcttgagctctataaatggaacaacaaagcctggatgccagcacatccatttacagcatagtttactgaataatttaagcccactgttgagacctgctgctcaggataaaaggatttctttcaaaatacaactgatgattaacaatgcagctggtcatctgagagctttgatgggtatgtccaataaaattaatgttgttttcatgcctgctaacacaacatcagttttatagcccagagatcagagtcattttgactttcaagacttattacttaagaaataggaggtgggtggtcacttaaggtcaggagtttaagactagcctggccaacattgcaaaactctgtctctactaaaaacacaaaaattagccaggcatgatggtacatacctgtagtcccagctactcgagaggctgaggcaggagaatcgcttgaacccaggaggcagagattgcagtgagcctattttgcaccagtgcactccagcctgggtgacagagtaagactctgtctcaaaacagaaaaaaaaaaaaaaaaaggctataatttccatggatagtaattcatgtgatggatctggacaaagtaaattgaaaaccaactgaaagtaattcaccattccagatgccattgataatatttgtgattcataggaaaggttgaaatagcaacatcaacaggagtttggaagaagttgattgcaaccatcatggatgactgagggttacaagacttcagagaaggaaataactatagatgtggtgaaaatagcaagaaaactagaattagaagtgaagcctgaagatgtgactgcattggtgcaatctcatgatgaaacttcagtgaaggagaagtagcttttctaattgagcaaagaaagtgtttttgtttttgtttttttttagatgaaatctcctggtgaagatgctatgaacactgttgacatgatgtgtagggaaaaactttctaaaccatgtttttcctctgcctcatgccacaacaatcatcacaaaagcagagttcgatgacaagaagtgtgggggttttccacacacacaccaagcagcaaacaccagctggatgtcatccaactcagttccgacactatctacatggaaatagttagatcccacaggttgcgagcttagtccccaagattgcccccttctttcaacactagtcacaagtccaagtctccaggactaccgacaagcttcaagttggggttctcattaccccctctttgggtttgattaatttgcttgaagcagctcacagaagtcagggaaatgcttatttatgtttaccagtttattataaaggatacaaatgaagagatggatcaggtaaggtatgggggaaggtgtgtggagcttccatgccttccctggcatgtcaccctctaggaacctccaagcattcagctatcaagaagctcaccaaacccagtcctcttgagtttttatggaagcttcctgacttcagcattccttcccccaggatgtagggtgggatcctgtctggggagagtcttgagactaacaatcagaagggaggggaaagattagggtcctgccttggggcaagtgaaaggagggctagagggagattctgttttctgaggcctgatatacatgataacaaaaagtctgtaactagggttaagggaaataagaaccagaaaaggtggacaaaaaccaatatatatcataacaccacacgtgacaacaaagaatttataatattacataaagttggttgatgaagcagtggcagggtttgagaggattgtcccagttttaaaagaagttctactttgggtaaaatgttatcaaacagcattgcatgctatagaaaaggcaaacaatttttccaagtgatgtggcaaactttattgtctcattttaagaaactgccacagcaaccctgaccttcagcaaccaccacctagatcagtcagtagccatcaatatccaggcaagattctctaccagcaaaaagattattataattgttagcttttttttagcaataaggtattttaaagtatgtacattttttaatggtatggcacacttaatagactatagtatagggtaaacatacttttctatgcagtgggaaacaaaatttgtgtgactcagtttattgtgatattcactatattacagcagtctgaaaccaaacttccagtatctgcagaggatgcctatattctgggcatgtttacatttatctaattttcttaacattttctagtgttatctcatctgtaaacatgtgactagcaataatttatagaatgctttgggacaaataatacatggaagcatttaacatgatagctgactcgtggtaataggtgaataaatatttgtccccttctgtatcatttgatagaatttttcaagttgtctcacatgtgagggacaaaataaataaatgttttagaacaaaaataaggtattatgtctaataattcaaataatttaaaggtcatttatatttttttaaaaaaatccaaagaacactagagaatcaaaatcattttaaaaattaacttcatactagtaacaggccactagtaacagtgtatggaaatgaaaaagaggtattattctagttatccaagagcttaatattaagttaactagcgagagtggcaagaggcagccaaatgcctaggcagatagtggcaggtccccactgaaatcccacctctagccgaagacagtttaaagcctgaaagccacactacgagttaaaccctcagactgcattgagaacttgtcttcctgtttggcgtgctttcctctgattgatccccacccttcacctattttatatataccttccctttccaaattggtttttcacactgtcgtgcccacctttgagtggtgtctttgctttaaccttttttacaaccagcatacactccccattctgagtccgtaaaaggccccatacccagccacatgggggactttcccaccttcaggtggggggaccacccctgcatctcctctctgctgaaagctgttccatcactcaataaaattattttctgtcttcctcacccttcaatattcaccatatcctcattcttctggggcacgagacaagagcttgggaaacgctgaatgctggtataagctgggacatgccagtgtggccaagagaggcccaggtggggcatggcttgccgagggtccccggcttgcaaagagaccatgaagaaaaatcttaccttactagcattgctgaaggagaacaaagaagaataatggcatccaccaaaaatcaaagcaatactgtctcaaacattacagcagaacttggagaaaggtgttaaaaagagataaaaagtggacacagaaaaaagagcaaaacaaagcaatattctagttacatttttaaaaataatcattaggatgatttagaacaagtgtttgtaactctgggggtctctgaaccctcatttgtaggactagatgtctgcagtgagaaaataagaaaggaaagagaagaaatgtattctacacagaagtaggggaaagttccttaaactatgagtcacagctatttatatccgaacaaatgtgcatttcctattagtccaggagattctgtggtcttctacccatgcatttgtataaagaattgtcctctgtgtataagctgcatctctagaatatgaactccttgaaactacctagcaacacttaagtacctagaccaatttggacagacagcattattgggttgtcttggtaaatattggtaacttcaataaccaagaatgctctaaaatctatagctagacaacaggctatctctgaactaaactttagacaacagtccttggtagactttttttttttttttactctattatgtaaaagtagagacttatctagtaataattctagctggttcataaatctctgataccattaatttctctattgaagatctcattgttagtatttattataccaatcttctgttctaaagagataaaaaataactaaattttggacttctattaaaggctagggaccagctctagaatgaatgttctcgaccagggtgactgtccacttcatgaaagtagactaaaaataccaaactctcatatatacacaataatatatatcaaagtatttgaagtacattatagaaatcctcacagtaggggtcacattttcttccactttgtggcagagttctgagcacatagtgaccatgtgataaatattaattcagtatgtgagtgtatgaggatgtatgtcatcaatattctttgactgccttaagtgttctgggaaaaagccatatttttggtctcatttagcatatactgtaattcttatttttagggtgtatttatttttgttttaatttatttgatttgtgttgcatatacaatattgtacccatcaaatattgcttaattctttcatattgcaaaataaacagctattataagcctgaacttgttagtcttgctgggccctgcccaaggttgccctcatctccagctttccacaaactggaatattcactgatgctttgtttcttctcccagaccaggatacatgttgttatgtggttcctaggaggactgtaaagtcctctaacaaagacaaaggatggaatgaatcaagggaattactatgagaaagtagggatatccctggagaggggactgtttctgtgtgcttttagacatcacagagtaattgtttctttttttaaaggaaggaaccagggtgaagagcagctcatttttaagctggagaggttaacaaacactggctgcaagatttactttggtttaggaataccactgtctcacaggagtgtcaatcaaaattccacagccattcttcgacactaggaggtgggactgactgatgtacagcagtgatttgacccagcacttggggcaaacacaaccagagtcttcggtgttaattccctggtcttcccaactagcattctgaaagtgcattaacatttgtggccttgtgctctttcatcggacttctaatggtaattatgcctgtgtaatcacagtaaagttacctaatctaaatatgtaagatttcacactttgcttgcaatacttaaaatttcctactttgatctgacttttgctttgttcttgtccagtttaatatatatttgcatttctctctcttctctcagggcgtagaatttatggagtattgtaggcatttaggcagcctgtttcaaacttttaaataagaagttgtatctaaaagaaagtagagggataagtcaaatgatttttactatgagttctcagtaattgttatgttaataagtggtaagaaggcattcaaaaatatttgaaataatctaagtgctccaatatacacatgcttatatgcatgcaacagtggaggaatatcttaatagggcaaattcgtgtgtagccatcttttattcttaggaatatatatatcctgccagacatggtcatcccagcactttgaggccaggagttcaagaccagcctggaaaacacagcaaaaccctgtctcctgtctctaccaaaaatacagtaatacaatagtaggatatacttcctagtataccctaggaagactgttaagttatagatagtcattttttagccaaagatgtattataatgaatatgattataaaaatttagattctcttatattaatattgtaagacagagtggttgacttctcaatgttggagcaagcagaatctatcctcccctgcttttgatgttcaatagtgacaagtagaggtcacacgcagtctctgctgctggcattcctggcatggtcacagtgactactgtgacttgtttgagaggtgactttgaacatttattttactttcaggttagataatttagtcattgtattggcttgggctagtgaatctttgttacaacagccaataggatatatgaagtagtgttttaaaaaattagccattaaagacagttttcaatttgcaaaccatttctaacatgttttccatggtaagaattagctacacggaatgatactgggaaatatagaaaaatggggggtactggaactagctaaaattttacagattacaggtataattgttttgctggtcacacatgattatttctattggttacattttatttggacttgtattgtgatacattgttctatagaaacaaactatgccttaactttgttgtgatgatctaaaacagttggaaactgagcctgatgtattaaaagagagtacaggaggccatggtttgccgcagtgggcattgtgtgaagataagggactgaagaaggtgtttatagatatgaaatgctaatgcatgctcattcaaaaaatcataaccttgcttgtatttcagatctgtgcaattctatttgtcatttggatggctagtattgtgactcaagtattctagacaagctgtgattaaatatttcaacagaagacctcaaagaattactgatttataattacccacgttacctatgctacaataattagaaataaagaaattgaagtgatgtactgtatagtaatgctactaaacagatatatgtttatatgaaaaggcaaggaatttatgaaggctagtattatgtaaatgactgtctctaaagaattggatgatatattgcattttgttcattgattcaacaaatatttgtctgcccaatacataccaggcactgaccattttctgtaactaacttcatccacttagcactgcgaataatccaataattccccaggacaaatattattattcaataaattaaatgagtatcaatacaggggggtattttacagaaatcactgttctcctgggtaatcaggggatctgccattgagtttggtagcacaaatttttgtatttttccttaagggatgatgaaagatcagtggactcctaactatctgcagtctgtggagtctcaggttgcttagaaactcagcgactatgggcttgctatggcaacccaatttattagtgactgcaaaactaacttagctggcattgtggcaaatctccatattttgctggtaagaatattcagataagttcttctatcatactagtatttatattatttacactattgagctaaatatttatcaaattttgaaaataataaattatgatttataatggtcgagaactacatgaaaatgaagcttaaattctgaatgtatttttagatttccaatttacactgtctgccggttaccaggccattgccttagcttaaatctacagaatgtgatttatgatttgtactatatttaaagcatgagaaaacaaaactagtacagtctattatctatgtgccaataaaaatggtctgcaaatttagctttaatacttctatccaattaatagataaatttatgtatgtatagtataatttaataattttgttttacattacaaacttcatatataattgtaagattttacagtattatgtatttttaaaatcttatgtcttaatataccatgtaatctgatacacaaatgtattagaaaaccactttacttgaaaagtacatttttgcaattgtgggaaagacattagggaacatattctcaacctttgtttgagtatttgttccctgtagtacatttacaaaaattttgccctttctgattttagtcatgcttttaggttctgttgttttacatgctaacgagttctattgttttacactgtatataaactacaatcttctctgtacctcttcatatgtaagtattgcattcatcttatctccctattgattccaactttttgtttttatcacagtcaatagcagaagcagagccagcattctctcctgagacagactattacaaggttctatttactgtccttttctcctgggttttggcatttatgcattttgttttgatacttaagacttcatcatattaaaggttctcttgagattgaaagaatcagtctgactcaggtttttacaggacaatgctacatttgattatattttaaattttttctttatattttatccattgccttgtaattctgcaaatgatgaagttatttttgaatcctctagtacatcagttcaactaggctatgcccctgtggttgacgatatgtctcatctcacagacggaaacaagtacaaagagagaacttaggttattttcttggaattaattctcattggaacagaaaagccaattcccaggggtccttgcttaagcctccaattagtacaccatattgaccccctcccttaaaagaggggctttttttttttcacttagactacagacccactgctctttaacagaataaatgagcagtccagaacactaaacaacccaaaggaatcaaactcttatcaagggatcatgtgtgttagcctttaaggagatagtagattggcatgtaaaaaaaaattaggtggtagagtacaaatattcagaagacttggagaggattttcaacaggcaaaagcaaaacaatacaactatttcatgatacacatttagtgtttaatcatgctttttggtgtgactgaattattttaatacattttacaaaactttattttaatcaatatgtctgtttctgccaatggatacataaacacaactggtacattgcatcatttaaaatatttgggaaaagctcattgtgtagaagcatgtcattcattcttgtattatagttaataaatacctgtgaaagggaagaattaaatccctttataagaatattttctaatgtggaataatcaaactatttacctgtttgctacttgagatttttgcttaaaaaagagtacatctgttctttattccattacatgcatgatgtctattaaacataaaaaaacgcacatctggaaaatcatcagtgcatttaaacttgatcagatactggaataaacaaaggtacttcctctcctacaaaagtatttaacatatacatgcatttcttttaaaaatctatgctgtgatacatagagttactgtttattcagcatcaaataaaaaaaatttgagcacctattaggtatcaggcactatttaaaactctggaatataatgctaaacactaccagcatgattcctggtaatatgttatagggagtttcattgtgacctactctcttgctacttatgaatgaacagatgatgaattgagctattttggaatcctttctataagtggaacactaaaatattctaaagctatataaatgagtaaaatacagtcacatggtatatgtgcttcatgttatattaatatctatatttgttacatagagtgtagaaaaccatattgcagaaacactttttttctcctcctttaagagacctggttaagccatgtttcttgactgcactcatgagctagaagtttgattaagtgttttagtttattaaaaatacctgtgatctaatgcctatgttttaaatagaatcacaaggtatcagcttgggtgctttcaacctgtgaaccccaaatacctaagacagatcccagttaatttaatcccatctacccacggtagtcagagcacagtttggttttatgcattttaggaagacctgagacatcaatcaacatatgtaagatgaacatggattcagtctggaaaggtgagacaacacaaagcaaacacaggacaactcaaagttggcagggggtcccaggtcataggtagataagatacaaatggttgcactcttttgagtttctgactagcttctccaaagaaggcaatcagataagcttttatctcagcgagcagaggaatgactttgaatagaatgggaggcaggtttgccctaagcagttcctagattgactttttcttttagcttagtgattttggggtcccaagatttattctcccttcacaaacctaaattagctgaatcaataggaggacaggtttgcccacagaattgaaaactccagtgttagcactcttccggcacaggtggatcagattgctggctcttcttaactttctctgctctctccttatttggatggtaggtttgacacaggctggctttccttgaggttgtaagagggcctccagcagcatggctgtaggcttcctccttatacataagcagtggggattggaatagagaatagatgatgatagaaaaatcattcccactgctgttcaacaaaggagcacattttcatgagttctgggcaaatgtatgtcctataacactctctatttaattaaatgagaatattaaatagtaccttgacatttttagaggcaataccacattaatagctccacatcaacatatggagaaactttcgaatctttccctctgaacttagtgttaaagggcatctctggaaactaaccagccaagcaagactttctggaaaacaaggtactcctcactacacaagatgaattatagatgtggagttgtgaagtcttgaaatgttgctttctttcctctggaaaatacttaagcatattgaattagcccttagaggttataattcagttaactgagatggctcaattttgtcagatttattcattgttcttcatgtgtagaaatagaagcaaatccctcaacatacaccttaacactcatgtattggattattctaaaataaaaattgcctatttttagtttaaatcttattcacctagattgtctggagactgataaattcaatagtagcctttttttttttttggtatcatgaaaaaaagtattctaggtaattaatttgcatcaaaagacttagaaagaaaaccactgctatatttcttttatttttcacctaacctagatgacatggcagataagccagggaaaaattagtaaatagcacaagtttcatcttcattttttgaattttaatagtttgaagaattaaaatatttaatacttagggtgctaaatgtgaggttaagagactaagtagcagaataaggtttagttttggctgaaatattttttgatgatatttgcagacccatcattgtgtgtcaaactgtcatcggggtggtatgcccatcaaaacaaggatctgttaagtggataaagtgagcacatccttaaaaggagtagaagagctaatgaacttacagtttcttctaatttagagatatttgtgtttttctttgtggaattgtatgaagttgatttggagacagttacaaatttacatacctaaaaccaggtaccattttgaaagaaaattaagataaaaatgagatgtcaaatagccaaaaatcaacagaacagacaaatgtaggataatcaaagaagaaaaaattaagagaaaagtctatactgaaagcttattataaaaatcaatcttttgggatgtgcttctctatagcatgggaagtacttgatgcttttaatttgggattccagaaatggtgtggtttccatgtttttatggatttatttcacctcaaatttttgttcactgcaggctcctttcctcctgcctattttgattacccaattttcccggaggggttgttgaaaatgagaggaaaacaggcctagcaatgatcttggatcaagtccagaaaatgttcttagtccttggaatacattacatggaggatgccactccaagccttgtaaatgcagcttgggaaaataaatacgcttagagtattcactctgaacacgaaagcacagtgtggttaacaacaggagaattgcagagtatgccgaaacatagaaaacataaacatttcagtttagatttattatcttcacccatgaactggggcactgtagaatagaacagtttgcatacctacataacacagctgagagaccttgggctccaaaaaccaacaaaacatcgtgtccgagaagtctctgaggatctaagtgcaaattgagcagtgcaaaagtagcagggctagtggtgtcttttgagagtgacattctgtagcaattaagattccatacctactattgtttacttaattcacaaccccagaatacaaaagaaaagtgacattcagaatctgaaatgggatgatcacagtaaatatgtttgagtccttcgttgtttgctggagaacaatgaggatgatagacactttcataaaggcagggctcatgataactaaacctacataggagagttagaaggatgaaagatttctttctgcataaccacaaggtaaagtattttatcaagtccattgtaactgctccataatgtgaagcaaattttaaatgctgctacttaagtttcagggctaaaatgaagtttaataggtaagttagacttctctattattcaaagtttaaatgtggaaattccaaagtgaaggttttactctactgctgataagtttgcaatttttttttttttatttcaagaagataaccagctatcacaaagacacatacaggacagttgaagggtttcagtgttttagaatgattctgaagttctaagatatttgtcttatgtattatagaatagtagtctgccacttttcattatctgaattctaatattttctagaatatactcatgtaaacatgatataaacaaagtgatttaaataattcataacatttccagaaaaacatttctggaagttttatatatattttatatatatacataaatgatataaataatgtacaaaacacacatatttgtatttgttttttacaaagtattgtataatgctttgttaaaaccaaaaatgcatttagtgtaagatgttcccactgttaattctatagatgcttagaaatcttaagaatatgtgtcaagttattgcaaggtattcatttgagaagtagcactccaaactaaacctgttggtctcttggaagagcttcagaaaactgaagcttgtccgagagcaaaaccttcccttaaggtttttgagaaccaacctggaaaatgatgttatgatttcactataggatttgatagattgttttatattcctttgaaattattagcagaagctgctgtgccactcaagtgcagggtttgtgccaaataattctgtgaagtctcagggcagaatgatcacttctccatttaaaaaaaaaaaaaaacagaacaagaatggtatcacagatgtattatttcctgtgtttcttttaaattatttttgtatgcttcttagaaacttcaccccacaagctttaaaaaaatgtaatcaggcatgcttctgtgttcctggaaaacgtttgtgtgtgtatacacatgcatatctgcatatgtatttcagtcttttaggaagctaatgcccaagtgttctgtatctttaaacttgaggtaacagatgatcagctggtgcagatgtcaatataattttttaaaagatagatttgccagcgtggtttagtgtgtttatttattaaatggaacaaaaaatcattttatgtcatccttcatctgatttctttatatttttctgttttaagatattcatcatgctgatcaattttttatggtttaaacaaaataagaaaaacctaatattttagcattttaaaacacatcattatggccaagcctagagccaatgcaaagttaaattatttctctgaaccttctcaaaattatttattttattttaaagactccactttagggaccacctttttaatccagggctattataatatttctcagaactaaaatttgtggtacccttaatgacaatgaattttttctttctgcccggtaaaaattcaaaattcattaattgctatttttttctcaacgtttaaaaaactaggtgctcatcaactaaatgcttgttttggctatgaattattgatttttttcctgctatttcatcacaccatgctttgagacctagttattcttttgcctaaatgtttctgttttttcctcgaataatttcctatctactctatgaacacagtttacctaactatgctgatcatggcatttccttatgtttcttaccatcatttaaatgttgactaattttttttcctacttagagaattgtttttgcaagctgttcaagtaagaattaggtctgccaacatttttagatggcctgtaaaatttacataatgatttggccatgcccacatgagaactacctacatatacagaagtgctctctttaatctgttacaagcatgacttctattaaacctataggtaagattattttctacttttaatgcagtatgtttgtttttatcctgacttttgattcattaggccatgtggtttaagtctaaactaagttactctgatattcggaatttcacctttaataattttctggaaattttcttttaaaggtgatattagaaatctccatttcagtctcagcatttcactagcattacatgatgctcttgtcttttgcaatttaatattcaaattacatagatattttttattactgcatgtgaagtccttcctcaacttataaagcagttagaacatactaatactttaatacttctataagtgacgagctggcaactgaaaaatgttcatctattatacatatataagcataagtgtgtgtatgcctaaatgtatgtatgtatacatttccatgattagtattccctaaagattaaagtgataaaataaatgttgcctggttttacattggtaactaatgttatgagatagttcataggtcaatagaatgaaattttatgttttatttaatctaaaataattctgttgattgccacctacatatgttcactgttcattttctattgtgtctagacattattttgctcttaatgtaatatcaggttaaaattattcaacttgtgcaaagattttgagaaaaatatgtaaaattagattttgatcaaggataaatgtatctttttttttctttgaagaaaagagtataggcccttcagtcagtcagtttgggttccagcccttgttctgccaagtactagctgtgtgaactcagctagtcatctaaagagcctagtaaggagagatgattattcagcaaggtaatacatgtgaaatacttagctccacacctggcaggtagtaagctcctactatgtgttgactatgttattgtatgatcatcttcattgttctttgctcttcaagtctttgttcacccattcaatctagaattacaatgcaagttatactaaaatgcttcttttcatttgctgaactgttaaaaaaaatcgcttagttttcttttaaatggtatctactactataagatattcttgtatctgcatatagccttacattttaaagtttaaatctactatctgatcttcagcttaaaggtaggtagactttataggttatcccatttaacaagaaaggacaacaggaatacaatgattattacgtcttgcctagttcacaaatcctattgctaataaaggaatcacacgggccatgtgattcctcttccagaactcttgttacccatctgtcatttgcttctcaaatatgttgcaatatttgttactcaacttactgtactcttcctcttttatttcacaagtgttacattccatgaatcagcttgtccaaaagtactgttaaaaggattttttttaactatacaaatgctaaaagaaagtttattttttttttagtatgctcaaagtggataaaggctttcaaagcatgatacaatcctcaaaaggaaatgactcaaagtttatggaataaaaatgtaaacatttctgtaagttacacatacaaacagaaaagtaaaaattgtcaaattaaaaaaaaattgtcaaatgtccaaagactattttcctactaattattaagaaagggacaaagcaatttatggaaaaaaaggtgaaaaggatattgttacaaatgttttaaaataaaaatggctaatatactttagaaaattataaaattactgggggaaggttaacacacacttaacatttgttacttctgaggaatacaattggggattgaggcctctcattgtacacttttctataattttcaatattgctttctctccatacttaatacattttctaaaataaaattgtgcgtgatagccagtgatggccatgcaattatttgttgttgtttttgttttttgagacagagtctcactctattgcccaggctggagtatagtggcacaatcttagctcactgcaaacctccgcctcccaggttcaagcgattttcctgtctcagcctcctgagtagttgggattacaggcatgcaccaccacacctggctaatttttgtatttttagtagagaggaggtttcaccatgttggtcaagctactctcgaactcctgacctcaagtgatccgcccacctcagcctcccaaagtgctgggattacaggtgtgagccaccaagcccagccacaattatttgttaaacaaaaactatgtcaggctctgtgctaaatccttcatattatcacttttaatcttgacagcaattctgtgagggagatatttctaccatgtttaagagaggtaaagtagttagcaataagtcatacacttaggaagtgatgaattccaaattcagactcggattccattcattttcctagcagatgttcttaatctgaatcaaaccattacatatccatggtatgaagaagcagcataatagtctctcatttccactcattctcactacttgtaaagcattatgatggttataatagtcttgtgtgtgtctgtttattcaacttattaccaactatgagcttattctgtactataggggttcagtggtgaattaaacagacaagcatccccctcctcaaaaacgcaacattctagcaagtgcaaaggcaggtgcaaagttcagtggtgaattaaacagacaagcatccccctctgcaaaaacccaacattctagcaggtgcaaagacagggcaaaaacaaaagtcaattggcagaatttcttcgatggtgataagtgacctgtggaaaataaagcagagaacggagaggggaggaggcttgtaggaagtgggggtgatgaaatggggagtgttgagtgcctagaaattttcaggctcctgtcaagtattgtacactactcatctcttagctcttattattactcttttatttagttttctctattctttgattatgaaaatgagagcaatgaatgttaattaacttgattatggcaatcattttacagtgtatacacatgtcaaaatgattcataccttgataaatctggaaaaagaagaacaagcagttaacttccaattacaagtcaatataactagggcccggtagcctgaggatttaaacttacatccttccaatttctaaccctatgtgatctcttgcaaaaaaaaaaaaaaaagaatttccaaagaattgtctaaactgactgaagtagattgaaaattatatcctgtcattctaataaattaatccagtgttatagtggatttacataaagcaaggtatatgctcacataaaacacatcccttcaaaatatggtgggtgcatagtctttaaaaaaatgaaaaccccaacactctttactttaaaatgggtacagcattttgctatgttattgtttaaggtctatatttttctaaaaatccacagttgcagatttgactcagctgtgtgctttcagatcttgtatgctaagctactcaggaactgttgtctatgggattgaacacttaacagctgtctctgggaatgtaaatttgattctttggactgctcatgggactctgtgacattttcctctccagtgacagcagatttgaatggcattaggctactgattaaataatacccaagtaagtttaatgtcaacttaggcatctattttgcatgtattttttctgaaataatctttctctaattgcgatcatattttcattatactttagtcttttaatatctttaaaatatgctcttttaaacaggtcttatctgaaccctttcgttggtaatctttttctgaattgtcatattagagtgtgagtgtgtgagaattaaggttgagaaataaattagcttaaatacaaaacagctatctacaaaatagatattcttaaccaaaataatatgtctttatactaccattttatatcgtgccaccaagataaaaggtcgcagttatttaagggaattaccttcttaagtttcatgaaatcactgtgagttattcttttctaactgaaagcataaattataaagagattgcacatggtcatttctactttatcctaattaagtggtctgagatttgaaaaaaaagtaatagacttacaatatttttatgacttattttttaaataaatatgtcagtaaaaacttccctggggaaaaaaaattcttgaggagaaaagagtgtttggggttttttttttcagttgtatggcactgcttgcaaatgaaaggattcgttgtgtgcctcacatgcccaaaaaggacagcacgagcattctaacttaaggactggtttaaatatgacctaatgaactaaatatatttctgtctggtattcttaggttactttacttctaaggttgtttgaatgcatttatccagctctcctatcaaatacatgccaggttaaccctgtgaaggttttcctgtatgattctgagaatttctttataagaacagggtcttgatagtgaaggttctttccccaaagtgcaaggccttctattttgattcaatatcaacataatgctttttttttttttgaaagtgacttaagtactaaagattatcctcaatagtaattctacttagacatattttggttgaagaaatttaaagagtttattttttgtaggagcactgtgctgtgatcatgaaatttttgcaaaactaacagaaaatgataaacagttaagaacttccagctagaacaataggctgtttcctttttttaagtcagtttgtcatccttgctgattgacagtctccaattgttttcagaattattagtctcacagtatttcagaattacgctgtataaaaaagtacattaaatttaaacttaataaaataagtttcgcaagctcagtcaagacagggaagtgagaatatgattattcttccaaatttactatttccaccagcggtctcagttcagcatctgagaatatgttaggggaaactcagcaagtcagttccttttgtttttctggcctctgacttacttggatgggaaatagccaaaaaaaaaaaaaatgctgaatatctcagatataggtaatgggtcttcaccagaacataaaaatagacccttattagccatatcagtaatgtgctgtgtgggggattttttttttctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaaggtaagttgtatgatttttctttaaataaaaaagattaagggatttttcccatcacccagatgacgggaggtgacactactgtataaatactcctaagaagttatataggaggacaggaaaaaaggtagtaactgttttcttagtcactaggctttatctaaaaatcaggtttgcattattttcaagttatcaaccttcctatattttatgcttaaaccatacccaatggcatttcatgtcgtatgtataagttaatatttaaagtgatttataatccaatttggattattataaaactttcattttatacttaggctatttatacatgatgtttaaatgatgaagatcattatactgcagaccaatataatgaggttagatgttataaatgacttacagctcttatgtcaacatgttgtctaatatgcaattattaactattactttacagagtcattagcttgtttaattttcaatctgaattgcacaacttttggtatacctgacttgctctacatgatcaaatgcaatgtgtattttggatatgtgctttttaagttcttttctgtaatgaacaaagatattgtcattgttactgggaatagcaaagtatattacttttaaataatctgaaatttaattagtgtaaattagtagaataaaaataaagttaattttttttcgattcaggaagcttattacaaatagtactgaattattagatgatgatgccaagttgaagtaaaggagaaatcaatttggaggaattaagtaaaagcctcaaattaattatacattaactaaaattataaataactgtaaatggcataaattctctagagtacatcccagtttctgaaatcatcaagtagcatattgaaacctgttttgtaaagatttgcatgtactttttagtctttttctgtgtggtttgaagtcagtaatgtgtgttgaagctaaaaaatattgctttaaatattggttcacaaggaagccaaaatgaaatatttaaaaatgtttgttatatagaaagtccagtggtcctttggaatttacaagaaaataagaactaaagtagaaatcatttaatttcccagactcattagtgaaccagaacaataaaccaaacagagaaccatcagataatgggttagcctgggaagaatattaattacaactggaggtacttgcacagagtgtactgaatttggaatttaccttggaagttatagttgccaccctatttttttaaggaatttttttaaccttgtttactttaacacatttgaaccctgcatgtgtgtgtatttcctgtgtgtttcctgaaaaggaaagtttaagataattctgtaactatcagatacttaattctgtaagtatccttgcatctaatcagaagatgtttttgttcactggcccaagatgtgtctgaaacttgcaagtagcattgttctaaactagtagctgtctttccatttgcatattttaattccatacatatatgatcacatttcattataatctaactattttgcaaatactcatttctacttttgtaaaatatacacatttattagatttttaaaacacttggccaatatgaaataacactttactgttatggtttgaaatgatacttcatagtaatatttcaaaataacaataacattttctacaatataaatatatattattttacttcatttaatacttgcaaccttatttgatgtaagtaaactcattttagagaaaactgtatcacagacaaacttcaatactaacacccagaactgaatctacatttcttggcttcaaggtccagcatttttggcattacaaactttatagtgtctgtttatagtagaatttggggtgtggaaaaaagacattagcattcttgtctaaggttcaaaaattaagaatgggtctagataatactctttaagtcagtatgaacttaagggaataatttcaaacctacagtaatccctggttcataagtctttaaaagacgggacttgtttctagaaggatcccaagtataatatataaagtccaatgtatttattgcattagtttttaaagactaccatcaaaacaagttacaaattgcaatatttgagaagtatgtaattattttatattacagatgtctatcaagttttttcctattttacatttttaccatcatatattctgataggatagaaatggacatgagataatttcagtaagataagattctggagatctcatagtccagttatttgaaaattacttgtggagcccatgggttctttggagatgactcagagcccaagtgaagcgtgactgggaaagggaagaggcacagtttctgctcctttcttttaccaaataactcttctttgaactatcttttatattggtattgtgcataaaatttaccttgaaaggagaattctatctctaaacatgattttataaagaatgacctaatgaccttatgttgatgaaacataatcatagttaaatgattgttttacacccatttctactaccttgaatttgaatctacatttttactcatgtatagggaactgtgtctttataaacatacatagttatgataatgtgaaaaaagtaattttaaaaactaacttctatactcatgcaaaccgttgaatgaattcccccaagtcctccaaaaactagattttatggacagatgctgtattttttaggtaaggaaaactctctgtatcaagagaatggaaaacaagagtgtggtctggttttctatcctaagaaaaagtgggaggaaggcttatagatagaaaaaaaagaaattttagcaatctactgatcagtaagaaaatgtcatttaggtctggcaagtgtctatggtacaagtaccctggaaatctaaaacttttcaaatttcatagtttacatcccagcagatgttacttcagggccatgccttttctgggtggagtttccaagggaacacagctttataaacacaagggattaattatagatgctctggggacttgctctaatgttctaaactgtttactgaagaggcttcttatatctcagtctaatgcaggctttgcaaaaagcttagtctctgtttctactgggttcccaatatagtgggagggtattttgcttaaaagttcattacagaaacactgttgacctgataaccaaaaaaaaaaaaaagttatatttttcctccctctttcaaagatgacccaacggaatagggtccactcatgaattctacaaaaggaataggatttataatctataaactggacagaaggcaactgagctgcctatagaatcaagaaaggcatgtaattagttgcctattaaaacacgtcttcttattttccctttcttctttatacaagtctcaattagttttctgtatcttggctttctaaatttaagtattttaagcaggaagtaaattattaccgatacagtatcaatatcttgtctgtttcttataaaggacaagtaacaattagtaaagaataaaatttaatctacaattagcaaatgaaattaattacctattttcatatataaggagttgtgttattaagaaaactgagtaagcataacccaaatttttttatgctttagacagctaaatttggtggaatggtggagacaaactacattctttctctgaagataaatataggtggaaaagctgtgtgactacatgtgctatttaacatgaacttttctcttttgtatttggtgcacgtcttacgtagtatgggtggttctcctttgcctcaggtgaataaaactaattataattttgtcatatgcagcttaaggatagagtatgattataataacaatacttcattactcatggtgtcaaggcaccgagtgataataaatgaacccaactagtgtcacgtattttgcctattcttaggaaaaaggtagaaacttaaagtaataagaggcaatcaatcagttgaaaatttgaacaaatagacaagttcagtttgtctagctcttttttcaaaatatcagcacatggattgaagttttgttagattaatacttgtaattttgcttgtatatcatcctgaccaatgttagattgagaactgtctaaccatagaattcaacagaataaattacttgatacttctgttttctaatgtatgtgactctacagcagtgggatgtgtacactatctcacttcagttttaagttcaaagcagacagagctaggcagtacccaggcctgtccattgctcaacatatctaggctcagagtccatagaagttatactaatcagttttcaggtctagagagggagccattggagcgcatgcactactccctggtttcttcagtggttactgttggaactctttaccccttgcagaaactcttctctgtagtgcatggagctacttgattgaataaagaagaatgatttgggaaaaggccagatagattcacaactaggttgtggcatagaatctggagaagggctaatatatgcacatatacctattctaacagcaatagagttataattttaaatcattttgtatcacatttgtcagagttgcaaatgacattaatattgaatgagtaatttttagtgaagtttatgtggaacataaaataacttttccagagagataacttaatccttgagttatacatgttttaaatagattttcatactatattaacaaaactggaatgtgacactgggggtttcctgctgcattttttatgtgggctcataaagctgtgggtttctacagaggttctcctagagcttcctaacagtgaggataaagagtgtcaggcaggaacaggaagacaaagttaagaaacagagtctctgggtttcttaactgctgtggaatcagtcattttacctaatgcacttccacgtaagaattgaaaaaccagttcagccgcttaaattaaaaaatgctgatctcattttatcatctcattttacgcatgaggaaattgaggtgtagagagattatgtggcttgtctgctttcatttagcaagacagtgacaaatcagtctttggtttaatcttgtcccttcatctcaattgaaccagctgggatcgctatattttaattgcttcgttaagtataacttgcagaaaatatttggggatggtctatgaaatgggcattcaataaaatattatgtacctaataaactaccctaaatctcattatcagttcacaacatacagaacaccagcatgacattctctagttggcgattactgtggttgcttaaaagatggtttcaagaaaagtttcaagtgctttacaattatgcattgcaaaggaaattctatttgacaatatccagtcctgattaccagcattaaattactcattccattgcattaggacagccatggacaaagccatatgaggtagcatggtatacgatttccaagggcagggaaagctattgttaccactccaccctgaacaattaataaaaagccagccctacttgctcagtgagacagaaaattccacaggaaaaacaaatcacttgtttagacttatgtgcattccctttacattggagaaaaatgacactaaagaactagtcagtcttcttaatcaccaagaccttgatgtaaatgaagtttattgcatcctatggtttatactggaaagtatcctatgtataagggaataggcaaaggggaatcccaaaggttaagggaacatatgtaaataataaaattgccaagaaaaatatttgtaacatttattcctacattttgggggaaaatatcattttcttattcttttcttagctctacaggtaatatttttgaaaaactatatgattactaaagtggaagtaaatactaataaaatcataagagtggtacctctgttgcaagacagctgtggagggaaaacctgaaattataacaaaccacaattattaatacacttacaacattaacaacaatattctatgtgcccttttttgactgtagccttcattccgttggcacatatgttttctttggccatgagcatttcaaagtagagaataattgtttataaactataaagcgcattctgactataaatgacacgccaaccccattattgacaaaatgtcattgcaacaacaaagaagttcaaataaatgtgttttcaaatactagttagaattaactctgattattacagtaggatccactcatttcacaaactgtattctttcttccaatctttttttttttttttgagatggagtttcactcttgttgcccaggctggagtgcaatggcatgatctcggctcaccgcaacctccgcctcctgggttcaagcgattctcctgcctcagcctccggagtagctgggattacaagcatgtgccaccaagcccggctaactttgtatgtttagtagagatggggtttctctgtgttggtcgggctggtctcaaactcccaacctcaggtgatccacccgcctcagccttccaaagtgctaggatgacaggtgtgagccaccacgcccggctctcccaatctttatataataatcacatactatggctgggcatggtggctcacgcctgtcatcccagcactttgggaggctgaggtgggtggatcacgaggtcaggagttcgagaccagcctgaccaacatggtgaaaccccatctctactgaaaatacaaaaattaaccaggcatggtggcgtgcacctgtaatcccagctacacaggaggctgagtcaggagaattgcttgaacccaggaggcagaggttgcagtgagccgagatcgtgccactgcactccagcctgggtgacagagaaagactccgtctcaaaaaataataataatcacatactttatgaagacaccaaacattagattgacaaatatatactaacacaaactacctaattttaacagaattagcatgaatcaactgcaaatgacaaactatattgtagttgaatgtgtagggaaaaaattcttcagtaagagagcaatgccatggttgaaacaagacatcctctacattttatatttgcttcaaattctttatacctgtagtctatccaaagtcatcaataaaactgaaagtaagatactcttattttaaaaattccatgttttaaacagtttttaggacaagccattcaggcctgaactcagtattcatgaaaattagactttcttttaacagttattttaagtatggtgatattagagagtgtcccagtataaaatttctgagaatttttttctatttacccatgcttttcttattttcacagatagctttccaatgattagacgaattgattctttctgtgactcatcagttcatttcctgtaaaattcatgtcttgctgttgatttgtgaataaggtatcgtaaataaaacatctgttaccatacttgcttatcatttaatggaaaacacatcagtcaacccacattctgttcgcaggagagctccagaaggggtgtggaaggttgtgttgggtggagaaaccagatagtgaggatgcaactaagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaaggtacaagtagtccaaagaatatgccttctcattttgattgattctaacttctctttttttgctttgtatttacctgctttatatttcatggtaactgctaattttgtatctttgacataaaggtaattatgaaccactgcaactctatatgatgcgactttatgtgaaatgttataagtataatgtatatttaacatgactccattgctgtcttaaatataaataccaaattctattaaaagctgtctacaggtatgcatgttagtagaaataattgttttaagttatgtccaaagagcatgttggcatgcttttgagtaggaaataagtgagtatattttgtaaaagcacatttataaaagaagttgcactttagttaatactgagaaaagtaaaactgtgtgtgtgtgtgtgtgtgtgtgtaatgtgtttaatattgaaacataaatccttattaaattgtaggtaaacttgtttggtaatacactgtttagtaatccactatttttatatatgtgtaataatctcatctcataaatattttctatttgtgaagcttcatattggaatcttagaaaatactttcagaaatatgcagaacatgtcttagtataaaacaaattgactgtagtgtgaaaaaacagaatgattgaatagatgggctttgcacaacaacctagaattcatctcccaccctagcttattcgaattagctacacactcactcatcagaaacgttgattgatagggggaagaagagaataaagggaagcagttctgctgaagttctaaatcagggatggcaaattcaaatggctgcaggagtttggatacaggggttaaacaaaatttaaggtgccaagaacaagataaaatgaagaacaggaactgctgtgaactagactgtgtgtttactgcctgaaggcataaatgttcattttattaaacataatactggccaaataaaacgagttctgccttcaactctctacctggttaggatggcaatgacctagacaaagggttagtaagcatagtgcacgatggagaacaggaggaattgaatttttattaaatttttattgctatattgttagtatttttaatatttttgatccacagttggttgaatctgcagatgtggaacccatgaatacagagggctgactgtattgtgtttattgctaacatattgcagaacttcagcctcatgcatttaactgaaaaaacatatgtaaattagtatcccctgccttggaattcttagttttcttgatagtatttttaatacaggccaatggaaacagacaggtaatagtgaggtgtggggcttatctaatagtgggatggagtggccattgatctgacatccttcctactcataaactatgttctcacccagatcttatgcagagaaagtacaagatcagtgtctgtgttaacgtacagactacaacatcatttggaaaagttttccaaattcaaaaatcacaataatcttccaatgcacagcgatttagactacttttttttgctgacacataattattggtcaataactgagtattgatgatttaatttttttctttgtcatgcaacaaaactggtacatgtagattcttttgaatagcatgtgaggtgctagcatttattttaattctttaatatttatctttatgcttataatagttaaccatgagaaagtaagttttctgacatcaaaatgtgcttttgtataatgactaagagaataatataatctcatctattgtaagctataaccaggggaagatatattataataaaaaataccgagacctatgagactctagaattgaattggaaaagtaaatgctgtaatactttgaaagagaaatctctcagagtattcaagaaacttcaggaaaaaggtaggacttgattcagattttaaagaagtgtagaattttgaaagtctcaaataactgcagtaaccatattaaaggactgattgatagtatgaaaaaccctgtgaaaatgctaccaaatgcagtgaagatggaaggaagaaggtagagaatgtgcccataatactggattaacagcagaaaagattagaagttaacatggggttagagttaggaagcaagcttagaacatcaggcagaaaaatacttaattgatgatacaatacacaatagtcgtcggtatgtttttcagcaagtgtaagatatgataaaacctgaatttagagattagatggctaacatttaattcttactaagagtttcctatatactagttcacttaatcttcaaaaatatctgtgagaagttgctgttattttactcatcttacaggcgcaagtccttaaatcaacttgccaactcacctagccaatagggaaagaagtcattctccaaatgtaagcaatctgtaggaagagcctagatgaaaaacctggccttgtatactactctacagcagaaaggttgcaaagtgaggataccagagataggaaaacaaacaaacaaaaaactgtaggatatgaccactttcaaggagaatataagattcccttttagaaagatatttgcataatctgcacattatataacaaaaggcacactggtctggcatggttgagtatatagaaaaaaaaaactgatagataataggatgaaatggaagcttggagagacagattaaattagaggagtaaaagcatcaaactcaagatgtccagtgagttattgatagaaggtatgtatataccttacaaagtaaaacagaggttttataagtgatgttttatgaacatcagtctgtgtttcaaaggtcagagttcaaatagatttgatcattgctataaagattaaaaataaaactaaacagtagatttacttttagagagttttaatggagagaggaaaaagcagaagaattattacagaatttgtaataattcagaggcaggaagacaaaagtagaaaaggaaaagaatgatcttatatgaagaaacaaacaaagagtacaatcctagaagttaataggaggccagaactcaaggaaagaaagcataaaatgttctcaggcagatgaaaattaagaaaataatgattagaacatggtcaccaataattttgaaagtatactttgagtagggtaataaagaagggggaattaaatcaatggagtgcttttccttcttgtttttgaaataagaattatccgtgcaatcttttacaaggaaaagagaagattcagacttcctagtgtagattcaaactcaaggaggtggtacaacagagactcataaaaactgtcaaatgacagtgcacattgtaagccccctacatgtccatagactaagactcatcatcagaatccttatattggtcaagatgtatggtacatttaaggctaagcttctttttgctctcagattcctacacaaccatgttgaccttgttaatttagtcatatgaagtaggtggaatattgtttgaatagactgtttcttttttcttcagtttacagactattttttaaatgatattggcgtatgtatatctttggcatagagtaggagtcaaatatttgaattttgtgtaaacctagagagccaagtgtcttactgctgcctcagaaatacttagagtaatgctatttcacaaacatatgggttttggtactgttgacttcttatttgtgtaccattaaaactcatttaatattactttgtttagctgactaatagcaaattaagaaagctattgtatacaagtgatatttggaaaaaaataattaaacttcttaattgagaatgatgagaaaatcatttcatatttagtgtagagttgcagtgctgtgataccttccaattctgaaagatgtcattaccatttgaagtagtctaaaacagtttagcaagcttatttgtactttatttttgctctttattttcaagggatgtctctggtatcctcatgctttttatggattatagctgcaatctttcttaccagtatttttgaccgtgattcttaatagagttgtgtgcagccagcaagtttatgcagtctttcaaaaaaaaaaaaaaaactaaaaatcaatagcaagagctgccatgaaagtagaaactaccaaagcactgtggaaaagggtcaaaattctaccaccatttacaaaagataatttatcacttgacattattaatgtcagttgataaaaagtttagtgaatattgtataacataacataggtagttgtatgctaagcagattaatgcaggaacagaaaaccagataccacatgttctcacttgtaagtaggagctaaatattgaatacacgtggatataaagaagggaacaatagacacctggggctaatcgagggtgggaagggggaggagagcggaggatcaaaaaactacctatcaggtactatgcttattacctgcgtgaagaaataatccgtacaccaaacctccatgacacacaatttacctatataacaaacttgcacatgtacctctgaccctaaaataaaagttggaagaaaaaaataaaatttaaataagttctatagttctaactatagaacaccaaaaaaggaattataggtttctttgttcctgttagagaactaatattaaatatcatcattcaattataccatttttccttctcccattcttgaaaacaatgatccttctgtagcttgtaagaaatgccttcagacaaaataaattgaaatcatgattcattaaaatggttatacatggctgggcatggtggctcatgcctataatcctagtacttcgggaggctgagacgggtggatcacttgagctcaggagtttgagaccagcctgggcaacatggcaaaaccccatctctacgaataatacaaaaaaattagctggatatggttacacatgcctgtagtcctagcttttgtggggctgaagtgggaggatcccttgagcccaggaggttgaggctgcagtgagctaaggtcgcgcctctgtacttcagcctgggtgacaaagtgagaccctgtctccccccgcaaaaaattatgtttgaattaatagtccatattttaaacatataatttgtttatattacctttataatgtatgcttctagtatttccagatataataaaataatttgtactttttcatagtatctaaaagctcaaaaataaatgactaaaaatattaaagatggtaaagtttgttttatatttaataacgtaagaacaacccaaaatatttaaattaaaatagcagtataaaaacgaattaaacactatgtatatgtgcatatagctgtaataacaaatgtcacttaaagacaatgtttcaagaaatagacaagcatatatgtttcttctactagtccaatttaatatcaacatagtttacttttcatgccaaacacaacatagtttacttttcataccattttaggtacttacataaattcttggaggctaatttctaggtttcagaaacatattaaagcttactactccaatacatttcacctaattttattctgggttttagttgatgatgatgttctgaaactaaagccattttcagattctctgcataactgtcactacaattctaattcattctcaacttacacacacttgcataatgcaaaaacattagaatttcttttaacatggggaaatgattcgttttaggcccaattacaagcaaatggtagcagctagtgggaaggatggaagtatgcttctggtttttaagaaagtttttactttactagaaagagaaatattaaaatgattaaataacagaaaaataattgtcacaggatattatataagttattggcacatgactggcttagacagtaaatgctatgaaccaagcaattaaagcagaatggagaagtaaatggtattagagttcttcctctaaaggatggatagaatttgtaaaatactaatagctgacatttattgaatgtctggtttgtactaacactgttctaagtgttcacgtttattgatccccataacaacctatgaggataaatatttaagccacatgaaaatgccaaaattcaactttttttgattttcaaaaatactaagtctatatggttcaatctaacattactgttataatttcacagataaggaaagtgaggtacaaagaaattaaataatctgctcaaacttcaatgatgatgattattattaagtgatcaaactcatagcatctaatttcattgttggccacttcagtctatgctttagggaagaagccactataccttgttagggtggggatagggtaaaaaaatctaactcgtagattaaaatctgctaaacatacttctgtctcttggtagaaatgtgtaaagtccttgaaaagtgaaacaaaatattttctacatttgtactctactccatgcgtagcaaagtatgaagggcattttaataatgaaagttgtcagttatgtagatgattattgctgttgcatgaaaacagtattcaagtgagtgcatgactacatataggatattaaggtcccaacaagcatctgttttcaaattaatgtagcagaatagaagtttcaaggtcagtgctttcaacccagctatagaacatgctatgtgagagtcaccaggttgaaatccagttgttgttggggcttggtagtctgcatgcttagagtcagggacaaatacacacatacacattagccaagtgagaaaatcttatatcactttttctgtgtacatacttaccagctttgtacttcaaatttagtaaaatatttgcaaaatagtctagacagtccaaattcaatttaaaatcaagttcttttaaattcacaaaggacataacatcttttgtttcttgtgacatatttagtcttggtattcaaggagtgactacaatttaatacatatagtagtggtagcgtcagaagcatattattactacttcgactacttcaatatttttctctatgtctctaaacaaatcatgatgctatggaaactatataaaattgaagtgaaaggacctgatttttctattatctgctagtaaatttgtcacataacattgagtcagacatctcttttctctagaacccattttccacctctaaaaaaatggacggggttagatagtcctgattctaacagttgataattcaacacattcatttcaaccctgtgtttcacgtttgccttatttgtcgctagagatattttttaagggaaaagtgatttgtggcctttagaaaaaaaggtctcatacacgtacaatgtcttttggtgtttagatggacactcattgtagagttaggaaggcattcaatcctgtcaagcacattctgtcacagactctcttcaattctataagagtttgttgagtttctttcattaagagatattaggtcggtacaaaagtaattgtgatttttgtcattaaaatcgcaaaaaccgtaattacttgtgtacaaacctaatatgtaccttgagaggcacttgatgaataacaggtattgtttttgagcattaagattctaatagtgtgaggagaataatgtttgtgtttgtgtgttctcccttgttaagtctcttgaaatggagaaatcaaccgttttcagcttctatttagctttgagcttcaacatcctcaccaaacatatttacatttagaagaatatccataatgctttaagcaattttgtcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgaaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcaggttaagttggagctctttaacctgggcattcttcccaatacttcattagaaataccgcctgcttcaaaatcacctttgtttgcactatctactacagcgtaatagacttctggctcagagagtgaaagctgtggaagaaaactagaagaatatttatgttaactcccttattttacagctaatgaagttgaccctagggaggtttgatgactctccacccagtcccaaagctcctaaagcaaggaatcgagttcctaatgtaggatttttaattctcttattggtgtattttccacttgtctatctttaccaaaggagcatcagtgatttttagtggatttcacaaaggagtaataggacagcttccttgtcctgtttttttctttaaaaactacaacccaataatgatgagtgaggctgttgtaatttttggaaacatgataatgggttgttgcaaatatattgaaagttaggggctgtgtgcagtggctcacacctgtaattccagccttttgggagtccaggtcaggtggattgcttcagctcaggagttcaaggtcagcctgaccaatatggtgaaatcctgtttctactaaaactacaaaaactaggtgggcatggtggcacaggtgagaggatcacttgagcctgggaggtcaaggctgcaaggagccaagattgtaccactgtactccagcctgggtgacagagcaatatcttgtctcaaaaaaaaaaaaaagaaaagaaaaagaaaaaggttagggaagccagattgagcaggattttgaagacacggtgtcaaatttgtgttcttcatgtagatatttttattttcttaatgtagtgagtgttaagtaccatcctctgaagtgtccaactcttgaaggaaaagaaaaagcttccaataccattagatttttcactcagtttttgtgttttgtttcatcagtccaacttaggggcagagaagaagttcaactcagtaagaacttttttgaacttcggtaaaatttgcttaataaattatgttgactgttgcaatattttcaaagcgtcactctaaagcttgccgaagggtcactttaaagtttgccttaaaatcaacagtcgtgtcttcagtattacacactgattctctttgtaaaaggctaaaaagactgctgtaataataatttgttgaaaacatttctgctgcaagtgtatggtaaggttgcaaaggttctcatgaatgaggtacttgggcttggtccttttattctggctgactcaaggctgcaaacaatcttccagaagtgcctgtacttactacaaagacataacccaaacttattttctttttcatagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacaggtgagtgagtccccacaaatatgagacactcttaccttgaccatgtatttctgagaagtcttctacttggcaaatgtcattgtattgaaatgtacttattattttcttgccaaaaatatactttaaaatatttttcctgtctgtatagaatcctaatctaagaatttaatgattataaggtatttattttgaaaaaagtggaagatatatacattatccaaatatttattagacaatatatagaaaagataaacagattttattataaacttaccagtatcaaataacttccctatgtttatgaagttagtgttttgttattgtggcatatattctcaacaactctgaaatattcctgctgaggaaaaaaaaatcagttttcacatcttaaaatttaaagcatattttaacagtggttctcaaagtgtagctgggccacagcaaagtgctgggccagctgcatcagcattaacagggaattgggaaacatgcaaatccctccaccccatcccagaccaaatgaatgaaagagttgaggcccactaaagagttttacaaatcctgggtgatttgaatacacaattttgagaaccaccgtgctaaattcatttttcctaactgcggtacctactcaagatttatattcaaattaacttctgggtcatatagatgtttacattgatctattttagtttcactcttatatttcctctagtgttgagacaatattttatatctttcctctgccttccctgatagtttaacacacttttgaacagaatcttagagtattagaactagaggaaatgatcagccagaatctgtcattttgtgagttaaaaatgcctgatccagtggatgtgaggtcacttgtccatgttcacacagatgtaggtactggtagctcctagatttttgtataccttttcttccatttcaattatagacactctgtctttttcactaaaaagggaaaaaagggggagattgaggtgccaaaaacactaccttaaccaaggattaggaatatatttatggtatccatatggaaacatagttatgttctgctatagaatttgttacctaaatgtgtattttccctcatggataatcacaactagttatacaccatgattagttctcatcacaaagttttgtatttctaatgattttttataatttgtagttttagcatcttatctgttttggttatcggatgattgtataattttccttcttccccaaagcattactatgcttccagattgaaaattcacacccaaaataaaatgaaataacaggcatggtgagggtggtgcctactaccatagcacatgacatataagccccagagggccttggtgcatgtcctgtcttagcagttttacccgaatcgggtgtctctgtgcgcatctgtgacaattcataattttgtcaatgaagacttagtttttatgggtacaaaaacatcttaccttagaattttcttcatggtcttaaagtttttatattattagcaagagtctatacaagtatcttgttgcaaagaatgttgttaggtgtaccatatatatatacacacatatatatatatgtattcataggtgtatatatacttatgaaaatctagaattcacatatgacctaaggagagtatcagcataattgtttaagaaatagaacctaagtgaactgagtaagtgtgaggaaagaaaatagttgttagaatttgagaactcatcatgattttttttgtttgtttgggggaagttatatttttcacttctgtttttaattttgtttattttttgaggcaaggtcttgttctgtcacccactctagagtgcagtggcacgatcacagttcactgcatcctcaacctcctaggctcaagtgatcctcccacctcagcctcctgagtagctgggaccacaggcgcatgccactatacccagctaatttttatgggttttgttttgtagacaaggtttcgccatgttgctcatgctggcctcaaactcctgggctcaagcaatctatgtgccttggcctcgcaaagtgttgggattacaggtgtgacccaccatgcccgaccatatttttcacttttaaatatattatttgggatatgagaaaacatattattgaaatagttctcctctggtagttgacagctgatctatattttattcttaaagcctttaacctatctctctaagggacaaaaaggggatgtgttagatatatttggtttgcttagagaggcaatggagcaaagactggagaagaacagttgcatttacagctaaattttagaatccataaatagctctttctgtaacaattttaaagggattcctgattatctgtaggtcatcttgtctcagcatgtcaccaaaatagtcttttattgtttgcctgagtgccttaaataatggaaaaacaaccagtaccttttagaaaaaaaattaacactttgatagtgcatgtgttgagctaaacatgctttttcataactaattataccctaaatccatctgacattggaagtatgtgagaatgtccctcctcaaacagaaccacaggctgtatttggccattgtctgctaaagtaagcttgattacactttgacaagatatgacctgaatcaaagcacgaaattgcttgggttgagatcttatgtgtgtttctacctacaccatctctatgaagatgctgtaattccttcagaatattcttagatctgtaattcattttttgagttactttgctttggaaagaatataaaaagtaatcttgagaaaagcataaattccttcccttgaccttataaacaaacacgttccaaaacttccatacagtctaacttttaaacaaaaaattcagtaattatgttccctttttaaaacaacattctaaaggcagggctgttttaaggatttttcttctagtgactgccatctactggtataatgttgtcagtacactttaggtaacgtgacaattatgttgctattgttttaatatatgggcatatttctgaaaattgaagtactttgatttgaaatattagtaatatgcacactaatttaaaatacaattgtcctgagtgctgtttcagatttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtaggaatttacatttttattataatggaataaaatgggtttttaaaaaattcagtccaattgcttaagtctttaccttggctatctactcacttcacaggcattcaaatatgacagtgcaattatgatatatatcttatttcttctcagtgaatatcttccacttgtgaaatgtatttttcctgtaataatcacccttcaccgcgttcctaaaatgtagttggtactttgcagcctagatatgttagagtcaggagattagaactagcaaaagtattcaatatacttgaggggctggggaagttagtctataacccttaaaaatggaaattatattcttatctctaattctcattaaagaagtcctgaaaaagggaaaaagcagtgctggataggccttgtattttgatcattctttctaatataagaaaatgtgctctaaatattcccctgctgaagcccctgtactttttcctccttatcctcaggataaagtctcgtttgagtattagatgcaactcttttatgtttgagatcttacttgtttcaataactttatttccactactctcctcacctcttactctgtaatccaaccacactcaaatatctgcatttcccaaaacatattatgttcgttcttatgcatgctaccatctgccgtactttacctaactaaacttgtatttgttacatagaccatttatgtagacttgtactaaaaagtgttttaaccctcacccctaccctgaccattctaaatctggatctggatctgttttgtgttttcccatggagtctccattataacaatattccttctctctcactattttaatttccagtttgccagtttaagaccccttctcgttagtttgctagagaccctggctgatttctcattttaacaccattgcttacatactatctatctggcatattctgtgtgttcaaaaatcatttgttgaatgaatgacatttgagatctaatgttcacatatgacaaatgttttgaattttgtttactgctatttctttagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagtgagtagacaaacaacaaagttatctattttaaaatactctagaactcatgtaattaatcctatcattagaattattaggttttacttgtttttccatttttatcaaaacgtattcctatatcattattttgaatggaggcatggtcatttggaaagtgacaaaatcataagaatcgactgcattagaagaccactttatttttttcattattttttgtcgaaacattctctatatttaatttcaattttataacagattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatcctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggctttttttttttttaagttctgggatacatgtgctgaatgtgcaggattgttacataggtatacatgtgccatggtgctttgctgcacctatcaaaccatcatctaggttttaagccccgtatgccttaatgcattagatatttgagaagaccactttaagtgtatcgttaaataaatagagcttaacttggaatgtcgtcttcttgtggctggcactgaggcaaagaaatgtaatcatctaggaattagacgaattgcattttgagttttggcaggatctggcagtaattttaaagataagctttaaaaagttttgtattaagctcaatattagcatttaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagtcttattgctgatctggagacatatatcctaactttttaaaaagtccacttctcattatagcttcagctttcctagttgggaaattcatctgaatttaacaattaaatttaaacctgaagaatagatttaataaggtttctactcatttataaatacacaattttttttaaattagccggtaagctagtctgtaaatctttgagcactgtttttggcttttatttccctattcacataatcaagtttaataccatatttttatttgttttaaatatactcctcattcctccttttctagacctcttacaattttaatttatatttaaaagttagcctaatgttcacatctcaatactgataaggtaatagacttcattttaatgggatttgtaaataagaatttttagtagtccataatgtcatgaaatggcagcttgaagattaaggaaaatgtgaacttgatggtgtacttgattaccgcttaatgttttgaattacaaataggataagctaactactgaattggaagttggactatgacttcatttggcactatatgtgaatattatgttctctagttcattgttttacttttagatactgttaggattacaaggttatatatcaattataaatgaatgtagaaagccataatgaatcaaattcattctgattttaactcaatactcatagctctttctttggctaatgctttaacttttggatgtctaatttttatcattttagtaaccacttattatcattttagtaaccacttattaatgactgtaacatttagaatacccctagaaatcattgttcttataggtttgttcaatgtccctcacctcaacatagtaagaatagtgatcaaaatgccctcattggcttaattatgacagagtgctagagttcacatcatgtcagcttctgatatgtatcttctttgtcacagcatctagcacttatttctaggcacctttcacaatttttaaggccaataatttaaaaaaatgtattgcagatgtatttcaagtcatttgagtaaccagtgattgagaaatgtgaaagtgagttatgtattgtacaactttgaaaaaatgacttgtagaagtaacattttcccatacatatatttcagtacaacaatactgcagatggagtttataaagttttcaatggaaaagataacataagtaaagttgccataatcgacacatataaaggtaaaaggtaagtattctggtaaaatgtgcatgtatgttactagggtactcttaagcaggaatagtattcatttaacatctcataagacataggcatcaacctatagaacagacctggttataattcagctctggaaactcctgttctgctaggtattaactctttagttgtggtaactggtgagttcacaccagtgcatagctgctgactatcagctccactttaaggtttggttcacctttctgcacaggttatggttgtgttacataaatccccaaagggactattttttcatctctgctacttatccagcattacagtataattattcttacaattagataaccataaatgaaaaggtaaaaaaaaaaaaaacaacacatcaactgattgtgtagtagatggaaactttttttttactttttaaatcgagcatatcgaattccatattccagtggcatgacctaaatgtgtctataaagatggaagcttaatgaatccaggcaactgctttcatgaccttccccctgcaaatagtctttaataattttccatattgataactcagcttttttaactttatcaatgcaaaaatagaatgaatatttcaagtgcagttctacaatgtaaatacaaaatgtgaaaatgaagactttgccaactttaaagtggtaaaataacaaatcagcttcctaagccattatttcctttttttttttctagctccagcctattcacctaaagaatttataatttatcatatatgtaaactaggaagaaccctaataaatatcagaggaacaagctttcttctccataaaattaacaattgtgtgtttgactagtttttttctgaaaaagaataaagtgatcaaaaccaaaagagatgaaatgtttttattaatataaagtaacccctacctcaaactgagtctatctaatgattgcttttaacagctaaatattactagtggagtactttttcttctaaagagtccacagttacatatttttatagaaaaagtcagtagagggaaaaaaacacttctaagtattcacttaaaaggaaatcacagcaattttttatattgagaaataacgagcatttcactctaatattacagagagatgtggaggggagttgcaaagcactcctagttagagtaagaatttcacatcattttaagattgtaaggttgatttaactcatggcaagactgaacatgattaaccacttattttgtttaagcaatggcttgtcttgacatgtcactgtcaggagtggaaaaaaagtttttccatcaccaaaaagtgaggatgcagggaaactattactattgtttttatcacttccagatatatatagcttatttagacagcaaagtataagttagtaaactctttcctactttaacgccagtccatgggagaattaaagggaggaaggggcaagaatataaattaatcatctacatgttttgaatgtttgctgatccaaacatctgcttctttcctcttccctgcttctctcttctgcctgccttgtacttagcttatatcagttacccacttaacactttccttctattcattctgaacacttatactactgagtaattcatgtatcccattggaaaaaaaaaaatttcccctaagtagagatctaagtttctgataaatgtttttaatttttttcttattccaagatgtttctaattaacacctggcagtttttattttatgatctggctacctaatggcatcaggtacattgcaataagataaaaggttcaaacaaaacataaacagaattgaacatttcttaaacttagtacttgtcacatttaaatgcatcatattaacagaagtattgaattataatagaaaaagtaatgtaagaaaggtattctttaaataagaatgtttattcattgtctttttctattcctaggaatctgtcctattgggaaagtcactgcgacatgattaatggtacaggtaagaatatttgttttgtggtcatcacagttaatccacctccctttcccacaaatccaccgttgtactgacagtgttctgaaagttgagggtgtgtgtttacttgcctttatatccccacaacaaaattcagagtcactatttgtatataggctaaaggtctgttcaatgtgatgggatttgtaaagattaatcataaaaaattagcccttactgcatgattcagagaaatgtttgctttgtaaaaactttactgccatcctggcaacagaagtaaatggtaaaaaacaaacaacaacacaaaacactttagttacatttcaaatattttataaatagtatacagataagttagaattgaaagaattaaaaaaagctaattacaaaatagaaaacatatctaagcaaggcttatagctgagatagaataaagttgcaagacagaaccatccatttttggataaggtggtcagaatgagagagaaaacaataacaaagtcagatgtcttcttaactgtgaaaaatatatgtaaaaaatgagcattcataaacttagatttaaggtatggttagatcaggcttattctccttcaggaaaagcaaagtacagatatgcctattagtttaagaattaagatttttaaaaagcaatgggaggctggtcacagtggctcatgtctataatcccagcactttgggagaccaaggcaggtagactacttgtgccccggaggttgagaccagcctgggcaacatagcaaaatcccatctctacaaaaaaaatacaaatattagctgggtgtgctggcacacgcttttagttccggctacttgggaggctgaggcaggaggatcacttgattccaggaggtggaggctgcagtgagctataattgtgcctctgcactctagcctgggcaatagtgtgagaccctgtctcaaaaaaaaaaaaaaaaaaaaaagtggtgggaatcgaataccatgaagtaattaatatccagaggcaagctttcaactactaggaaacaaaagcatgaagtttagaaaattagggaatatcccataggaaaatgatataacaaagataaagacacttaagtaaaaatgaagtacagagaatgtttactttgccaaaggtatgattattgacttcgtatgcgtacttgattctatcattgccttgtaggaaatgataaacaaaaaaagcaaacaaaaaaaacagcaaaaacactgttggatttgcaggggttttcttttgtttttttttttttttttttttgagacatagtctggctctgttgccaggctggagtgcagtggtgcgatctcggctcactgcaacctctgcctcctggggttcaagtgattctcctacctcaatctcatgagtagttgggactacaggcatgtgccaccacacccagctaatttttgtatttttagtagagacggtttcaccatgttggccaggatggtcttgatctcttgaccttgtgatccgcccccctcggcctcccaaagtgctgggattacaggcttgagccaccacacctggccaaggctttgcagggttttgagccataggagtgggcaaataagctattttctaagtaaagcatttctggaaataaattttcaagtcctcaatactaccaatgctagtagttgtataagcggaatacttagtccttagatgcagagataaatatactgtgttaatcctagtaaaggattctttaaggagaaaaatctttaaaaagaagattcattgacaataatagaaatgcatgagcatcaggcatgatgttaaaaatatctatggggaaaatagggctgatacaaactaggaaaagagggaatttggacagagcaggggatgatccctgtgagagagattcttgcttatggcactagcgaaaagaaagtaataaaacagtaaggttctaatgtgttttcatcgtaatttagaagtgcatcctctttaccttcttcagtaagtttgaaaagacttaaaatgaaagtattggtatacatttagaatgtttcttttgggaggacagaaaaaaagctctgcaaatatcaactatgttgcagtcattgtccatggtagttgctgggtataattaggacataatcttcaatgatattttagataatgatcttaaaagcttttcaatgcatttttctttaattattaaggaaatggaaaagcagttgttgtcaatgtccatatgggggcttatattttacttgtcacaagagtgtaaactaatgaaaacaaggtcacaaggttgacacacttgccagagaaagaacctacaatgcataatcaaagatgagacttaccatttaaaactcattcaatgacggctcgtattagtgatattcatgtgagaagtacatggaggagttaactatttcttcatatatccaatgtttgccatggatcatagctgtagcaaaaagtaaattcaataaatgacttttttatacactttcaaagcatttgaagttctgtttagtgagagaactttagtaaatatttttagaagtagtaatcagccattaggacaaatgagaaaaaaaatcactacaaataaatgtggacatggcaggagatccaaatgaacttcactggaagaaaagtgccactctactggtggggtagggcatttcaaaaaacaaacacaatgttagccttaacatttcatgtttaagtttcttttattttgtaccattaaatatgtatagtatgtagatttgttgttgacaatagcagccgccagccatatgtaactgttaaggactcaaaatctggctagtatgatttgaaatgtgctgtaaatataaaatgcacagtagattttgagactttaagaatttaaaatattttataatggttacatgttaaaatattttggatattaataagttaaatatagttttgttttgtttgagacaaagttttccacttgtcgcccaggctggagtgcaatggcatgatcttggctcactgcagtatccgcctcctgggtgcaagcaattatcctgcctcaggatagctgggattacgagcgcctatctcaggatagctgaggcaggcctatcctgcctcaggatagctgcctcccaagtagctgggattacaagcgcctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccggttatttctttttaccttttaaaaatgtggctgctagataaattacttaggcagtttgcattacatttctatggactacactggaggagagatttctaggtttttttctagaacacacattacatctaatcatttgccactcgatttttaaacagatgcagcctcatttccaccttttgttgagaaaagccaggtattgcagttcttttcttctgatatttgcaggtaagacagatactgaagtataagtatgtctgagtcagaccccaggtgacaaaatgcagaccaagaaacttaaacacagcataggaaattcatcatgtttattaactaactctttgcaaaatgttcttctgcatcttccaatttttaatagtacaaattttttttttttttgccatttctatctaagcaagaaccattttgccttttaaaaactaaactagtagtctattaacgatcaagtccagaagggcgtgcccaatctttctaaagacatacagagaagatgatgcaaatgtaacagaactgtgttaatgtgctctgctcagatttgtggggcccagtagataacacacaagcactggagcctttaccactacccttgagcccaagctctgtccctaaagactgtatgcttgtgggtaggcatttaacatctctgaatttttttcttatctgtacaatttaagacagcagtatttcttcatatacgtgtatctggggataagaaaaatatgtgtattgaaccctatgatagacacttggtaaacgatggaaatgtaccaggtatatatccagcatgtatatgcatacactccagtgagtggtctttctttccaggattaattaagccgtgaaagaaactatttcatttaaactgatcacaaataaagtatttgaaggaagtcctataaatatttactctattggataaattgcctgtgagaagtaacttgagtataaataaacatggtacttcacaaacaagaatagttcatgcttggctattgagttttagtatgtgttaaaatttcccaatcactttttttctaagaatgaaacaagaatttaaaagagtatatgatgtttctaagttaaaacaagaataagaaaaaatgaatctccagaatgtaagttcaggttcctggaatgcagctcttttttctctgtatttaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaaggtgagtaaataacctcagtagcacagtccataccataatttgtgatattctttaagatgagaactttaccataatcctttagcaaccaaaatttaaaatatatcataatttgtgatattctttaaaatgagaactttaccataatcctttagcaaccaaaatttaaaattaaagtaagaaagtaattagggcagaagaaagaatggtggcagaaaattttagtgctgattttgtattttgggaagatcccacttgtgtttcagtattacaaaatttagttaaaaccacaccagtatttccttgtggctgcttttagatttagggtgaaatgaaaataattccgagaacacattaaacatcctgttattcatctgtcctaacttttttcactagaaaatggtacaggtaaatgtattttcagtatgtatctaaagctagagttaaacataaaatttggagactagcttatcctgtacatatttatcatactaacgtgggtgtggaagaagaaagaaaaaactagtgttaaataaattcttagtccatagacatattactgcctgaaagctttacatattgaaaattaatactgaaggagtttatagtagaaatcaactgacataattcttccccacccatgttaaaaaccatgtattttttaatgcaagaagctttagttttgtggaaatattttttgagttatatgtgaaatgaaggaagttattaattccaattgactcttaaaacttgtcttcagggagacctgtgtacatttcacttcctcattttctgtatgcaagtcctgatgtttcagaacctattgatggattaaacccaaatgaagaagaacataggacatacttggatattgaacctgtaagaaaacaccttattgatctgatttggttgatatttttaaaaatacaattgaaataaaaataatcttgtcgatgattatttattcaataaataatcatatttattgaatcacattcttgaaagttactgaaacttaggtcgatttcttcctatggtttatgaagtgattctaattggcttaaaataattttatataaatatttatgtttagatgaggagttattgtatattatgcaaaagtcaaagagtatatgtgagtttgactatacttattgtcaaaatctataaaattgttgtagcgcaacagttttaatcatctttatttttgtattttccttttcaaaaagtaaatgaaattctaggattttagtagttatgttttagtttaaacaatgacacatggattctaactgaatatatatttgaccaggaattatctgagatcttatattttgttgctgatttttgattttttaaaaaccatttcaagtaactcacaaatctaactaactaaaaccttgacattcgattgggcaaataaattgtgtgtatctatatggatgcatgtgtatataactataactatatatgcagttttaaaagtttcaattagtcctgtttaaccttaagttactaccttctcttctgctgtaagaaaaataagttttgaatagtataaaataatgtttttaaaagttggtaattatttagttgttctctttttagataactggattcactttacaatttgcaaaacggctgcaggtcaacctattggtcaagccatcagaaaaaattcagtgagtctcttgaaaatggttattttgatatgatctgtagtatcgtagtatcttcttgtaagaacatgagtaaatctatgtaagtaagtggaaataacatctgatatcaacttatctttagcttaatgtcaccaatcattattaaatgcttatgactaatttcacagattttggaatggttttatggttttatttgagcatttgatagcatctcttattttgttagctgcccaaatatttctatgacaataattaatttttggaattcatatttcagttccccgagaatttattgaaaggaaaaatccacacttgtgaaaaaaaatcaatgtgattagaagacatataagagcaaaggaagtcaaaaacaactatattaaaatttaaatgagtcattacaggaacaaaatcaaattagcaacagcaactaatttatgaacatttattttaaagtttgttatatataaatattagtttatatgttcataattattttcaacgtatattacagagtattaaagaatctgaagaggaactatattgtgcctattctttggcttaatgaggtttgtatttgcagctgttagtcattaaaaacaaccttctttgtatataaacaagctcttgatgtttcaaaagaatgtatagtatttaaagctatatgtatttccattacccatatggatgagtatacatttatttaacctatttgagatgatccaattgaacaaaaacatttcctatcatttaagattttcttcaaaaatgcatctattaaacacattttcttgttgtaacatttgtcttctattgcctgacaaggtatttttactataaatccatgcattgatagctataaaaataggaaaaacattgaataagtctttggagcaaatgaaactgttgaccctttgatagttctgaagagcaaatgaatcctagtacattgaagagtaccgtactctatctggcacttaattgcctttcttgacttgcaaaaggaattccattaacttgccttatagatactgatgactaacaccaatagaggtgttagaaaaaagggtgataggcaattgaagggtttattttgttttactaacgtacccaaataatgttgattattaacttgattacagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaa

SEQ ID NO: 2400 - DNA, 40762 bp, Homo sapiens
  source 1..40762: mol_type = genomic DNA
ctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaaggtaagttgtatgatttttctttaaataaaaaagattaagggatttttcccatcacccagatgacgggaggtgacactactgtataaatactcctaagaagttatataggaggacaggaaaaaaggtagtaactgttttcttagtcactaggctttatctaaaaatcaggtttgcattattttcaagttatcaaccttcctatattttatgcttaaaccatacccaatggcatttcatgtcgtatgtataagttaatatttaaagtgatttataatccaatttggattattataaaactttcattttatacttaggctatttatacatgatgtttaaatgatgaagatcattatactgcagaccaatataatgaggttagatgttataaatgacttacagctcttatgtcaacatgttgtctaatatgcaattattaactattactttacagagtcattagcttgtttaattttcaatctgaattgcacaacttttggtatacctgacttgctctacatgatcaaatgcaatgtgtattttggatatgtgctttttaagttcttttctgtaatgaacaaagatattgtcattgttactgggaatagcaaagtatattacttttaaataatctgaaatttaattagtgtaaattagtagaataaaaataaagttaattttttttcgattcaggaagcttattacaaatagtactgaattattagatgatgatgccaagttgaagtaaaggagaaatcaatttggaggaattaagtaaaagcctcaaattaattatacattaactaaaattataaataactgtaaatggcataaattctctagagtacatcccagtttctgaaatcatcaagtagcatattgaaacctgttttgtaaagatttgcatgtactttttagtctttttctgtgtggtttgaagtcagtaatgtgtgttgaagctaaaaaatattgctttaaatattggttcacaaggaagccaaaatgaaatatttaaaaatgtttgttatatagaaagtccagtggtcctttggaatttacaagaaaataagaactaaagtagaaatcatttaatttcccagactcattagtgaaccagaacaataaaccaaacagagaaccatcagataatgggttagcctgggaagaatattaattacaactggaggtacttgcacagagtgtactgaatttggaatttaccttggaagttatagttgccaccctatttttttaaggaatttttttaaccttgtttactttaacacatttgaaccctgcatgtgtgtgtatttcctgtgtgtttcctgaaaaggaaagtttaagataattctgtaactatcagatacttaattctgtaagtatccttgcatctaatcagaagatgtttttgttcactggcccaagatgtgtctgaaacttgcaagtagcattgttctaaactagtagctgtctttccatttgcatattttaattccatacatatatgatcacatttcattataatctaactattttgcaaatactcatttctacttttgtaaaatatacacatttattagatttttaaaacacttggccaatatgaaataacactttactgttatggtttgaaatgatacttcatagtaatatttcaaaataacaataacattttctacaatataaatatatattattttacttcatttaatacttgcaaccttatttgatgtaagtaaactcattttagagaaaactgtatcacagacaaacttcaatactaacacccagaactgaatctacatttcttggcttcaaggtccagcatttttggcattacaaactttatagtgtctgtttatagtagaatttggggtgtggaaaaaagacattagcattcttgtctaaggttcaaaaattaagaatgggtctagataatactctttaagtcagtatgaacttaagggaataatttcaaacctacagtaatccctggttcataagtctttaaaagacgggacttgtttctagaaggatcccaagtataatatataaagtccaatgtatttattgcattagtttttaaagactaccatcaaaacaagttacaaattgcaatatttgagaagtatgtaattattttatattacagatgtctatcaagttttttcctattttacatttttaccatcatatattctgataggatagaaatggacatgagataatttcagtaagataagattctggagatctcatagtccagttatttgaaaattacttgtggagcccatgggttctttggagatgactcagagcccaagtgaagcgtgactgggaaagggaagaggcacagtttctgctcctttcttttaccaaataactcttctttgaactatcttttatattggtattgtgcataaaatttaccttgaaaggagaattctatctctaaacatgattttataaagaatgacctaatgaccttatgttgatgaaacataatcatagttaaatgattgttttacacccatttctactaccttgaatttgaatctacatttttactcatgtatagggaactgtgtctttataaacatacatagttatgataatgtgaaaaaagtaattttaaaaactaacttctatactcatgcaaaccgttgaatgaattcccccaagtcctccaaaaactagattttatggacagatgctgtattttttaggtaaggaaaactctctgtatcaagagaatggaaaacaagagtgtggtctggttttctatcctaagaaaaagtgggaggaaggcttatagatagaaaaaaaagaaattttagcaatctactgatcagtaagaaaatgtcatttaggtctggcaagtgtctatggtacaagtaccctggaaatctaaaacttttcaaatttcatagtttacatcccagcagatgttacttcagggccatgccttttctgggtggagtttccaagggaacacagctttataaacacaagggattaattatagatgctctggggacttgctctaatgttctaaactgtttactgaagaggcttcttatatctcagtctaatgcaggctttgcaaaaagcttagtctctgtttctactgggttcccaatatagtgggagggtattttgcttaaaagttcattacagaaacactgttgacctgataaccaaaaaaaaaaaaaagttatatttttcctccctctttcaaagatgacccaacggaatagggtccactcatgaattctacaaaaggaataggatttataatctataaactggacagaaggcaactgagctgcctatagaatcaagaaaggcatgtaattagttgcctattaaaacacgtcttcttattttccctttcttctttatacaagtctcaattagttttctgtatcttggctttctaaatttaagtattttaagcaggaagtaaattattaccgatacagtatcaatatcttgtctgtttcttataaaggacaagtaacaattagtaaagaataaaatttaatctacaattagcaaatgaaattaattacctattttcatatataaggagttgtgttattaagaaaactgagtaagcataacccaaatttttttatgctttagacagctaaatttggtggaatggtggagacaaactacattctttctctgaagataaatataggtggaaaagctgtgtgactacatgtgctatttaacatgaacttttctcttttgtatttggtgcacgtcttacgtagtatgggtggttctcctttgcctcaggtgaataaaactaattataattttgtcatatgcagcttaaggatagagtatgattataataacaatacttcattactcatggtgtcaaggcaccgagtgataataaatgaacccaactagtgtcacgtattttgcctattcttaggaaaaaggtagaaacttaaagtaataagaggcaatcaatcagttgaaaatttgaacaaatagacaagttcagtttgtctagctcttttttcaaaatatcagcacatggattgaagttttgttagattaatacttgtaattttgcttgtatatcatcctgaccaatgttagattgagaactgtctaaccatagaattcaacagaataaattacttgatacttctgttttctaatgtatgtgactctacagcagtgggatgtgtacactatctcacttcagttttaagttcaaagcagacagagctaggcagtacccaggcctgtccattgctcaacatatctaggctcagagtccatagaagttatactaatcagttttcaggtctagagagggagccattggagcgcatgcactactccctggtttcttcagtggttactgttggaactctttaccccttgcagaaactcttctctgtagtgcatggagctacttgattgaataaagaagaatgatttgggaaaaggccagatagattcacaactaggttgtggcatagaatctggagaagggctaatatatgcacatatacctattctaacagcaatagagttataattttaaatcattttgtatcacatttgtcagagttgcaaatgacattaatattgaatgagtaatttttagtgaagtttatgtggaacataaaataacttttccagagagataacttaatccttgagttatacatgttttaaatagattttcatactatattaacaaaactggaatgtgacactgggggtttcctgctgcattttttatgtgggctcataaagctgtgggtttctacagaggttctcctagagcttcctaacagtgaggataaagagtgtcaggcaggaacaggaagacaaagttaagaaacagagtctctgggtttcttaactgctgtggaatcagtcattttacctaatgcacttccacgtaagaattgaaaaaccagttcagccgcttaaattaaaaaatgctgatctcattttatcatctcattttacgcatgaggaaattgaggtgtagagagattatgtggcttgtctgctttcatttagcaagacagtgacaaatcagtctttggtttaatcttgtcccttcatctcaattgaaccagctgggatcgctatattttaattgcttcgttaagtataacttgcagaaaatatttggggatggtctatgaaatgggcattcaataaaatattatgtacctaataaactaccctaaatctcattatcagttcacaacatacagaacaccagcatgacattctctagttggcgattactgtggttgcttaaaagatggtttcaagaaaagtttcaagtgctttacaattatgcattgcaaaggaaattctatttgacaatatccagtcctgattaccagcattaaattactcattccattgcattaggacagccatggacaaagccatatgaggtagcatggtatacgatttccaagggcagggaaagctattgttaccactccaccctgaacaattaataaaaagccagccctacttgctcagtgagacagaaaattccacaggaaaaacaaatcacttgtttagacttatgtgcattccctttacattggagaaaaatgacactaaagaactagtcagtcttcttaatcaccaagaccttgatgtaaatgaagtttattgcatcctatggtttatactggaaagtatcctatgtataagggaataggcaaaggggaatcccaaaggttaagggaacatatgtaaataataaaattgccaagaaaaatatttgtaacatttattcctacattttgggggaaaatatcattttcttattcttttcttagctctacaggtaatatttttgaaaaactatatgattactaaagtggaagtaaatactaataaaatcataagagtggtacctctgttgcaagacagctgtggagggaaaacctgaaattataacaaaccacaattattaatacacttacaacattaacaacaatattctatgtgcccttttttgactgtagccttcattccgttggcacatatgttttctttggccatgagcatttcaaagtagagaataattgtttataaactataaagcgcattctgactataaatgacacgccaaccccattattgacaaaatgtcattgcaacaacaaagaagttcaaataaatgtgttttcaaatactagttagaattaactctgattattacagtaggatccactcatttcacaaactgtattctttcttccaatctttttttttttttttgagatggagtttcactcttgttgcccaggctggagtgcaatggcatgatctcggctcaccgcaacctccgcctcctgggttcaagcgattctcctgcctcagcctccggagtagctgggattacaagcatgtgccaccaagcccggctaactttgtatgtttagtagagatggggtttctctgtgttggtcgggctggtctcaaactcccaacctcaggtgatccacccgcctcagccttccaaagtgctaggatgacaggtgtgagccaccacgcccggctctcccaatctttatataataatcacatactatggctgggcatggtggctcacgcctgtcatcccagcactttgggaggctgaggtgggtggatcacgaggtcaggagttcgagaccagcctgaccaacatggtgaaaccccatctctactgaaaatacaaaaattaaccaggcatggtggcgtgcacctgtaatcccagctacacaggaggctgagtcaggagaattgcttgaacccaggaggcagaggttgcagtgagccgagatcgtgccactgcactccagcctgggtgacagagaaagactccgtctcaaaaaataataataatcacatactttatgaagacaccaaacattagattgacaaatatatactaacacaaactacctaattttaacagaattagcatgaatcaactgcaaatgacaaactatattgtagttgaatgtgtagggaaaaaattcttcagtaagagagcaatgccatggttgaaacaagacatcctctacattttatatttgcttcaaattctttatacctgtagtctatccaaagtcatcaataaaactgaaagtaagatactcttattttaaaaattccatgttttaaacagtttttaggacaagccattcaggcctgaactcagtattcatgaaaattagactttcttttaacagttattttaagtatggtgatattagagagtgtcccagtataaaatttctgagaatttttttctatttacccatgcttttcttattttcacagatagctttccaatgattagacgaattgattctttctgtgactcatcagttcatttcctgtaaaattcatgtcttgctgttgatttgtgaataaggtatcgtaaataaaacatctgttaccatacttgcttatcatttaatggaaaacacatcagtcaacccacattctgttcgcaggagagctccagaaggggtgtggaaggttgtgttgggtggagaaaccagatagtgaggatgcaactaagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaaggtacaagtagtccaaagaatatgccttctcattttgattgattctaacttctctttttttgctttgtatttacctgctttatatttcatggtaactgctaattttgtatctttgacataaaggtaattatgaaccactgcaactctatatgatgcgactttatgtgaaatgttataagtataatgtatatttaacatgactccattgctgtcttaaatataaataccaaattctattaaaagctgtctacaggtatgcatgttagtagaaataattgttttaagttatgtccaaagagcatgttggcatgcttttgagtaggaaataagtgagtatattttgtaaaagcacatttataaaagaagttgcactttagttaatactgagaaaagtaaaactgtgtgtgtgtgtgtgtgtgtgtgtaatgtgtttaatattgaaacataaatccttattaaattgtaggtaaacttgtttggtaatacactgtttagtaatccactatttttatatatgtgtaataatctcatctcataaatattttctatttgtgaagcttcatattggaatcttagaaaatactttcagaaatatgcagaacatgtcttagtataaaacaaattgactgtagtgtgaaaaaacagaatgattgaatagatgggctttgcacaacaacctagaattcatctcccaccctagcttattcgaattagctacacactcactcatcagaaacgttgattgatagggggaagaagagaataaagggaagcagttctgctgaagttctaaatcagggatggcaaattcaaatggctgcaggagtttggatacaggggttaaacaaaatttaaggtgccaagaacaagataaaatgaagaacaggaactgctgtgaactagactgtgtgtttactgcctgaaggcataaatgttcattttattaaacataatactggccaaataaaacgagttctgccttcaactctctacctggttaggatggcaatgacctagacaaagggttagtaagcatagtgcacgatggagaacaggaggaattgaatttttattaaatttttattgctatattgttagtatttttaatatttttgatccacagttggttgaatctgcagatgtggaacccatgaatacagagggctgactgtattgtgtttattgctaacatattgcagaacttcagcctcatgcatttaactgaaaaaacatatgtaaattagtatcccctgccttggaattcttagttttcttgatagtatttttaatacaggccaatggaaacagacaggtaatagtgaggtgtggggcttatctaatagtgggatggagtggccattgatctgacatccttcctactcataaactatgttctcacccagatcttatgcagagaaagtacaagatcagtgtctgtgttaacgtacagactacaacatcatttggaaaagttttccaaattcaaaaatcacaataatcttccaatgcacagcgatttagactacttttttttgctgacacataattattggtcaataactgagtattgatgatttaatttttttctttgtcatgcaacaaaactggtacatgtagattcttttgaatagcatgtgaggtgctagcatttattttaattctttaatatttatctttatgcttataatagttaaccatgagaaagtaagttttctgacatcaaaatgtgcttttgtataatgactaagagaataatataatctcatctattgtaagctataaccaggggaagatatattataataaaaaataccgagacctatgagactctagaattgaattggaaaagtaaatgctgtaatactttgaaagagaaatctctcagagtattcaagaaacttcaggaaaaaggtaggacttgattcagattttaaagaagtgtagaattttgaaagtctcaaataactgcagtaaccatattaaaggactgattgatagtatgaaaaaccctgtgaaaatgctaccaaatgcagtgaagatggaaggaagaaggtagagaatgtgcccataatactggattaacagcagaaaagattagaagttaacatggggttagagttaggaagcaagcttagaacatcaggcagaaaaatacttaattgatgatacaatacacaatagtcgtcggtatgtttttcagcaagtgtaagatatgataaaacctgaatttagagattagatggctaacatttaattcttactaagagtttcctatatactagttcacttaatcttcaaaaatatctgtgagaagttgctgttattttactcatcttacaggcgcaagtccttaaatcaacttgccaactcacctagccaatagggaaagaagtcattctccaaatgtaagcaatctgtaggaagagcctagatgaaaaacctggccttgtatactactctacagcagaaaggttgcaaagtgaggataccagagataggaaaacaaacaaacaaaaaactgtaggatatgaccactttcaaggagaatataagattcccttttagaaagatatttgcataatctgcacattatataacaaaaggcacactggtctggcatggttgagtatatagaaaaaaaaaactgatagataataggatgaaatggaagcttggagagacagattaaattagaggagtaaaagcatcaaactcaagatgtccagtgagttattgatagaaggtatgtatataccttacaaagtaaaacagaggttttataagtgatgttttatgaacatcagtctgtgtttcaaaggtcagagttcaaatagatttgatcattgctataaagattaaaaataaaactaaacagtagatttacttttagagagttttaatggagagaggaaaaagcagaagaattattacagaatttgtaataattcagaggcaggaagacaaaagtagaaaaggaaaagaatgatcttatatgaagaaacaaacaaagagtacaatcctagaagttaataggaggccagaactcaaggaaagaaagcataaaatgttctcaggcagatgaaaattaagaaaataatgattagaacatggtcaccaataattttgaaagtatactttgagtagggtaataaagaagggggaattaaatcaatggagtgcttttccttcttgtttttgaaataagaattatccgtgcaatcttttacaaggaaaagagaagattcagacttcctagtgtagattcaaactcaaggaggtggtacaacagagactcataaaaactgtcaaatgacagtgcacattgtaagccccctacatgtccatagactaagactcatcatcagaatccttatattggtcaagatgtatggtacatttaaggctaagcttctttttgctctcagattcctacacaaccatgttgaccttgttaatttagtcatatgaagtaggtggaatattgtttgaatagactgtttcttttttcttcagtttacagactattttttaaatgatattggcgtatgtatatctttggcatagagtaggagtcaaatatttgaattttgtgtaaacctagagagccaagtgtcttactgctgcctcagaaatacttagagtaatgctatttcacaaacatatgggttttggtactgttgacttcttatttgtgtaccattaaaactcatttaatattactttgtttagctgactaatagcaaattaagaaagctattgtatacaagtgatatttggaaaaaaataattaaacttcttaattgagaatgatgagaaaatcatttcatatttagtgtagagttgcagtgctgtgataccttccaattctgaaagatgtcattaccatttgaagtagtctaaaacagtttagcaagcttatttgtactttatttttgctctttattttcaagggatgtctctggtatcctcatgctttttatggattatagctgcaatctttcttaccagtatttttgaccgtgattcttaatagagttgtgtgcagccagcaagtttatgcagtctttcaaaaaaaaaaaaaaaactaaaaatcaatagcaagagctgccatgaaagtagaaactaccaaagcactgtggaaaagggtcaaaattctaccaccatttacaaaagataatttatcacttgacattattaatgtcagttgataaaaagtttagtgaatattgtataacataacataggtagttgtatgctaagcagattaatgcaggaacagaaaaccagataccacatgttctcacttgtaagtaggagctaaatattgaatacacgtggatataaagaagggaacaatagacacctggggctaatcgagggtgggaagggggaggagagcggaggatcaaaaaactacctatcaggtactatgcttattacctgcgtgaagaaataatccgtacaccaaacctccatgacacacaatttacctatataacaaacttgcacatgtacctctgaccctaaaataaaagttggaagaaaaaaataaaatttaaataagttctatagttctaactatagaacaccaaaaaaggaattataggtttctttgttcctgttagagaactaatattaaatatcatcattcaattataccatttttccttctcccattcttgaaaacaatgatccttctgtagcttgtaagaaatgccttcagacaaaataaattgaaatcatgattcattaaaatggttatacatggctgggcatggtggctcatgcctataatcctagtacttcgggaggctgagacgggtggatcacttgagctcaggagtttgagaccagcctgggcaacatggcaaaaccccatctctacgaataatacaaaaaaattagctggatatggttacacatgcctgtagtcctagcttttgtggggctgaagtgggaggatcccttgagcccaggaggttgaggctgcagtgagctaaggtcgcgcctctgtacttcagcctgggtgacaaagtgagaccctgtctccccccgcaaaaaattatgtttgaattaatagtccatattttaaacatataatttgtttatattacctttataatgtatgcttctagtatttccagatataataaaataatttgtactttttcatagtatctaaaagctcaaaaataaatgactaaaaatattaaagatggtaaagtttgttttatatttaataacgtaagaacaacccaaaatatttaaattaaaatagcagtataaaaacgaattaaacactatgtatatgtgcatatagctgtaataacaaatgtcacttaaagacaatgtttcaagaaatagacaagcatatatgtttcttctactagtccaatttaatatcaacatagtttacttttcatgccaaacacaacatagtttacttttcataccattttaggtacttacataaattcttggaggctaatttctaggtttcagaaacatattaaagcttactactccaatacatttcacctaattttattctgggttttagttgatgatgatgttctgaaactaaagccattttcagattctctgcataactgtcactacaattctaattcattctcaacttacacacacttgcataatgcaaaaacattagaatttcttttaacatggggaaatgattcgttttaggcccaattacaagcaaatggtagcagctagtgggaaggatggaagtatgcttctggtttttaagaaagtttttactttactagaaagagaaatattaaaatgattaaataacagaaaaataattgtcacaggatattatataagttattggcacatgactggcttagacagtaaatgctatgaaccaagcaattaaagcagaatggagaagtaaatggtattagagttcttcctctaaaggatggatagaatttgtaaaatactaatagctgacatttattgaatgtctggtttgtactaacactgttctaagtgttcacgtttattgatccccataacaacctatgaggataaatatttaagccacatgaaaatgccaaaattcaactttttttgattttcaaaaatactaagtctatatggttcaatctaacattactgttataatttcacagataaggaaagtgaggtacaaagaaattaaataatctgctcaaacttcaatgatgatgattattattaagtgatcaaactcatagcatctaatttcattgttggccacttcagtctatgctttagggaagaagccactataccttgttagggtggggatagggtaaaaaaatctaactcgtagattaaaatctgctaaacatacttctgtctcttggtagaaatgtgtaaagtccttgaaaagtgaaacaaaatattttctacatttgtactctactccatgcgtagcaaagtatgaagggcattttaataatgaaagttgtcagttatgtagatgattattgctgttgcatgaaaacagtattcaagtgagtgcatgactacatataggatattaaggtcccaacaagcatctgttttcaaattaatgtagcagaatagaagtttcaaggtcagtgctttcaacccagctatagaacatgctatgtgagagtcaccaggttgaaatccagttgttgttggggcttggtagtctgcatgcttagagtcagggacaaatacacacatacacattagccaagtgagaaaatcttatatcactttttctgtgtacatacttaccagctttgtacttcaaatttagtaaaatatttgcaaaatagtctagacagtccaaattcaatttaaaatcaagttcttttaaattcacaaaggacataacatcttttgtttcttgtgacatatttagtcttggtattcaaggagtgactacaatttaatacatatagtagtggtagcgtcagaagcatattattactacttcgactacttcaatatttttctctatgtctctaaacaaatcatgatgctatggaaactatataaaattgaagtgaaaggacctgatttttctattatctgctagtaaatttgtcacataacattgagtcagacatctcttttctctagaacccattttccacctctaaaaaaatggacggggttagatagtcctgattctaacagttgataattcaacacattcatttcaaccctgtgtttcacgtttgccttatttgtcgctagagatattttttaagggaaaagtgatttgtggcctttagaaaaaaaggtctcatacacgtacaatgtcttttggtgtttagatggacactcattgtagagttaggaaggcattcaatcctgtcaagcacattctgtcacagactctcttcaattctataagagtttgttgagtttctttcattaagagatattaggtcggtacaaaagtaattgtgatttttgtcattaaaatcgcaaaaaccgtaattacttgtgtacaaacctaatatgtaccttgagaggcacttgatgaataacaggtattgtttttgagcattaagattctaatagtgtgaggagaataatgtttgtgtttgtgtgttctcccttgttaagtctcttgaaatggagaaatcaaccgttttcagcttctatttagctttgagcttcaacatcctcaccaaacatatttacatttagaagaatatccataatgctttaagcaattttgtcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgaaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcaggttaagttggagctctttaacctgggcattcttcccaatacttcattagaaataccgcctgcttcaaaatcacctttgtttgcactatctactacagcgtaatagacttctggctcagagagtgaaagctgtggaagaaaactagaagaatatttatgttaactcccttattttacagctaatgaagttgaccctagggaggtttgatgactctccacccagtcccaaagctcctaaagcaaggaatcgagttcctaatgtaggatttttaattctcttattggtgtattttccacttgtctatctttaccaaaggagcatcagtgatttttagtggatttcacaaaggagtaataggacagcttccttgtcctgtttttttctttaaaaactacaacccaataatgatgagtgaggctgttgtaatttttggaaacatgataatgggttgttgcaaatatattgaaagttaggggctgtgtgcagtggctcacacctgtaattccagccttttgggagtccaggtcaggtggattgcttcagctcaggagttcaaggtcagcctgaccaatatggtgaaatcctgtttctactaaaactacaaaaactaggtgggcatggtggcacaggtgagaggatcacttgagcctgggaggtcaaggctgcaaggagccaagattgtaccactgtactccagcctgggtgacagagcaatatcttgtctcaaaaaaaaaaaaaagaaaagaaaaagaaaaaggttagggaagccagattgagcaggattttgaagacacggtgtcaaatttgtgttcttcatgtagatatttttattttcttaatgtagtgagtgttaagtaccatcctctgaagtgtccaactcttgaaggaaaagaaaaagcttccaataccattagatttttcactcagtttttgtgttttgtttcatcagtccaacttaggggcagagaagaagttcaactcagtaagaacttttttgaacttcggtaaaatttgcttaataaattatgttgactgttgcaatattttcaaagcgtcactctaaagcttgccgaagggtcactttaaagtttgccttaaaatcaacagtcgtgtcttcagtattacacactgattctctttgtaaaaggctaaaaagactgctgtaataataatttgttgaaaacatttctgctgcaagtgtatggtaaggttgcaaaggttctcatgaatgaggtacttgggcttggtccttttattctggctgactcaaggctgcaaacaatcttccagaagtgcctgtacttactacaaagacataacccaaacttattttctttttcatagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacaggtgagtgagtccccacaaatatgagacactcttaccttgaccatgtatttctgagaagtcttctacttggcaaatgtcattgtattgaaatgtacttattattttcttgccaaaaatatactttaaaatatttttcctgtctgtatagaatcctaatctaagaatttaatgattataaggtatttattttgaaaaaagtggaagatatatacattatccaaatatttattagacaatatatagaaaagataaacagattttattataaacttaccagtatcaaataacttccctatgtttatgaagttagtgttttgttattgtggcatatattctcaacaactctgaaatattcctgctgaggaaaaaaaaatcagttttcacatcttaaaatttaaagcatattttaacagtggttctcaaagtgtagctgggccacagcaaagtgctgggccagctgcatcagcattaacagggaattgggaaacatgcaaatccctccaccccatcccagaccaaatgaatgaaagagttgaggcccactaaagagttttacaaatcctgggtgatttgaatacacaattttgagaaccaccgtgctaaattcatttttcctaactgcggtacctactcaagatttatattcaaattaacttctgggtcatatagatgtttacattgatctattttagtttcactcttatatttcctctagtgttgagacaatattttatatctttcctctgccttccctgatagtttaacacacttttgaacagaatcttagagtattagaactagaggaaatgatcagccagaatctgtcattttgtgagttaaaaatgcctgatccagtggatgtgaggtcacttgtccatgttcacacagatgtaggtactggtagctcctagatttttgtataccttttcttccatttcaattatagacactctgtctttttcactaaaaagggaaaaaagggggagattgaggtgccaaaaacactaccttaaccaaggattaggaatatatttatggtatccatatggaaacatagttatgttctgctatagaatttgttacctaaatgtgtattttccctcatggataatcacaactagttatacaccatgattagttctcatcacaaagttttgtatttctaatgattttttataatttgtagttttagcatcttatctgttttggttatcggatgattgtataattttccttcttccccaaagcattactatgcttccagattgaaaattcacacccaaaataaaatgaaataacaggcatggtgagggtggtgcctactaccatagcacatgacatataagccccagagggccttggtgcatgtcctgtcttagcagttttacccgaatcgggtgtctctgtgcgcatctgtgacaattcataattttgtcaatgaagacttagtttttatgggtacaaaaacatcttaccttagaattttcttcatggtcttaaagtttttatattattagcaagagtctatacaagtatcttgttgcaaagaatgttgttaggtgtaccatatatatatacacacatatatatatatgtattcataggtgtatatatacttatgaaaatctagaattcacatatgacctaaggagagtatcagcataattgtttaagaaatagaacctaagtgaactgagtaagtgtgaggaaagaaaatagttgttagaatttgagaactcatcatgattttttttgtttgtttgggggaagttatatttttcacttctgtttttaattttgtttattttttgaggcaaggtcttgttctgtcacccactctagagtgcagtggcacgatcacagttcactgcatcctcaacctcctaggctcaagtgatcctcccacctcagcctcctgagtagctgggaccacaggcgcatgccactatacccagctaatttttatgggttttgttttgtagacaaggtttcgccatgttgctcatgctggcctcaaactcctgggctcaagcaatctatgtgccttggcctcgcaaagtgttgggattacaggtgtgacccaccatgcccgaccatatttttcacttttaaatatattatttgggatatgagaaaacatattattgaaatagttctcctctggtagttgacagctgatctatattttattcttaaagcctttaacctatctctctaagggacaaaaaggggatgtgttagatatatttggtttgcttagagaggcaatggagcaaagactggagaagaacagttgcatttacagctaaattttagaatccataaatagctctttctgtaacaattttaaagggattcctgattatctgtaggtcatcttgtctcagcatgtcaccaaaatagtcttttattgtttgcctgagtgccttaaataatggaaaaacaaccagtaccttttagaaaaaaaattaacactttgatagtgcatgtgttgagctaaacatgctttttcataactaattataccctaaatccatctgacattggaagtatgtgagaatgtccctcctcaaacagaaccacaggctgtatttggccattgtctgctaaagtaagcttgattacactttgacaagatatgacctgaatcaaagcacgaaattgcttgggttgagatcttatgtgtgtttctacctacaccatctctatgaagatgctgtaattccttcagaatattcttagatctgtaattcattttttgagttactttgctttggaaagaatataaaaagtaatcttgagaaaagcataaattccttcccttgaccttataaacaaacacgttccaaaacttccatacagtctaacttttaaacaaaaaattcagtaattatgttccctttttaaaacaacattctaaaggcagggctgttttaaggatttttcttctagtgactgccatctactggtataatgttgtcagtacactttaggtaacgtgacaattatgttgctattgttttaatatatgggcatatttctgaaaattgaagtactttgatttgaaatattagtaatatgcacactaatttaaaatacaattgtcctgagtgctgtttcagatttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtaggaatttacatttttattataatggaataaaatgggtttttaaaaaattcagtccaattgcttaagtctttaccttggctatctactcacttcacaggcattcaaatatgacagtgcaattatgatatatatcttatttcttctcagtgaatatcttccacttgtgaaatgtatttttcctgtaataatcacccttcaccgcgttcctaaaatgtagttggtactttgcagcctagatatgttagagtcaggagattagaactagcaaaagtattcaatatacttgaggggctggggaagttagtctataacccttaaaaatggaaattatattcttatctctaattctcattaaagaagtcctgaaaaagggaaaaagcagtgctggataggccttgtattttgatcattctttctaatataagaaaatgtgctctaaatattcccctgctgaagcccctgtactttttcctccttatcctcaggataaagtctcgtttgagtattagatgcaactcttttatgtttgagatcttacttgtttcaataactttatttccactactctcctcacctcttactctgtaatccaaccacactcaaatatctgcatttcccaaaacatattatgttcgttcttatgcatgctaccatctgccgtactttacctaactaaacttgtatttgttacatagaccatttatgtagacttgtactaaaaagtgttttaaccctcacccctaccctgaccattctaaatctggatctggatctgttttgtgttttcccatggagtctccattataacaatattccttctctctcactattttaatttccagtttgccagtttaagaccccttctcgttagtttgctagagaccctggctgatttctcattttaacaccattgcttacatactatctatctggcatattctgtgtgttcaaaaatcatttgttgaatgaatgacatttgagatctaatgttcacatatgacaaatgttttgaattttgtttactgctatttctttagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagtgagtagacaaacaacaaagttatctattttaaaatactctagaactcatgtaattaatcctatcattagaattattaggttttacttgtttttccatttttatcaaaacgtattcctatatcattattttgaatggaggcatggtcatttggaaagtgacaaaatcataagaatcgactgcattagaagaccactttatttttttcattattttttgtcgaaacattctctatatttaatttcaattttataacagattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatcctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggctttttttttttttaagttctgggatacatgtgctgaatgtgcaggattgttacataggtatacatgtgccatggtgctttgctgcacctatcaaaccatcatctaggttttaagccccgtatgccttaatgcattagatatttgagaagaccactttaagtgtatcgttaaataaatagagcttaacttggaatgtcgtcttcttgtggctggcactgaggcaaagaaatgtaatcatctaggaattagacgaattgcattttgagttttggcaggatctggcagtaattttaaagataagctttaaaaagttttgtattaagctcaatattagcatttaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagtcttattgctgatctggagacatatatcctaactttttaaaaagtccacttctcattatagcttcagctttcctagttgggaaattcatctgaatttaacaattaaatttaaacctgaagaatagatttaataaggtttctactcatttataaatacacaattttttttaaattagccggtaagctagtctgtaaatctttgagcactgtttttggcttttatttccctattcacataatcaagtttaataccatatttttatttgttttaaatatactcctcattcctccttttctagacctcttacaattttaatttatatttaaaagttagcctaatgttcacatctcaatactgataaggtaatagacttcattttaatgggatttgtaaataagaatttttagtagtccataatgtcatgaaatggcagcttgaagattaaggaaaatgtgaacttgatggtgtacttgattaccgcttaatgttttgaattacaaataggataagctaactactgaattggaagttggactatgacttcatttggcactatatgtgaatattatgttctctagttcattgttttacttttagatactgttaggattacaaggttatatatcaattataaatgaatgtagaaagccataatgaatcaaattcattctgattttaactcaatactcatagctctttctttggctaatgctttaacttttggatgtctaatttttatcattttagtaaccacttattatcattttagtaaccacttattaatgactgtaacatttagaatacccctagaaatcattgttcttataggtttgttcaatgtccctcacctcaacatagtaagaatagtgatcaaaatgccctcattggcttaattatgacagagtgctagagttcacatcatgtcagcttctgatatgtatcttctttgtcacagcatctagcacttatttctaggcacctttcacaatttttaaggccaataatttaaaaaaatgtattgcagatgtatttcaagtcatttgagtaaccagtgattgagaaatgtgaaagtgagttatgtattgtacaactttgaaaaaatgacttgtagaagtaacattttcccatacatatatttcagtacaacaatactgcagatggagtttataaagttttcaatggaaaagataacataagtaaagttgccataatcgacacatataaaggtaaaaggtaagtattctggtaaaatgtgcatgtatgttactagggtactcttaagcaggaatagtattcatttaacatctcataagacataggcatcaacctatagaacagacctggttataattcagctctggaaactcctgttctgctaggtattaactctttagttgtggtaactggtgagttcacaccagtgcatagctgctgactatcagctccactttaaggtttggttcacctttctgcacaggttatggttgtgttacataaatccccaaagggactattttttcatctctgctacttatccagcattacagtataattattcttacaattagataaccataaatgaaaaggtaaaaaaaaaaaaaacaacacatcaactgattgtgtagtagatggaaactttttttttactttttaaatcgagcatatcgaattccatattccagtggcatgacctaaatgtgtctataaagatggaagcttaatgaatccaggcaactgctttcatgaccttccccctgcaaatagtctttaataattttccatattgataactcagcttttttaactttatcaatgcaaaaatagaatgaatatttcaagtgcagttctacaatgtaaatacaaaatgtgaaaatgaagactttgccaactttaaagtggtaaaataacaaatcagcttcctaagccattatttcctttttttttttctagctccagcctattcacctaaagaatttataatttatcatatatgtaaactaggaagaaccctaataaatatcagaggaacaagctttcttctccataaaattaacaattgtgtgtttgactagtttttttctgaaaaagaataaagtgatcaaaaccaaaagagatgaaatgtttttattaatataaagtaacccctacctcaaactgagtctatctaatgattgcttttaacagctaaatattactagtggagtactttttcttctaaagagtccacagttacatatttttatagaaaaagtcagtagagggaaaaaaacacttctaagtattcacttaaaaggaaatcacagcaattttttatattgagaaataacgagcatttcactctaatattacagagagatgtggaggggagttgcaaagcactcctagttagagtaagaatttcacatcattttaagattgtaaggttgatttaactcatggcaagactgaacatgattaaccacttattttgtttaagcaatggcttgtcttgacatgtcactgtcaggagtggaaaaaaagtttttccatcaccaaaaagtgaggatgcagggaaactattactattgtttttatcacttccagatatatatagcttatttagacagcaaagtataagttagtaaactctttcctactttaacgccagtccatgggagaattaaagggaggaaggggcaagaatataaattaatcatctacatgttttgaatgtttgctgatccaaacatctgcttctttcctcttccctgcttctctcttctgcctgccttgtacttagcttatatcagttacccacttaacactttccttctattcattctgaacacttatactactgagtaattcatgtatcccattggaaaaaaaaaaatttcccctaagtagagatctaagtttctgataaatgtttttaatttttttcttattccaagatgtttctaattaacacctggcagtttttattttatgatctggctacctaatggcatcaggtacattgcaataagataaaaggttcaaacaaaacataaacagaattgaacatttcttaaacttagtacttgtcacatttaaatgcatcatattaacagaagtattgaattataatagaaaaagtaatgtaagaaaggtattctttaaataagaatgtttattcattgtctttttctattcctaggaatctgtcctattgggaaagtcactgcgacatgattaatggtacaggtaagaatatttgttttgtggtcatcacagttaatccacctccctttcccacaaatccaccgttgtactgacagtgttctgaaagttgagggtgtgtgtttacttgcctttatatccccacaacaaaattcagagtcactatttgtatataggctaaaggtctgttcaatgtgatgggatttgtaaagattaatcataaaaaattagcccttactgcatgattcagagaaatgtttgctttgtaaaaactttactgccatcctggcaacagaagtaaatggtaaaaaacaaacaacaacacaaaacactttagttacatttcaaatattttataaatagtatacagataagttagaattgaaagaattaaaaaaagctaattacaaaatagaaaacatatctaagcaaggcttatagctgagatagaataaagttgcaagacagaaccatccatttttggataaggtggtcagaatgagagagaaaacaataacaaagtcagatgtcttcttaactgtgaaaaatatatgtaaaaaatgagcattcataaacttagatttaaggtatggttagatcaggcttattctccttcaggaaaagcaaagtacagatatgcctattagtttaagaattaagatttttaaaaagcaatgggaggctggtcacagtggctcatgtctataatcccagcactttgggagaccaaggcaggtagactacttgtgccccggaggttgagaccagcctgggcaacatagcaaaatcccatctctacaaaaaaaatacaaatattagctgggtgtgctggcacacgcttttagttccggctacttgggaggctgaggcaggaggatcacttgattccaggaggtggaggctgcagtgagctataattgtgcctctgcactctagcctgggcaatagtgtgagaccctgtctcaaaaaaaaaaaaaaaaaaaaaagtggtgggaatcgaataccatgaagtaattaatatccagaggcaagctttcaactactaggaaacaaaagcatgaagtttagaaaattagggaatatcccataggaaaatgatataacaaagataaagacacttaagtaaaaatgaagtacagagaatgtttactttgccaaaggtatgattattgacttcgtatgcgtacttgattctatcattgccttgtaggaaatgataaacaaaaaaagcaaacaaaaaaaacagcaaaaacactgttggatttgcaggggttttcttttgtttttttttttttttttttttgagacatagtctggctctgttgccaggctggagtgcagtggtgcgatctcggctcactgcaacctctgcctcctggggttcaagtgattctcctacctcaatctcatgagtagttgggactacaggcatgtgccaccacacccagctaatttttgtatttttagtagagacggtttcaccatgttggccaggatggtcttgatctcttgaccttgtgatccgcccccctcggcctcccaaagtgctgggattacaggcttgagccaccacacctggccaaggctttgcagggttttgagccataggagtgggcaaataagctattttctaagtaaagcatttctggaaataaattttcaagtcctcaatactaccaatgctagtagttgtataagcggaatacttagtccttagatgcagagataaatatactgtgttaatcctagtaaaggattctttaaggagaaaaatctttaaaaagaagattcattgacaataatagaaatgcatgagcatcaggcatgatgttaaaaatatctatggggaaaatagggctgatacaaactaggaaaagagggaatttggacagagcaggggatgatccctgtgagagagattcttgcttatggcactagcgaaaagaaagtaataaaacagtaaggttctaatgtgttttcatcgtaatttagaagtgcatcctctttaccttcttcagtaagtttgaaaagacttaaaatgaaagtattggtatacatttagaatgtttcttttgggaggacagaaaaaaagctctgcaaatatcaactatgttgcagtcattgtccatggtagttgctgggtataattaggacataatcttcaatgatattttagataatgatcttaaaagcttttcaatgcatttttctttaattattaaggaaatggaaaagcagttgttgtcaatgtccatatgggggcttatattttacttgtcacaagagtgtaaactaatgaaaacaaggtcacaaggttgacacacttgccagagaaagaacctacaatgcataatcaaagatgagacttaccatttaaaactcattcaatgacggctcgtattagtgatattcatgtgagaagtacatggaggagttaactatttcttcatatatccaatgtttgccatggatcatagctgtagcaaaaagtaaattcaataaatgacttttttatacactttcaaagcatttgaagttctgtttagtgagagaactttagtaaatatttttagaagtagtaatcagccattaggacaaatgagaaaaaaaatcactacaaataaatgtggacatggcaggagatccaaatgaacttcactggaagaaaagtgccactctactggtggggtagggcatttcaaaaaacaaacacaatgttagccttaacatttcatgtttaagtttcttttattttgtaccattaaatatgtatagtatgtagatttgttgttgacaatagcagccgccagccatatgtaactgttaaggactcaaaatctggctagtatgatttgaaatgtgctgtaaatataaaatgcacagtagattttgagactttaagaatttaaaatattttataatggttacatgttaaaatattttggatattaataagttaaatatagttttgttttgtttgagacaaagttttccacttgtcgcccaggctggagtgcaatggcatgatcttggctcactgcagtatccgcctcctgggtgcaagcaattatcctgcctcaggatagctgggattacgagcgcctatctcaggatagctgaggcaggcctatcctgcctcaggatagctgcctcccaagtagctgggattacaagcgcctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccggttatttctttttaccttttaaaaatgtggctgctagataaattacttaggcagtttgcattacatttctatggactacactggaggagagatttctaggtttttttctagaacacacattacatctaatcatttgccactcgatttttaaacagatgcagcctcatttccaccttttgttgagaaaagccaggtattgcagttcttttcttctgatatttgcaggtaagacagatactgaagtataagtatgtctgagtcagaccccaggtgacaaaatgcagaccaagaaacttaaacacagcataggaaattcatcatgtttattaactaactctttgcaaaatgttcttctgcatcttccaatttttaatagtacaaattttttttttttttgccatttctatctaagcaagaaccattttgccttttaaaaactaaactagtagtctattaacgatcaagtccagaagggcgtgcccaatctttctaaagacatacagagaagatgatgcaaatgtaacagaactgtgttaatgtgctctgctcagatttgtggggcccagtagataacacacaagcactggagcctttaccactacccttgagcccaagctctgtccctaaagactgtatgcttgtgggtaggcatttaacatctctgaatttttttcttatctgtacaatttaagacagcagtatttcttcatatacgtgtatctggggataagaaaaatatgtgtattgaaccctatgatagacacttggtaaacgatggaaatgtaccaggtatatatccagcatgtatatgcatacactccagtgagtggtctttctttccaggattaattaagccgtgaaagaaactatttcatttaaactgatcacaaataaagtatttgaaggaagtcctataaatatttactctattggataaattgcctgtgagaagtaacttgagtataaataaacatggtacttcacaaacaagaatagttcatgcttggctattgagttttagtatgtgttaaaatttcccaatcactttttttctaagaatgaaacaagaatttaaaagagtatatgatgtttctaagttaaaacaagaataagaaaaaatgaatctccagaatgtaagttcaggttcctggaatgcagctcttttttctctgtatttaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaaggtgagtaaataacctcagtagcacagtccataccataatttgtgatattctttaagatgagaactttaccataatcctttagcaaccaaaatttaaaatatatcataatttgtgatattctttaaaatgagaactttaccataatcctttagcaaccaaaatttaaaattaaagtaagaaagtaattagggcagaagaaagaatggtggcagaaaattttagtgctgattttgtattttgggaagatcccacttgtgtttcagtattacaaaatttagttaaaaccacaccagtatttccttgtggctgcttttagatttagggtgaaatgaaaataattccgagaacacattaaacatcctgttattcatctgtcctaacttttttcactagaaaatggtacaggtaaatgtattttcagtatgtatctaaagctagagttaaacataaaatttggagactagcttatcctgtacatatttatcatactaacgtgggtgtggaagaagaaagaaaaaactagtgttaaataaattcttagtccatagacatattactgcctgaaagctttacatattgaaaattaatactgaaggagtttatagtagaaatcaactgacataattcttccccacccatgttaaaaaccatgtattttttaatgcaagaagctttagttttgtggaaatattttttgagttatatgtgaaatgaaggaagttattaattccaattgactcttaaaacttgtcttcagggagacctgtgtacatttcacttcctcattttctgtatgcaagtcctgatgtttcagaacctattgatggattaaacccaaatgaagaagaacataggacatacttggatattgaacctgtaagaaaacaccttattgatctgatttggttgatatttttaaaaatacaattgaaataaaaataatcttgtcgatgattatttattcaataaataatcatatttattgaatcacattcttgaaagttactgaaacttaggtcgatttcttcctatggtttatgaagtgattctaattggcttaaaataattttatataaatatttatgtttagatgaggagttattgtatattatgcaaaagtcaaagagtatatgtgagtttgactatacttattgtcaaaatctataaaattgttgtagcgcaacagttttaatcatctttatttttgtattttccttttcaaaaagtaaatgaaattctaggattttagtagttatgttttagtttaaacaatgacacatggattctaactgaatatatatttgaccaggaattatctgagatcttatattttgttgctgatttttgattttttaaaaaccatttcaagtaactcacaaatctaactaactaaaaccttgacattcgattgggcaaataaattgtgtgtatctatatggatgcatgtgtatataactataactatatatgcagttttaaaagtttcaattagtcctgtttaaccttaagttactaccttctcttctgctgtaagaaaaataagttttgaatagtataaaataatgtttttaaaagttggtaattatttagttgttctctttttagataactggattcactttacaatttgcaaaacggctgcaggtcaacctattggtcaagccatcagaaaaaattcagtgagtctcttgaaaatggttattttgatatgatctgtagtatcgtagtatcttcttgtaagaacatgagtaaatctatgtaagtaagtggaaataacatctgatatcaacttatctttagcttaatgtcaccaatcattattaaatgcttatgactaatttcacagattttggaatggttttatggttttatttgagcatttgatagcatctcttattttgttagctgcccaaatatttctatgacaataattaatttttggaattcatatttcagttccccgagaatttattgaaaggaaaaatccacacttgtgaaaaaaaatcaatgtgattagaagacatataagagcaaaggaagtcaaaaacaactatattaaaatttaaatgagtcattacaggaacaaaatcaaattagcaacagcaactaatttatgaacatttattttaaagtttgttatatataaatattagtttatatgttcataattattttcaacgtatattacagagtattaaagaatctgaagaggaactatattgtgcctattctttggcttaatgaggtttgtatttgcagctgttagtcattaaaaacaaccttctttgtatataaacaagctcttgatgtttcaaaagaatgtatagtatttaaagctatatgtatttccattacccatatggatgagtatacatttatttaacctatttgagatgatccaattgaacaaaaacatttcctatcatttaagattttcttcaaaaatgcatctattaaacacattttcttgttgtaacatttgtcttctattgcctgacaaggtatttttactataaatccatgcattgatagctataaaaataggaaaaacattgaataagtctttggagcaaatgaaactgttgaccctttgatagttctgaagagcaaatgaatcctagtacattgaagagtaccgtactctatctggcacttaattgcctttcttgacttgcaaaaggaattccattaacttgccttatagatactgatgactaacaccaatagaggtgttagaaaaaagggtgataggcaattgaagggtttattttgttttactaacgtacccaaataatgttgattattaacttgattacagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaattgactggttcatttctcaattatatagctagttatatattatctgatacttaaaaataattgactaggaaatggtttcataagaccaggattgctgcatgtagacatgctggccgtgcattttccaaatccagaaaagtcctgaacaaaaatttgaatataatagtatcaggaaataggggaaaatagtgttcaacatagtagaaccaagtactcagagtggtgtacaagagtttaggcctctatgctttagatattagtgtccatgcactcttaaagatgaatgaatgcctgacctttcctaaaggaaaacctttttttagttatcacaggtaacattggtgttgcctgtgggggagaattttttactttctccctatttttcttcagcccacctcaaggcaatgtaaataaaagcagtatgtgtgttataataacttatttagttgtttactgtgtgccagtaccatgctaaagaaagattctttatctcacatgatccctaatacaatttcatgattttccaatagcctggattcatcagcatccattctatcttctagagatgttccatgaaatcatacattttaattgtttgtgaccaaagcataaatcagtgaaagtggaatttggggaccaataatttccttttgtgagatggagagcttgtgtttgaaaaggcaacctaatttttggttctaatcacttctaccactatttagtcaccaaaaagacaataattctgcatccaaactatttggacagaatggcttcaaaatgctagcctaaaatgttcacattataaaaagttaaatattaccttcaatacctgtcagtagcctactgacaaattatgactaaacaaaggtatttgtatgactatgtaatagatcatccgctgaaaagtaaaacaaaataacaaaaaaacttgtcctaatgggaaagcatgcttaataaaaggaaatgcagaagttataaacatgttttgtaagtaagtattcagaattaaaattatgtgatacatttttatgattgcttaatgatccttggatgtcagattccttgggtctatttatagctaaattataatgaaaaattcaaggcttgctggagcaactttgtcaacaaatatattagttttgcttatatatttgatttttatgtggaaaaattactacccttttttacaagcagagaataaactgttgattacttgatttactagatttagaagaatcacaaaagatatgtagattttcttaagcaaaattcagctcttaatatcataaaaattatatctttgggcagatttgtaaacaataggaacaagtaagaagacaggtatgtaagaagtagcaaagtgtaagacggtggagctttaatgtgtggttttactcagggggtcacaagaaaataacccaatggtccttttgaaagtagtacatacacctttaaatggaacttggtctgaagggtgtggaaatgctggtccagggcagatgcacttcagctaccgttccttgcctggtgtgtgcttgtcttgaagcacccttcttatgtgcctttctggaatgggaatgtgttttgccctattggtgaagtccgttagagaacttctctctgcagctagagaaactgaactgattaataaaaagtatgatatctaagatatactgccactctacaggtagtaaatgattcttcacatttgtgcgccagctacatcatgacccttggtaataccgaccaacaggatgaaaattggatatgctttacttttacaaagcacaccttatcttttagttgaagaaatggtggcactatttctttttttgcactaagcaactgcacatttcaaaaggattattgagatgttatgaaaatctctaccttgcacaaaaaaaaacccagcagcttttaaaattcatcatttccacaactgaattgatttccgtttctacagacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagaaaaggttttgacctatatgtctttaatattgtttgaatacatgtataatctttatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggctttggatgtgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaatga

SEQ ID NO: 2401 - DNA, 28090 bp, Homo sapiens
  source 1..28090: mol_type = genomic DNA
aagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaaggtacaagtagtccaaagaatatgccttctcattttgattgattctaacttctctttttttgctttgtatttacctgctttatatttcatggtaactgctaattttgtatctttgacataaaggtaattatgaaccactgcaactctatatgatgcgactttatgtgaaatgttataagtataatgtatatttaacatgactccattgctgtcttaaatataaataccaaattctattaaaagctgtctacaggtatgcatgttagtagaaataattgttttaagttatgtccaaagagcatgttggcatgcttttgagtaggaaataagtgagtatattttgtaaaagcacatttataaaagaagttgcactttagttaatactgagaaaagtaaaactgtgtgtgtgtgtgtgtgtgtgtgtaatgtgtttaatattgaaacataaatccttattaaattgtaggtaaacttgtttggtaatacactgtttagtaatccactatttttatatatgtgtaataatctcatctcataaatattttctatttgtgaagcttcatattggaatcttagaaaatactttcagaaatatgcagaacatgtcttagtataaaacaaattgactgtagtgtgaaaaaacagaatgattgaatagatgggctttgcacaacaacctagaattcatctcccaccctagcttattcgaattagctacacactcactcatcagaaacgttgattgatagggggaagaagagaataaagggaagcagttctgctgaagttctaaatcagggatggcaaattcaaatggctgcaggagtttggatacaggggttaaacaaaatttaaggtgccaagaacaagataaaatgaagaacaggaactgctgtgaactagactgtgtgtttactgcctgaaggcataaatgttcattttattaaacataatactggccaaataaaacgagttctgccttcaactctctacctggttaggatggcaatgacctagacaaagggttagtaagcatagtgcacgatggagaacaggaggaattgaatttttattaaatttttattgctatattgttagtatttttaatatttttgatccacagttggttgaatctgcagatgtggaacccatgaatacagagggctgactgtattgtgtttattgctaacatattgcagaacttcagcctcatgcatttaactgaaaaaacatatgtaaattagtatcccctgccttggaattcttagttttcttgatagtatttttaatacaggccaatggaaacagacaggtaatagtgaggtgtggggcttatctaatagtgggatggagtggccattgatctgacatccttcctactcataaactatgttctcacccagatcttatgcagagaaagtacaagatcagtgtctgtgttaacgtacagactacaacatcatttggaaaagttttccaaattcaaaaatcacaataatcttccaatgcacagcgatttagactacttttttttgctgacacataattattggtcaataactgagtattgatgatttaatttttttctttgtcatgcaacaaaactggtacatgtagattcttttgaatagcatgtgaggtgctagcatttattttaattctttaatatttatctttatgcttataatagttaaccatgagaaagtaagttttctgacatcaaaatgtgcttttgtataatgactaagagaataatataatctcatctattgtaagctataaccaggggaagatatattataataaaaaataccgagacctatgagactctagaattgaattggaaaagtaaatgctgtaatactttgaaagagaaatctctcagagtattcaagaaacttcaggaaaaaggtaggacttgattcagattttaaagaagtgtagaattttgaaagtctcaaataactgcagtaaccatattaaaggactgattgatagtatgaaaaaccctgtgaaaatgctaccaaatgcagtgaagatggaaggaagaaggtagagaatgtgcccataatactggattaacagcagaaaagattagaagttaacatggggttagagttaggaagcaagcttagaacatcaggcagaaaaatacttaattgatgatacaatacacaatagtcgtcggtatgtttttcagcaagtgtaagatatgataaaacctgaatttagagattagatggctaacatttaattcttactaagagtttcctatatactagttcacttaatcttcaaaaatatctgtgagaagttgctgttattttactcatcttacaggcgcaagtccttaaatcaacttgccaactcacctagccaatagggaaagaagtcattctccaaatgtaagcaatctgtaggaagagcctagatgaaaaacctggccttgtatactactctacagcagaaaggttgcaaagtgaggataccagagataggaaaacaaacaaacaaaaaactgtaggatatgaccactttcaaggagaatataagattcccttttagaaagatatttgcataatctgcacattatataacaaaaggcacactggtctggcatggttgagtatatagaaaaaaaaaactgatagataataggatgaaatggaagcttggagagacagattaaattagaggagtaaaagcatcaaactcaagatgtccagtgagttattgatagaaggtatgtatataccttacaaagtaaaacagaggttttataagtgatgttttatgaacatcagtctgtgtttcaaaggtcagagttcaaatagatttgatcattgctataaagattaaaaataaaactaaacagtagatttacttttagagagttttaatggagagaggaaaaagcagaagaattattacagaatttgtaataattcagaggcaggaagacaaaagtagaaaaggaaaagaatgatcttatatgaagaaacaaacaaagagtacaatcctagaagttaataggaggccagaactcaaggaaagaaagcataaaatgttctcaggcagatgaaaattaagaaaataatgattagaacatggtcaccaataattttgaaagtatactttgagtagggtaataaagaagggggaattaaatcaatggagtgcttttccttcttgtttttgaaataagaattatccgtgcaatcttttacaaggaaaagagaagattcagacttcctagtgtagattcaaactcaaggaggtggtacaacagagactcataaaaactgtcaaatgacagtgcacattgtaagccccctacatgtccatagactaagactcatcatcagaatccttatattggtcaagatgtatggtacatttaaggctaagcttctttttgctctcagattcctacacaaccatgttgaccttgttaatttagtcatatgaagtaggtggaatattgtttgaatagactgtttcttttttcttcagtttacagactattttttaaatgatattggcgtatgtatatctttggcatagagtaggagtcaaatatttgaattttgtgtaaacctagagagccaagtgtcttactgctgcctcagaaatacttagagtaatgctatttcacaaacatatgggttttggtactgttgacttcttatttgtgtaccattaaaactcatttaatattactttgtttagctgactaatagcaaattaagaaagctattgtatacaagtgatatttggaaaaaaataattaaacttcttaattgagaatgatgagaaaatcatttcatatttagtgtagagttgcagtgctgtgataccttccaattctgaaagatgtcattaccatttgaagtagtctaaaacagtttagcaagcttatttgtactttatttttgctctttattttcaagggatgtctctggtatcctcatgctttttatggattatagctgcaatctttcttaccagtatttttgaccgtgattcttaatagagttgtgtgcagccagcaagtttatgcagtctttcaaaaaaaaaaaaaaaactaaaaatcaatagcaagagctgccatgaaagtagaaactaccaaagcactgtggaaaagggtcaaaattctaccaccatttacaaaagataatttatcacttgacattattaatgtcagttgataaaaagtttagtgaatattgtataacataacataggtagttgtatgctaagcagattaatgcaggaacagaaaaccagataccacatgttctcacttgtaagtaggagctaaatattgaatacacgtggatataaagaagggaacaatagacacctggggctaatcgagggtgggaagggggaggagagcggaggatcaaaaaactacctatcaggtactatgcttattacctgcgtgaagaaataatccgtacaccaaacctccatgacacacaatttacctatataacaaacttgcacatgtacctctgaccctaaaataaaagttggaagaaaaaaataaaatttaaataagttctatagttctaactatagaacaccaaaaaaggaattataggtttctttgttcctgttagagaactaatattaaatatcatcattcaattataccatttttccttctcccattcttgaaaacaatgatccttctgtagcttgtaagaaatgccttcagacaaaataaattgaaatcatgattcattaaaatggttatacatggctgggcatggtggctcatgcctataatcctagtacttcgggaggctgagacgggtggatcacttgagctcaggagtttgagaccagcctgggcaacatggcaaaaccccatctctacgaataatacaaaaaaattagctggatatggttacacatgcctgtagtcctagcttttgtggggctgaagtgggaggatcccttgagcccaggaggttgaggctgcagtgagctaaggtcgcgcctctgtacttcagcctgggtgacaaagtgagaccctgtctccccccgcaaaaaattatgtttgaattaatagtccatattttaaacatataatttgtttatattacctttataatgtatgcttctagtatttccagatataataaaataatttgtactttttcatagtatctaaaagctcaaaaataaatgactaaaaatattaaagatggtaaagtttgttttatatttaataacgtaagaacaacccaaaatatttaaattaaaatagcagtataaaaacgaattaaacactatgtatatgtgcatatagctgtaataacaaatgtcacttaaagacaatgtttcaagaaatagacaagcatatatgtttcttctactagtccaatttaatatcaacatagtttacttttcatgccaaacacaacatagtttacttttcataccattttaggtacttacataaattcttggaggctaatttctaggtttcagaaacatattaaagcttactactccaatacatttcacctaattttattctgggttttagttgatgatgatgttctgaaactaaagccattttcagattctctgcataactgtcactacaattctaattcattctcaacttacacacacttgcataatgcaaaaacattagaatttcttttaacatggggaaatgattcgttttaggcccaattacaagcaaatggtagcagctagtgggaaggatggaagtatgcttctggtttttaagaaagtttttactttactagaaagagaaatattaaaatgattaaataacagaaaaataattgtcacaggatattatataagttattggcacatgactggcttagacagtaaatgctatgaaccaagcaattaaagcagaatggagaagtaaatggtattagagttcttcctctaaaggatggatagaatttgtaaaatactaatagctgacatttattgaatgtctggtttgtactaacactgttctaagtgttcacgtttattgatccccataacaacctatgaggataaatatttaagccacatgaaaatgccaaaattcaactttttttgattttcaaaaatactaagtctatatggttcaatctaacattactgttataatttcacagataaggaaagtgaggtacaaagaaattaaataatctgctcaaacttcaatgatgatgattattattaagtgatcaaactcatagcatctaatttcattgttggccacttcagtctatgctttagggaagaagccactataccttgttagggtggggatagggtaaaaaaatctaactcgtagattaaaatctgctaaacatacttctgtctcttggtagaaatgtgtaaagtccttgaaaagtgaaacaaaatattttctacatttgtactctactccatgcgtagcaaagtatgaagggcattttaataatgaaagttgtcagttatgtagatgattattgctgttgcatgaaaacagtattcaagtgagtgcatgactacatataggatattaaggtcccaacaagcatctgttttcaaattaatgtagcagaatagaagtttcaaggtcagtgctttcaacccagctatagaacatgctatgtgagagtcaccaggttgaaatccagttgttgttggggcttggtagtctgcatgcttagagtcagggacaaatacacacatacacattagccaagtgagaaaatcttatatcactttttctgtgtacatacttaccagctttgtacttcaaatttagtaaaatatttgcaaaatagtctagacagtccaaattcaatttaaaatcaagttcttttaaattcacaaaggacataacatcttttgtttcttgtgacatatttagtcttggtattcaaggagtgactacaatttaatacatatagtagtggtagcgtcagaagcatattattactacttcgactacttcaatatttttctctatgtctctaaacaaatcatgatgctatggaaactatataaaattgaagtgaaaggacctgatttttctattatctgctagtaaatttgtcacataacattgagtcagacatctcttttctctagaacccattttccacctctaaaaaaatggacggggttagatagtcctgattctaacagttgataattcaacacattcatttcaaccctgtgtttcacgtttgccttatttgtcgctagagatattttttaagggaaaagtgatttgtggcctttagaaaaaaaggtctcatacacgtacaatgtcttttggtgtttagatggacactcattgtagagttaggaaggcattcaatcctgtcaagcacattctgtcacagactctcttcaattctataagagtttgttgagtttctttcattaagagatattaggtcggtacaaaagtaattgtgatttttgtcattaaaatcgcaaaaaccgtaattacttgtgtacaaacctaatatgtaccttgagaggcacttgatgaataacaggtattgtttttgagcattaagattctaatagtgtgaggagaataatgtttgtgtttgtgtgttctcccttgttaagtctcttgaaatggagaaatcaaccgttttcagcttctatttagctttgagcttcaacatcctcaccaaacatatttacatttagaagaatatccataatgctttaagcaattttgtcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgaaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcaggttaagttggagctctttaacctgggcattcttcccaatacttcattagaaataccgcctgcttcaaaatcacctttgtttgcactatctactacagcgtaatagacttctggctcagagagtgaaagctgtggaagaaaactagaagaatatttatgttaactcccttattttacagctaatgaagttgaccctagggaggtttgatgactctccacccagtcccaaagctcctaaagcaaggaatcgagttcctaatgtaggatttttaattctcttattggtgtattttccacttgtctatctttaccaaaggagcatcagtgatttttagtggatttcacaaaggagtaataggacagcttccttgtcctgtttttttctttaaaaactacaacccaataatgatgagtgaggctgttgtaatttttggaaacatgataatgggttgttgcaaatatattgaaagttaggggctgtgtgcagtggctcacacctgtaattccagccttttgggagtccaggtcaggtggattgcttcagctcaggagttcaaggtcagcctgaccaatatggtgaaatcctgtttctactaaaactacaaaaactaggtgggcatggtggcacaggtgagaggatcacttgagcctgggaggtcaaggctgcaaggagccaagattgtaccactgtactccagcctgggtgacagagcaatatcttgtctcaaaaaaaaaaaaaagaaaagaaaaagaaaaaggttagggaagccagattgagcaggattttgaagacacggtgtcaaatttgtgttcttcatgtagatatttttattttcttaatgtagtgagtgttaagtaccatcctctgaagtgtccaactcttgaaggaaaagaaaaagcttccaataccattagatttttcactcagtttttgtgttttgtttcatcagtccaacttaggggcagagaagaagttcaactcagtaagaacttttttgaacttcggtaaaatttgcttaataaattatgttgactgttgcaatattttcaaagcgtcactctaaagcttgccgaagggtcactttaaagtttgccttaaaatcaacagtcgtgtcttcagtattacacactgattctctttgtaaaaggctaaaaagactgctgtaataataatttgttgaaaacatttctgctgcaagtgtatggtaaggttgcaaaggttctcatgaatgaggtacttgggcttggtccttttattctggctgactcaaggctgcaaacaatcttccagaagtgcctgtacttactacaaagacataacccaaacttattttctttttcatagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacaggtgagtgagtccccacaaatatgagacactcttaccttgaccatgtatttctgagaagtcttctacttggcaaatgtcattgtattgaaatgtacttattattttcttgccaaaaatatactttaaaatatttttcctgtctgtatagaatcctaatctaagaatttaatgattataaggtatttattttgaaaaaagtggaagatatatacattatccaaatatttattagacaatatatagaaaagataaacagattttattataaacttaccagtatcaaataacttccctatgtttatgaagttagtgttttgttattgtggcatatattctcaacaactctgaaatattcctgctgaggaaaaaaaaatcagttttcacatcttaaaatttaaagcatattttaacagtggttctcaaagtgtagctgggccacagcaaagtgctgggccagctgcatcagcattaacagggaattgggaaacatgcaaatccctccaccccatcccagaccaaatgaatgaaagagttgaggcccactaaagagttttacaaatcctgggtgatttgaatacacaattttgagaaccaccgtgctaaattcatttttcctaactgcggtacctactcaagatttatattcaaattaacttctgggtcatatagatgtttacattgatctattttagtttcactcttatatttcctctagtgttgagacaatattttatatctttcctctgccttccctgatagtttaacacacttttgaacagaatcttagagtattagaactagaggaaatgatcagccagaatctgtcattttgtgagttaaaaatgcctgatccagtggatgtgaggtcacttgtccatgttcacacagatgtaggtactggtagctcctagatttttgtataccttttcttccatttcaattatagacactctgtctttttcactaaaaagggaaaaaagggggagattgaggtgccaaaaacactaccttaaccaaggattaggaatatatttatggtatccatatggaaacatagttatgttctgctatagaatttgttacctaaatgtgtattttccctcatggataatcacaactagttatacaccatgattagttctcatcacaaagttttgtatttctaatgattttttataatttgtagttttagcatcttatctgttttggttatcggatgattgtataattttccttcttccccaaagcattactatgcttccagattgaaaattcacacccaaaataaaatgaaataacaggcatggtgagggtggtgcctactaccatagcacatgacatataagccccagagggccttggtgcatgtcctgtcttagcagttttacccgaatcgggtgtctctgtgcgcatctgtgacaattcataattttgtcaatgaagacttagtttttatgggtacaaaaacatcttaccttagaattttcttcatggtcttaaagtttttatattattagcaagagtctatacaagtatcttgttgcaaagaatgttgttaggtgtaccatatatatatacacacatatatatatatgtattcataggtgtatatatacttatgaaaatctagaattcacatatgacctaaggagagtatcagcataattgtttaagaaatagaacctaagtgaactgagtaagtgtgaggaaagaaaatagttgttagaatttgagaactcatcatgattttttttgtttgtttgggggaagttatatttttcacttctgtttttaattttgtttattttttgaggcaaggtcttgttctgtcacccactctagagtgcagtggcacgatcacagttcactgcatcctcaacctcctaggctcaagtgatcctcccacctcagcctcctgagtagctgggaccacaggcgcatgccactatacccagctaatttttatgggttttgttttgtagacaaggtttcgccatgttgctcatgctggcctcaaactcctgggctcaagcaatctatgtgccttggcctcgcaaagtgttgggattacaggtgtgacccaccatgcccgaccatatttttcacttttaaatatattatttgggatatgagaaaacatattattgaaatagttctcctctggtagttgacagctgatctatattttattcttaaagcctttaacctatctctctaagggacaaaaaggggatgtgttagatatatttggtttgcttagagaggcaatggagcaaagactggagaagaacagttgcatttacagctaaattttagaatccataaatagctctttctgtaacaattttaaagggattcctgattatctgtaggtcatcttgtctcagcatgtcaccaaaatagtcttttattgtttgcctgagtgccttaaataatggaaaaacaaccagtaccttttagaaaaaaaattaacactttgatagtgcatgtgttgagctaaacatgctttttcataactaattataccctaaatccatctgacattggaagtatgtgagaatgtccctcctcaaacagaaccacaggctgtatttggccattgtctgctaaagtaagcttgattacactttgacaagatatgacctgaatcaaagcacgaaattgcttgggttgagatcttatgtgtgtttctacctacaccatctctatgaagatgctgtaattccttcagaatattcttagatctgtaattcattttttgagttactttgctttggaaagaatataaaaagtaatcttgagaaaagcataaattccttcccttgaccttataaacaaacacgttccaaaacttccatacagtctaacttttaaacaaaaaattcagtaattatgttccctttttaaaacaacattctaaaggcagggctgttttaaggatttttcttctagtgactgccatctactggtataatgttgtcagtacactttaggtaacgtgacaattatgttgctattgttttaatatatgggcatatttctgaaaattgaagtactttgatttgaaatattagtaatatgcacactaatttaaaatacaattgtcctgagtgctgtttcagatttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtaggaatttacatttttattataatggaataaaatgggtttttaaaaaattcagtccaattgcttaagtctttaccttggctatctactcacttcacaggcattcaaatatgacagtgcaattatgatatatatcttatttcttctcagtgaatatcttccacttgtgaaatgtatttttcctgtaataatcacccttcaccgcgttcctaaaatgtagttggtactttgcagcctagatatgttagagtcaggagattagaactagcaaaagtattcaatatacttgaggggctggggaagttagtctataacccttaaaaatggaaattatattcttatctctaattctcattaaagaagtcctgaaaaagggaaaaagcagtgctggataggccttgtattttgatcattctttctaatataagaaaatgtgctctaaatattcccctgctgaagcccctgtactttttcctccttatcctcaggataaagtctcgtttgagtattagatgcaactcttttatgtttgagatcttacttgtttcaataactttatttccactactctcctcacctcttactctgtaatccaaccacactcaaatatctgcatttcccaaaacatattatgttcgttcttatgcatgctaccatctgccgtactttacctaactaaacttgtatttgttacatagaccatttatgtagacttgtactaaaaagtgttttaaccctcacccctaccctgaccattctaaatctggatctggatctgttttgtgttttcccatggagtctccattataacaatattccttctctctcactattttaatttccagtttgccagtttaagaccccttctcgttagtttgctagagaccctggctgatttctcattttaacaccattgcttacatactatctatctggcatattctgtgtgttcaaaaatcatttgttgaatgaatgacatttgagatctaatgttcacatatgacaaatgttttgaattttgtttactgctatttctttagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagtgagtagacaaacaacaaagttatctattttaaaatactctagaactcatgtaattaatcctatcattagaattattaggttttacttgtttttccatttttatcaaaacgtattcctatatcattattttgaatggaggcatggtcatttggaaagtgacaaaatcataagaatcgactgcattagaagaccactttatttttttcattattttttgtcgaaacattctctatatttaatttcaattttataacagattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatcctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggctttttttttttttaagttctgggatacatgtgctgaatgtgcaggattgttacataggtatacatgtgccatggtgctttgctgcacctatcaaaccatcatctaggttttaagccccgtatgccttaatgcattagatatttgagaagaccactttaagtgtatcgttaaataaatagagcttaacttggaatgtcgtcttcttgtggctggcactgaggcaaagaaatgtaatcatctaggaattagacgaattgcattttgagttttggcaggatctggcagtaattttaaagataagctttaaaaagttttgtattaagctcaatattagcatttaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagtcttattgctgatctggagacatatatcctaactttttaaaaagtccacttctcattatagcttcagctttcctagttgggaaattcatctgaatttaacaattaaatttaaacctgaagaatagatttaataaggtttctactcatttataaatacacaattttttttaaattagccggtaagctagtctgtaaatctttgagcactgtttttggcttttatttccctattcacataatcaagtttaataccatatttttatttgttttaaatatactcctcattcctccttttctagacctcttacaattttaatttatatttaaaagttagcctaatgttcacatctcaatactgataaggtaatagacttcattttaatgggatttgtaaataagaatttttagtagtccataatgtcatgaaatggcagcttgaagattaaggaaaatgtgaacttgatggtgtacttgattaccgcttaatgttttgaattacaaataggataagctaactactgaattggaagttggactatgacttcatttggcactatatgtgaatattatgttctctagttcattgttttacttttagatactgttaggattacaaggttatatatcaattataaatgaatgtagaaagccataatgaatcaaattcattctgattttaactcaatactcatagctctttctttggctaatgctttaacttttggatgtctaatttttatcattttagtaaccacttattatcattttagtaaccacttattaatgactgtaacatttagaatacccctagaaatcattgttcttataggtttgttcaatgtccctcacctcaacatagtaagaatagtgatcaaaatgccctcattggcttaattatgacagagtgctagagttcacatcatgtcagcttctgatatgtatcttctttgtcacagcatctagcacttatttctaggcacctttcacaatttttaaggccaataatttaaaaaaatgtattgcagatgtatttcaagtcatttgagtaaccagtgattgagaaatgtgaaagtgagttatgtattgtacaactttgaaaaaatgacttgtagaagtaacattttcccatacatatatttcagtacaacaatactgcagatggagtttataaagttttcaatggaaaagataacataagtaaagttgccataatcgacacatataaaggtaaaaggtaagtattctggtaaaatgtgcatgtatgttactagggtactcttaagcaggaatagtattcatttaacatctcataagacataggcatcaacctatagaacagacctggttataattcagctctggaaactcctgttctgctaggtattaactctttagttgtggtaactggtgagttcacaccagtgcatagctgctgactatcagctccactttaaggtttggttcacctttctgcacaggttatggttgtgttacataaatccccaaagggactattttttcatctctgctacttatccagcattacagtataattattcttacaattagataaccataaatgaaaaggtaaaaaaaaaaaaaacaacacatcaactgattgtgtagtagatggaaactttttttttactttttaaatcgagcatatcgaattccatattccagtggcatgacctaaatgtgtctataaagatggaagcttaatgaatccaggcaactgctttcatgaccttccccctgcaaatagtctttaataattttccatattgataactcagcttttttaactttatcaatgcaaaaatagaatgaatatttcaagtgcagttctacaatgtaaatacaaaatgtgaaaatgaagactttgccaactttaaagtggtaaaataacaaatcagcttcctaagccattatttcctttttttttttctagctccagcctattcacctaaagaatttataatttatcatatatgtaaactaggaagaaccctaataaatatcagaggaacaagctttcttctccataaaattaacaattgtgtgtttgactagtttttttctgaaaaagaataaagtgatcaaaaccaaaagagatgaaatgtttttattaatataaagtaacccctacctcaaactgagtctatctaatgattgcttttaacagctaaatattactagtggagtactttttcttctaaagagtccacagttacatatttttatagaaaaagtcagtagagggaaaaaaacacttctaagtattcacttaaaaggaaatcacagcaattttttatattgagaaataacgagcatttcactctaatattacagagagatgtggaggggagttgcaaagcactcctagttagagtaagaatttcacatcattttaagattgtaaggttgatttaactcatggcaagactgaacatgattaaccacttattttgtttaagcaatggcttgtcttgacatgtcactgtcaggagtggaaaaaaagtttttccatcaccaaaaagtgaggatgcagggaaactattactattgtttttatcacttccagatatatatagcttatttagacagcaaagtataagttagtaaactctttcctactttaacgccagtccatgggagaattaaagggaggaaggggcaagaatataaattaatcatctacatgttttgaatgtttgctgatccaaacatctgcttctttcctcttccctgcttctctcttctgcctgccttgtacttagcttatatcagttacccacttaacactttccttctattcattctgaacacttatactactgagtaattcatgtatcccattggaaaaaaaaaaatttcccctaagtagagatctaagtttctgataaatgtttttaatttttttcttattccaagatgtttctaattaacacctggcagtttttattttatgatctggctacctaatggcatcaggtacattgcaataagataaaaggttcaaacaaaacataaacagaattgaacatttcttaaacttagtacttgtcacatttaaatgcatcatattaacagaagtattgaattataatagaaaaagtaatgtaagaaaggtattctttaaataagaatgtttattcattgtctttttctattcctaggaatctgtcctattgggaaagtcactgcgacatgattaatggtacaggtaagaatatttgttttgtggtcatcacagttaatccacctccctttcccacaaatccaccgttgtactgacagtgttctgaaagttgagggtgtgtgtttacttgcctttatatccccacaacaaaattcagagtcactatttgtatataggctaaaggtctgttcaatgtgatgggatttgtaaagattaatcataaaaaattagcccttactgcatgattcagagaaatgtttgctttgtaaaaactttactgccatcctggcaacagaagtaaatggtaaaaaacaaacaacaacacaaaacactttagttacatttcaaatattttataaatagtatacagataagttagaattgaaagaattaaaaaaagctaattacaaaatagaaaacatatctaagcaaggcttatagctgagatagaataaagttgcaagacagaaccatccatttttggataaggtggtcagaatgagagagaaaacaataacaaagtcagatgtcttcttaactgtgaaaaatatatgtaaaaaatgagcattcataaacttagatttaaggtatggttagatcaggcttattctccttcaggaaaagcaaagtacagatatgcctattagtttaagaattaagatttttaaaaagcaatgggaggctggtcacagtggctcatgtctataatcccagcactttgggagaccaaggcaggtagactacttgtgccccggaggttgagaccagcctgggcaacatagcaaaatcccatctctacaaaaaaaatacaaatattagctgggtgtgctggcacacgcttttagttccggctacttgggaggctgaggcaggaggatcacttgattccaggaggtggaggctgcagtgagctataattgtgcctctgcactctagcctgggcaatagtgtgagaccctgtctcaaaaaaaaaaaaaaaaaaaaaagtggtgggaatcgaataccatgaagtaattaatatccagaggcaagctttcaactactaggaaacaaaagcatgaagtttagaaaattagggaatatcccataggaaaatgatataacaaagataaagacacttaagtaaaaatgaagtacagagaatgtttactttgccaaaggtatgattattgacttcgtatgcgtacttgattctatcattgccttgtaggaaatgataaacaaaaaaagcaaacaaaaaaaacagcaaaaacactgttggatttgcaggggttttcttttgtttttttttttttttttttttgagacatagtctggctctgttgccaggctggagtgcagtggtgcgatctcggctcactgcaacctctgcctcctggggttcaagtgattctcctacctcaatctcatgagtagttgggactacaggcatgtgccaccacacccagctaatttttgtatttttagtagagacggtttcaccatgttggccaggatggtcttgatctcttgaccttgtgatccgcccccctcggcctcccaaagtgctgggattacaggcttgagccaccacacctggccaaggctttgcagggttttgagccataggagtgggcaaataagctattttctaagtaaagcatttctggaaataaattttcaagtcctcaatactaccaatgctagtagttgtataagcggaatacttagtccttagatgcagagataaatatactgtgttaatcctagtaaaggattctttaaggagaaaaatctttaaaaagaagattcattgacaataatagaaatgcatgagcatcaggcatgatgttaaaaatatctatggggaaaatagggctgatacaaactaggaaaagagggaatttggacagagcaggggatgatccctgtgagagagattcttgcttatggcactagcgaaaagaaagtaataaaacagtaaggttctaatgtgttttcatcgtaatttagaagtgcatcctctttaccttcttcagtaagtttgaaaagacttaaaatgaaagtattggtatacatttagaatgtttcttttgggaggacagaaaaaaagctctgcaaatatcaactatgttgcagtcattgtccatggtagttgctgggtataattaggacataatcttcaatgatattttagataatgatcttaaaagcttttcaatgcatttttctttaattattaaggaaatggaaaagcagttgttgtcaatgtccatatgggggcttatattttacttgtcacaagagtgtaaactaatgaaaacaaggtcacaaggttgacacacttgccagagaaagaacctacaatgcataatcaaagatgagacttaccatttaaaactcattcaatgacggctcgtattagtgatattcatgtgagaagtacatggaggagttaactatttcttcatatatccaatgtttgccatggatcatagctgtagcaaaaagtaaattcaataaatgacttttttatacactttcaaagcatttgaagttctgtttagtgagagaactttagtaaatatttttagaagtagtaatcagccattaggacaaatgagaaaaaaaatcactacaaataaatgtggacatggcaggagatccaaatgaacttcactggaagaaaagtgccactctactggtggggtagggcatttcaaaaaacaaacacaatgttagccttaacatttcatgtttaagtttcttttattttgtaccattaaatatgtatagtatgtagatttgttgttgacaatagcagccgccagccatatgtaactgttaaggactcaaaatctggctagtatgatttgaaatgtgctgtaaatataaaatgcacagtagattttgagactttaagaatttaaaatattttataatggttacatgttaaaatattttggatattaataagttaaatatagttttgttttgtttgagacaaagttttccacttgtcgcccaggctggagtgcaatggcatgatcttggctcactgcagtatccgcctcctgggtgcaagcaattatcctgcctcaggatagctgggattacgagcgcctatctcaggatagctgaggcaggcctatcctgcctcaggatagctgcctcccaagtagctgggattacaagcgcctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccggttatttctttttaccttttaaaaatgtggctgctagataaattacttaggcagtttgcattacatttctatggactacactggaggagagatttctaggtttttttctagaacacacattacatctaatcatttgccactcgatttttaaacagatgcagcctcatttccaccttttgttgagaaaagccaggtattgcagttcttttcttctgatatttgcaggtaagacagatactgaagtataagtatgtctgagtcagaccccaggtgacaaaatgcagaccaagaaacttaaacacagcataggaaattcatcatgtttattaactaactctttgcaaaatgttcttctgcatcttccaatttttaatagtacaaattttttttttttttgccatttctatctaagcaagaaccattttgccttttaaaaactaaactagtagtctattaacgatcaagtccagaagggcgtgcccaatctttctaaagacatacagagaagatgatgcaaatgtaacagaactgtgttaatgtgctctgctcagatttgtggggcccagtagataacacacaagcactggagcctttaccactacccttgagcccaagctctgtccctaaagactgtatgcttgtgggtaggcatttaacatctctgaatttttttcttatctgtacaatttaagacagcagtatttcttcatatacgtgtatctggggataagaaaaatatgtgtattgaaccctatgatagacacttggtaaacgatggaaatgtaccaggtatatatccagcatgtatatgcatacactccagtgagtggtctttctttccaggattaattaagccgtgaaagaaactatttcatttaaactgatcacaaataaagtatttgaaggaagtcctataaatatttactctattggataaattgcctgtgagaagtaacttgagtataaataaacatggtacttcacaaacaagaatagttcatgcttggctattgagttttagtatgtgttaaaatttcccaatcactttttttctaagaatgaaacaagaatttaaaagagtatatgatgtttctaagttaaaacaagaataagaaaaaatgaatctccagaatgtaagttcaggttcctggaatgcagctcttttttctctgtatttaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaaggtgagtaaataacctcagtagcacagtccataccataatttgtgatattctttaagatgagaactttaccataatcctttagcaaccaaaatttaaaatatatcataatttgtgatattctttaaaatgagaactttaccataatcctttagcaaccaaaatttaaaattaaagtaagaaagtaattagggcagaagaaagaatggtggcagaaaattttagtgctgattttgtattttgggaagatcccacttgtgtttcagtattacaaaatttagttaaaaccacaccagtatttccttgtggctgcttttagatttagggtgaaatgaaaataattccgagaacacattaaacatcctgttattcatctgtcctaacttttttcactagaaaatggtacaggtaaatgtattttcagtatgtatctaaagctagagttaaacataaaatttggagactagcttatcctgtacatatttatcatactaacgtgggtgtggaagaagaaagaaaaaactagtgttaaataaattcttagtccatagacatattactgcctgaaagctttacatattgaaaattaatactgaaggagtttatagtagaaatcaactgacataattcttccccacccatgttaaaaaccatgtattttttaatgcaagaagctttagttttgtggaaatattttttgagttatatgtgaaatgaaggaagttattaattccaattgactcttaaaacttgtcttcagggagacctgtgtacatttcacttcctcattttctgtatgcaagtcctgatgtttcagaacctattgatggattaaacccaaatgaagaagaacataggacatacttggatattgaacctgtaagaaaacaccttattgatctgatttggttgatatttttaaaaatacaattgaaataaaaataatcttgtcgatgattatttattcaataaataatcatatttattgaatcacattcttgaaagttactgaaacttaggtcgatttcttcctatggtttatgaagtgattctaattggcttaaaataattttatataaatatttatgtttagatgaggagttattgtatattatgcaaaagtcaaagagtatatgtgagtttgactatacttattgtcaaaatctataaaattgttgtagcgcaacagttttaatcatctttatttttgtattttccttttcaaaaagtaaatgaaattctaggattttagtagttatgttttagtttaaacaatgacacatggattctaactgaatatatatttgaccaggaattatctgagatcttatattttgttgctgatttttgattttttaaaaaccatttcaagtaactcacaaatctaactaactaaaaccttgacattcgattgggcaaataaattgtgtgtatctatatggatgcatgtgtatataactataactatatatgcagttttaaaagtttcaattagtcctgtttaaccttaagttactaccttctcttctgctgtaagaaaaataagttttgaatagtataaaataatgtttttaaaagttggtaattatttagttgttctctttttagataactggattcactttacaatttgcaaaacggctgcaggtcaacctattggtcaagccatcagaaaaaattcagtgagtctcttgaaaatggttattttgatatgatctgtagtatcgtagtatcttcttgtaagaacatgagtaaatctatgtaagtaagtggaaataacatctgatatcaacttatctttagcttaatgtcaccaatcattattaaatgcttatgactaatttcacagattttggaatggttttatggttttatttgagcatttgatagcatctcttattttgttagctgcccaaatatttctatgacaataattaatttttggaattcatatttcagttccccgagaatttattgaaaggaaaaatccacacttgtgaaaaaaaatcaatgtgattagaagacatataagagcaaaggaagtcaaaaacaactatattaaaatttaaatgagtcattacaggaacaaaatcaaattagcaacagcaactaatttatgaacatttattttaaagtttgttatatataaatattagtttatatgttcataattattttcaacgtatattacagagtattaaagaatctgaagaggaactatattgtgcctattctttggcttaatgaggtttgtatttgcagctgttagtcattaaaaacaaccttctttgtatataaacaagctcttgatgtttcaaaagaatgtatagtatttaaagctatatgtatttccattacccatatggatgagtatacatttatttaacctatttgagatgatccaattgaacaaaaacatttcctatcatttaagattttcttcaaaaatgcatctattaaacacattttcttgttgtaacatttgtcttctattgcctgacaaggtatttttactataaatccatgcattgatagctataaaaataggaaaaacattgaataagtctttggagcaaatgaaactgttgaccctttgatagttctgaagagcaaatgaatcctagtacattgaagagtaccgtactctatctggcacttaattgcctttcttgacttgcaaaaggaattccattaacttgccttatagatactgatgactaacaccaatagaggtgttagaaaaaagggtgataggcaattgaagggtttattttgttttactaacgtacccaaataatgttgattattaacttgattacagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaa

SEQ ID NO: 2402 - DNA, 27973 bp, Homo sapiens
  source 1..27973: mol_type = genomic DNA
atgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaaggtacaagtagtccaaagaatatgccttctcattttgattgattctaacttctctttttttgctttgtatttacctgctttatatttcatggtaactgctaattttgtatctttgacataaaggtaattatgaaccactgcaactctatatgatgcgactttatgtgaaatgttataagtataatgtatatttaacatgactccattgctgtcttaaatataaataccaaattctattaaaagctgtctacaggtatgcatgttagtagaaataattgttttaagttatgtccaaagagcatgttggcatgcttttgagtaggaaataagtgagtatattttgtaaaagcacatttataaaagaagttgcactttagttaatactgagaaaagtaaaactgtgtgtgtgtgtgtgtgtgtgtgtaatgtgtttaatattgaaacataaatccttattaaattgtaggtaaacttgtttggtaatacactgtttagtaatccactatttttatatatgtgtaataatctcatctcataaatattttctatttgtgaagcttcatattggaatcttagaaaatactttcagaaatatgcagaacatgtcttagtataaaacaaattgactgtagtgtgaaaaaacagaatgattgaatagatgggctttgcacaacaacctagaattcatctcccaccctagcttattcgaattagctacacactcactcatcagaaacgttgattgatagggggaagaagagaataaagggaagcagttctgctgaagttctaaatcagggatggcaaattcaaatggctgcaggagtttggatacaggggttaaacaaaatttaaggtgccaagaacaagataaaatgaagaacaggaactgctgtgaactagactgtgtgtttactgcctgaaggcataaatgttcattttattaaacataatactggccaaataaaacgagttctgccttcaactctctacctggttaggatggcaatgacctagacaaagggttagtaagcatagtgcacgatggagaacaggaggaattgaatttttattaaatttttattgctatattgttagtatttttaatatttttgatccacagttggttgaatctgcagatgtggaacccatgaatacagagggctgactgtattgtgtttattgctaacatattgcagaacttcagcctcatgcatttaactgaaaaaacatatgtaaattagtatcccctgccttggaattcttagttttcttgatagtatttttaatacaggccaatggaaacagacaggtaatagtgaggtgtggggcttatctaatagtgggatggagtggccattgatctgacatccttcctactcataaactatgttctcacccagatcttatgcagagaaagtacaagatcagtgtctgtgttaacgtacagactacaacatcatttggaaaagttttccaaattcaaaaatcacaataatcttccaatgcacagcgatttagactacttttttttgctgacacataattattggtcaataactgagtattgatgatttaatttttttctttgtcatgcaacaaaactggtacatgtagattcttttgaatagcatgtgaggtgctagcatttattttaattctttaatatttatctttatgcttataatagttaaccatgagaaagtaagttttctgacatcaaaatgtgcttttgtataatgactaagagaataatataatctcatctattgtaagctataaccaggggaagatatattataataaaaaataccgagacctatgagactctagaattgaattggaaaagtaaatgctgtaatactttgaaagagaaatctctcagagtattcaagaaacttcaggaaaaaggtaggacttgattcagattttaaagaagtgtagaattttgaaagtctcaaataactgcagtaaccatattaaaggactgattgatagtatgaaaaaccctgtgaaaatgctaccaaatgcagtgaagatggaaggaagaaggtagagaatgtgcccataatactggattaacagcagaaaagattagaagttaacatggggttagagttaggaagcaagcttagaacatcaggcagaaaaatacttaattgatgatacaatacacaatagtcgtcggtatgtttttcagcaagtgtaagatatgataaaacctgaatttagagattagatggctaacatttaattcttactaagagtttcctatatactagttcacttaatcttcaaaaatatctgtgagaagttgctgttattttactcatcttacaggcgcaagtccttaaatcaacttgccaactcacctagccaatagggaaagaagtcattctccaaatgtaagcaatctgtaggaagagcctagatgaaaaacctggccttgtatactactctacagcagaaaggttgcaaagtgaggataccagagataggaaaacaaacaaacaaaaaactgtaggatatgaccactttcaaggagaatataagattcccttttagaaagatatttgcataatctgcacattatataacaaaaggcacactggtctggcatggttgagtatatagaaaaaaaaaactgatagataataggatgaaatggaagcttggagagacagattaaattagaggagtaaaagcatcaaactcaagatgtccagtgagttattgatagaaggtatgtatataccttacaaagtaaaacagaggttttataagtgatgttttatgaacatcagtctgtgtttcaaaggtcagagttcaaatagatttgatcattgctataaagattaaaaataaaactaaacagtagatttacttttagagagttttaatggagagaggaaaaagcagaagaattattacagaatttgtaataattcagaggcaggaagacaaaagtagaaaaggaaaagaatgatcttatatgaagaaacaaacaaagagtacaatcctagaagttaataggaggccagaactcaaggaaagaaagcataaaatgttctcaggcagatgaaaattaagaaaataatgattagaacatggtcaccaataattttgaaagtatactttgagtagggtaataaagaagggggaattaaatcaatggagtgcttttccttcttgtttttgaaataagaattatccgtgcaatcttttacaaggaaaagagaagattcagacttcctagtgtagattcaaactcaaggaggtggtacaacagagactcataaaaactgtcaaatgacagtgcacattgtaagccccctacatgtccatagactaagactcatcatcagaatccttatattggtcaagatgtatggtacatttaaggctaagcttctttttgctctcagattcctacacaaccatgttgaccttgttaatttagtcatatgaagtaggtggaatattgtttgaatagactgtttcttttttcttcagtttacagactattttttaaatgatattggcgtatgtatatctttggcatagagtaggagtcaaatatttgaattttgtgtaaacctagagagccaagtgtcttactgctgcctcagaaatacttagagtaatgctatttcacaaacatatgggttttggtactgttgacttcttatttgtgtaccattaaaactcatttaatattactttgtttagctgactaatagcaaattaagaaagctattgtatacaagtgatatttggaaaaaaataattaaacttcttaattgagaatgatgagaaaatcatttcatatttagtgtagagttgcagtgctgtgataccttccaattctgaaagatgtcattaccatttgaagtagtctaaaacagtttagcaagcttatttgtactttatttttgctctttattttcaagggatgtctctggtatcctcatgctttttatggattatagctgcaatctttcttaccagtatttttgaccgtgattcttaatagagttgtgtgcagccagcaagtttatgcagtctttcaaaaaaaaaaaaaaaactaaaaatcaatagcaagagctgccatgaaagtagaaactaccaaagcactgtggaaaagggtcaaaattctaccaccatttacaaaagataatttatcacttgacattattaatgtcagttgataaaaagtttagtgaatattgtataacataacataggtagttgtatgctaagcagattaatgcaggaacagaaaaccagataccacatgttctcacttgtaagtaggagctaaatattgaatacacgtggatataaagaagggaacaatagacacctggggctaatcgagggtgggaagggggaggagagcggaggatcaaaaaactacctatcaggtactatgcttattacctgcgtgaagaaataatccgtacaccaaacctccatgacacacaatttacctatataacaaacttgcacatgtacctctgaccctaaaataaaagttggaagaaaaaaataaaatttaaataagttctatagttctaactatagaacaccaaaaaaggaattataggtttctttgttcctgttagagaactaatattaaatatcatcattcaattataccatttttccttctcccattcttgaaaacaatgatccttctgtagcttgtaagaaatgccttcagacaaaataaattgaaatcatgattcattaaaatggttatacatggctgggcatggtggctcatgcctataatcctagtacttcgggaggctgagacgggtggatcacttgagctcaggagtttgagaccagcctgggcaacatggcaaaaccccatctctacgaataatacaaaaaaattagctggatatggttacacatgcctgtagtcctagcttttgtggggctgaagtgggaggatcccttgagcccaggaggttgaggctgcagtgagctaaggtcgcgcctctgtacttcagcctgggtgacaaagtgagaccctgtctccccccgcaaaaaattatgtttgaattaatagtccatattttaaacatataatttgtttatattacctttataatgtatgcttctagtatttccagatataataaaataatttgtactttttcatagtatctaaaagctcaaaaataaatgactaaaaatattaaagatggtaaagtttgttttatatttaataacgtaagaacaacccaaaatatttaaattaaaatagcagtataaaaacgaattaaacactatgtatatgtgcatatagctgtaataacaaatgtcacttaaagacaatgtttcaagaaatagacaagcatatatgtttcttctactagtccaatttaatatcaacatagtttacttttcatgccaaacacaacatagtttacttttcataccattttaggtacttacataaattcttggaggctaatttctaggtttcagaaacatattaaagcttactactccaatacatttcacctaattttattctgggttttagttgatgatgatgttctgaaactaaagccattttcagattctctgcataactgtcactacaattctaattcattctcaacttacacacacttgcataatgcaaaaacattagaatttcttttaacatggggaaatgattcgttttaggcccaattacaagcaaatggtagcagctagtgggaaggatggaagtatgcttctggtttttaagaaagtttttactttactagaaagagaaatattaaaatgattaaataacagaaaaataattgtcacaggatattatataagttattggcacatgactggcttagacagtaaatgctatgaaccaagcaattaaagcagaatggagaagtaaatggtattagagttcttcctctaaaggatggatagaatttgtaaaatactaatagctgacatttattgaatgtctggtttgtactaacactgttctaagtgttcacgtttattgatccccataacaacctatgaggataaatatttaagccacatgaaaatgccaaaattcaactttttttgattttcaaaaatactaagtctatatggttcaatctaacattactgttataatttcacagataaggaaagtgaggtacaaagaaattaaataatctgctcaaacttcaatgatgatgattattattaagtgatcaaactcatagcatctaatttcattgttggccacttcagtctatgctttagggaagaagccactataccttgttagggtggggatagggtaaaaaaatctaactcgtagattaaaatctgctaaacatacttctgtctcttggtagaaatgtgtaaagtccttgaaaagtgaaacaaaatattttctacatttgtactctactccatgcgtagcaaagtatgaagggcattttaataatgaaagttgtcagttatgtagatgattattgctgttgcatgaaaacagtattcaagtgagtgcatgactacatataggatattaaggtcccaacaagcatctgttttcaaattaatgtagcagaatagaagtttcaaggtcagtgctttcaacccagctatagaacatgctatgtgagagtcaccaggttgaaatccagttgttgttggggcttggtagtctgcatgcttagagtcagggacaaatacacacatacacattagccaagtgagaaaatcttatatcactttttctgtgtacatacttaccagctttgtacttcaaatttagtaaaatatttgcaaaatagtctagacagtccaaattcaatttaaaatcaagttcttttaaattcacaaaggacataacatcttttgtttcttgtgacatatttagtcttggtattcaaggagtgactacaatttaatacatatagtagtggtagcgtcagaagcatattattactacttcgactacttcaatatttttctctatgtctctaaacaaatcatgatgctatggaaactatataaaattgaagtgaaaggacctgatttttctattatctgctagtaaatttgtcacataacattgagtcagacatctcttttctctagaacccattttccacctctaaaaaaatggacggggttagatagtcctgattctaacagttgataattcaacacattcatttcaaccctgtgtttcacgtttgccttatttgtcgctagagatattttttaagggaaaagtgatttgtggcctttagaaaaaaaggtctcatacacgtacaatgtcttttggtgtttagatggacactcattgtagagttaggaaggcattcaatcctgtcaagcacattctgtcacagactctcttcaattctataagagtttgttgagtttctttcattaagagatattaggtcggtacaaaagtaattgtgatttttgtcattaaaatcgcaaaaaccgtaattacttgtgtacaaacctaatatgtaccttgagaggcacttgatgaataacaggtattgtttttgagcattaagattctaatagtgtgaggagaataatgtttgtgtttgtgtgttctcccttgttaagtctcttgaaatggagaaatcaaccgttttcagcttctatttagctttgagcttcaacatcctcaccaaacatatttacatttagaagaatatccataatgctttaagcaattttgtcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgaaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcaggttaagttggagctctttaacctgggcattcttcccaatacttcattagaaataccgcctgcttcaaaatcacctttgtttgcactatctactacagcgtaatagacttctggctcagagagtgaaagctgtggaagaaaactagaagaatatttatgttaactcccttattttacagctaatgaagttgaccctagggaggtttgatgactctccacccagtcccaaagctcctaaagcaaggaatcgagttcctaatgtaggatttttaattctcttattggtgtattttccacttgtctatctttaccaaaggagcatcagtgatttttagtggatttcacaaaggagtaataggacagcttccttgtcctgtttttttctttaaaaactacaacccaataatgatgagtgaggctgttgtaatttttggaaacatgataatgggttgttgcaaatatattgaaagttaggggctgtgtgcagtggctcacacctgtaattccagccttttgggagtccaggtcaggtggattgcttcagctcaggagttcaaggtcagcctgaccaatatggtgaaatcctgtttctactaaaactacaaaaactaggtgggcatggtggcacaggtgagaggatcacttgagcctgggaggtcaaggctgcaaggagccaagattgtaccactgtactccagcctgggtgacagagcaatatcttgtctcaaaaaaaaaaaaaagaaaagaaaaagaaaaaggttagggaagccagattgagcaggattttgaagacacggtgtcaaatttgtgttcttcatgtagatatttttattttcttaatgtagtgagtgttaagtaccatcctctgaagtgtccaactcttgaaggaaaagaaaaagcttccaataccattagatttttcactcagtttttgtgttttgtttcatcagtccaacttaggggcagagaagaagttcaactcagtaagaacttttttgaacttcggtaaaatttgcttaataaattatgttgactgttgcaatattttcaaagcgtcactctaaagcttgccgaagggtcactttaaagtttgccttaaaatcaacagtcgtgtcttcagtattacacactgattctctttgtaaaaggctaaaaagactgctgtaataataatttgttgaaaacatttctgctgcaagtgtatggtaaggttgcaaaggttctcatgaatgaggtacttgggcttggtccttttattctggctgactcaaggctgcaaacaatcttccagaagtgcctgtacttactacaaagacataacccaaacttattttctttttcatagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacaggtgagtgagtccccacaaatatgagacactcttaccttgaccatgtatttctgagaagtcttctacttggcaaatgtcattgtattgaaatgtacttattattttcttgccaaaaatatactttaaaatatttttcctgtctgtatagaatcctaatctaagaatttaatgattataaggtatttattttgaaaaaagtggaagatatatacattatccaaatatttattagacaatatatagaaaagataaacagattttattataaacttaccagtatcaaataacttccctatgtttatgaagttagtgttttgttattgtggcatatattctcaacaactctgaaatattcctgctgaggaaaaaaaaatcagttttcacatcttaaaatttaaagcatattttaacagtggttctcaaagtgtagctgggccacagcaaagtgctgggccagctgcatcagcattaacagggaattgggaaacatgcaaatccctccaccccatcccagaccaaatgaatgaaagagttgaggcccactaaagagttttacaaatcctgggtgatttgaatacacaattttgagaaccaccgtgctaaattcatttttcctaactgcggtacctactcaagatttatattcaaattaacttctgggtcatatagatgtttacattgatctattttagtttcactcttatatttcctctagtgttgagacaatattttatatctttcctctgccttccctgatagtttaacacacttttgaacagaatcttagagtattagaactagaggaaatgatcagccagaatctgtcattttgtgagttaaaaatgcctgatccagtggatgtgaggtcacttgtccatgttcacacagatgtaggtactggtagctcctagatttttgtataccttttcttccatttcaattatagacactctgtctttttcactaaaaagggaaaaaagggggagattgaggtgccaaaaacactaccttaaccaaggattaggaatatatttatggtatccatatggaaacatagttatgttctgctatagaatttgttacctaaatgtgtattttccctcatggataatcacaactagttatacaccatgattagttctcatcacaaagttttgtatttctaatgattttttataatttgtagttttagcatcttatctgttttggttatcggatgattgtataattttccttcttccccaaagcattactatgcttccagattgaaaattcacacccaaaataaaatgaaataacaggcatggtgagggtggtgcctactaccatagcacatgacatataagccccagagggccttggtgcatgtcctgtcttagcagttttacccgaatcgggtgtctctgtgcgcatctgtgacaattcataattttgtcaatgaagacttagtttttatgggtacaaaaacatcttaccttagaattttcttcatggtcttaaagtttttatattattagcaagagtctatacaagtatcttgttgcaaagaatgttgttaggtgtaccatatatatatacacacatatatatatatgtattcataggtgtatatatacttatgaaaatctagaattcacatatgacctaaggagagtatcagcataattgtttaagaaatagaacctaagtgaactgagtaagtgtgaggaaagaaaatagttgttagaatttgagaactcatcatgattttttttgtttgtttgggggaagttatatttttcacttctgtttttaattttgtttattttttgaggcaaggtcttgttctgtcacccactctagagtgcagtggcacgatcacagttcactgcatcctcaacctcctaggctcaagtgatcctcccacctcagcctcctgagtagctgggaccacaggcgcatgccactatacccagctaatttttatgggttttgttttgtagacaaggtttcgccatgttgctcatgctggcctcaaactcctgggctcaagcaatctatgtgccttggcctcgcaaagtgttgggattacaggtgtgacccaccatgcccgaccatatttttcacttttaaatatattatttgggatatgagaaaacatattattgaaatagttctcctctggtagttgacagctgatctatattttattcttaaagcctttaacctatctctctaagggacaaaaaggggatgtgttagatatatttggtttgcttagagaggcaatggagcaaagactggagaagaacagttgcatttacagctaaattttagaatccataaatagctctttctgtaacaattttaaagggattcctgattatctgtaggtcatcttgtctcagcatgtcaccaaaatagtcttttattgtttgcctgagtgccttaaataatggaaaaacaaccagtaccttttagaaaaaaaattaacactttgatagtgcatgtgttgagctaaacatgctttttcataactaattataccctaaatccatctgacattggaagtatgtgagaatgtccctcctcaaacagaaccacaggctgtatttggccattgtctgctaaagtaagcttgattacactttgacaagatatgacctgaatcaaagcacgaaattgcttgggttgagatcttatgtgtgtttctacctacaccatctctatgaagatgctgtaattccttcagaatattcttagatctgtaattcattttttgagttactttgctttggaaagaatataaaaagtaatcttgagaaaagcataaattccttcccttgaccttataaacaaacacgttccaaaacttccatacagtctaacttttaaacaaaaaattcagtaattatgttccctttttaaaacaacattctaaaggcagggctgttttaaggatttttcttctagtgactgccatctactggtataatgttgtcagtacactttaggtaacgtgacaattatgttgctattgttttaatatatgggcatatttctgaaaattgaagtactttgatttgaaatattagtaatatgcacactaatttaaaatacaattgtcctgagtgctgtttcagatttttatattctttgtgtgtctgcagtacttcaagaatagtagttttaataaaattatattaaaaatatatttctagccaactttgaatcctctttttaaagaatctgagacatttgtttagtaaatacatttactgagaactcattatataccaggcatgatgcttagagatacaaaacactcataaacccctaccctgtaggaatttacatttttattataatggaataaaatgggtttttaaaaaattcagtccaattgcttaagtctttaccttggctatctactcacttcacaggcattcaaatatgacagtgcaattatgatatatatcttatttcttctcagtgaatatcttccacttgtgaaatgtatttttcctgtaataatcacccttcaccgcgttcctaaaatgtagttggtactttgcagcctagatatgttagagtcaggagattagaactagcaaaagtattcaatatacttgaggggctggggaagttagtctataacccttaaaaatggaaattatattcttatctctaattctcattaaagaagtcctgaaaaagggaaaaagcagtgctggataggccttgtattttgatcattctttctaatataagaaaatgtgctctaaatattcccctgctgaagcccctgtactttttcctccttatcctcaggataaagtctcgtttgagtattagatgcaactcttttatgtttgagatcttacttgtttcaataactttatttccactactctcctcacctcttactctgtaatccaaccacactcaaatatctgcatttcccaaaacatattatgttcgttcttatgcatgctaccatctgccgtactttacctaactaaacttgtatttgttacatagaccatttatgtagacttgtactaaaaagtgttttaaccctcacccctaccctgaccattctaaatctggatctggatctgttttgtgttttcccatggagtctccattataacaatattccttctctctcactattttaatttccagtttgccagtttaagaccccttctcgttagtttgctagagaccctggctgatttctcattttaacaccattgcttacatactatctatctggcatattctgtgtgttcaaaaatcatttgttgaatgaatgacatttgagatctaatgttcacatatgacaaatgttttgaattttgtttactgctatttctttagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagtgagtagacaaacaacaaagttatctattttaaaatactctagaactcatgtaattaatcctatcattagaattattaggttttacttgtttttccatttttatcaaaacgtattcctatatcattattttgaatggaggcatggtcatttggaaagtgacaaaatcataagaatcgactgcattagaagaccactttatttttttcattattttttgtcgaaacattctctatatttaatttcaattttataacagattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatcctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggctttttttttttttaagttctgggatacatgtgctgaatgtgcaggattgttacataggtatacatgtgccatggtgctttgctgcacctatcaaaccatcatctaggttttaagccccgtatgccttaatgcattagatatttgagaagaccactttaagtgtatcgttaaataaatagagcttaacttggaatgtcgtcttcttgtggctggcactgaggcaaagaaatgtaatcatctaggaattagacgaattgcattttgagttttggcaggatctggcagtaattttaaagataagctttaaaaagttttgtattaagctcaatattagcatttaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagtcttattgctgatctggagacatatatcctaactttttaaaaagtccacttctcattatagcttcagctttcctagttgggaaattcatctgaatttaacaattaaatttaaacctgaagaatagatttaataaggtttctactcatttataaatacacaattttttttaaattagccggtaagctagtctgtaaatctttgagcactgtttttggcttttatttccctattcacataatcaagtttaataccatatttttatttgttttaaatatactcctcattcctccttttctagacctcttacaattttaatttatatttaaaagttagcctaatgttcacatctcaatactgataaggtaatagacttcattttaatgggatttgtaaataagaatttttagtagtccataatgtcatgaaatggcagcttgaagattaaggaaaatgtgaacttgatggtgtacttgattaccgcttaatgttttgaattacaaataggataagctaactactgaattggaagttggactatgacttcatttggcactatatgtgaatattatgttctctagttcattgttttacttttagatactgttaggattacaaggttatatatcaattataaatgaatgtagaaagccataatgaatcaaattcattctgattttaactcaatactcatagctctttctttggctaatgctttaacttttggatgtctaatttttatcattttagtaaccacttattatcattttagtaaccacttattaatgactgtaacatttagaatacccctagaaatcattgttcttataggtttgttcaatgtccctcacctcaacatagtaagaatagtgatcaaaatgccctcattggcttaattatgacagagtgctagagttcacatcatgtcagcttctgatatgtatcttctttgtcacagcatctagcacttatttctaggcacctttcacaatttttaaggccaataatttaaaaaaatgtattgcagatgtatttcaagtcatttgagtaaccagtgattgagaaatgtgaaagtgagttatgtattgtacaactttgaaaaaatgacttgtagaagtaacattttcccatacatatatttcagtacaacaatactgcagatggagtttataaagttttcaatggaaaagataacataagtaaagttgccataatcgacacatataaaggtaaaaggtaagtattctggtaaaatgtgcatgtatgttactagggtactcttaagcaggaatagtattcatttaacatctcataagacataggcatcaacctatagaacagacctggttataattcagctctggaaactcctgttctgctaggtattaactctttagttgtggtaactggtgagttcacaccagtgcatagctgctgactatcagctccactttaaggtttggttcacctttctgcacaggttatggttgtgttacataaatccccaaagggactattttttcatctctgctacttatccagcattacagtataattattcttacaattagataaccataaatgaaaaggtaaaaaaaaaaaaaacaacacatcaactgattgtgtagtagatggaaactttttttttactttttaaatcgagcatatcgaattccatattccagtggcatgacctaaatgtgtctataaagatggaagcttaatgaatccaggcaactgctttcatgaccttccccctgcaaatagtctttaataattttccatattgataactcagcttttttaactttatcaatgcaaaaatagaatgaatatttcaagtgcagttctacaatgtaaatacaaaatgtgaaaatgaagactttgccaactttaaagtggtaaaataacaaatcagcttcctaagccattatttcctttttttttttctagctccagcctattcacctaaagaatttataatttatcatatatgtaaactaggaagaaccctaataaatatcagaggaacaagctttcttctccataaaattaacaattgtgtgtttgactagtttttttctgaaaaagaataaagtgatcaaaaccaaaagagatgaaatgtttttattaatataaagtaacccctacctcaaactgagtctatctaatgattgcttttaacagctaaatattactagtggagtactttttcttctaaagagtccacagttacatatttttatagaaaaagtcagtagagggaaaaaaacacttctaagtattcacttaaaaggaaatcacagcaattttttatattgagaaataacgagcatttcactctaatattacagagagatgtggaggggagttgcaaagcactcctagttagagtaagaatttcacatcattttaagattgtaaggttgatttaactcatggcaagactgaacatgattaaccacttattttgtttaagcaatggcttgtcttgacatgtcactgtcaggagtggaaaaaaagtttttccatcaccaaaaagtgaggatgcagggaaactattactattgtttttatcacttccagatatatatagcttatttagacagcaaagtataagttagtaaactctttcctactttaacgccagtccatgggagaattaaagggaggaaggggcaagaatataaattaatcatctacatgttttgaatgtttgctgatccaaacatctgcttctttcctcttccctgcttctctcttctgcctgccttgtacttagcttatatcagttacccacttaacactttccttctattcattctgaacacttatactactgagtaattcatgtatcccattggaaaaaaaaaaatttcccctaagtagagatctaagtttctgataaatgtttttaatttttttcttattccaagatgtttctaattaacacctggcagtttttattttatgatctggctacctaatggcatcaggtacattgcaataagataaaaggttcaaacaaaacataaacagaattgaacatttcttaaacttagtacttgtcacatttaaatgcatcatattaacagaagtattgaattataatagaaaaagtaatgtaagaaaggtattctttaaataagaatgtttattcattgtctttttctattcctaggaatctgtcctattgggaaagtcactgcgacatgattaatggtacaggtaagaatatttgttttgtggtcatcacagttaatccacctccctttcccacaaatccaccgttgtactgacagtgttctgaaagttgagggtgtgtgtttacttgcctttatatccccacaacaaaattcagagtcactatttgtatataggctaaaggtctgttcaatgtgatgggatttgtaaagattaatcataaaaaattagcccttactgcatgattcagagaaatgtttgctttgtaaaaactttactgccatcctggcaacagaagtaaatggtaaaaaacaaacaacaacacaaaacactttagttacatttcaaatattttataaatagtatacagataagttagaattgaaagaattaaaaaaagctaattacaaaatagaaaacatatctaagcaaggcttatagctgagatagaataaagttgcaagacagaaccatccatttttggataaggtggtcagaatgagagagaaaacaataacaaagtcagatgtcttcttaactgtgaaaaatatatgtaaaaaatgagcattcataaacttagatttaaggtatggttagatcaggcttattctccttcaggaaaagcaaagtacagatatgcctattagtttaagaattaagatttttaaaaagcaatgggaggctggtcacagtggctcatgtctataatcccagcactttgggagaccaaggcaggtagactacttgtgccccggaggttgagaccagcctgggcaacatagcaaaatcccatctctacaaaaaaaatacaaatattagctgggtgtgctggcacacgcttttagttccggctacttgggaggctgaggcaggaggatcacttgattccaggaggtggaggctgcagtgagctataattgtgcctctgcactctagcctgggcaatagtgtgagaccctgtctcaaaaaaaaaaaaaaaaaaaaaagtggtgggaatcgaataccatgaagtaattaatatccagaggcaagctttcaactactaggaaacaaaagcatgaagtttagaaaattagggaatatcccataggaaaatgatataacaaagataaagacacttaagtaaaaatgaagtacagagaatgtttactttgccaaaggtatgattattgacttcgtatgcgtacttgattctatcattgccttgtaggaaatgataaacaaaaaaagcaaacaaaaaaaacagcaaaaacactgttggatttgcaggggttttcttttgtttttttttttttttttttttgagacatagtctggctctgttgccaggctggagtgcagtggtgcgatctcggctcactgcaacctctgcctcctggggttcaagtgattctcctacctcaatctcatgagtagttgggactacaggcatgtgccaccacacccagctaatttttgtatttttagtagagacggtttcaccatgttggccaggatggtcttgatctcttgaccttgtgatccgcccccctcggcctcccaaagtgctgggattacaggcttgagccaccacacctggccaaggctttgcagggttttgagccataggagtgggcaaataagctattttctaagtaaagcatttctggaaataaattttcaagtcctcaatactaccaatgctagtagttgtataagcggaatacttagtccttagatgcagagataaatatactgtgttaatcctagtaaaggattctttaaggagaaaaatctttaaaaagaagattcattgacaataatagaaatgcatgagcatcaggcatgatgttaaaaatatctatggggaaaatagggctgatacaaactaggaaaagagggaatttggacagagcaggggatgatccctgtgagagagattcttgcttatggcactagcgaaaagaaagtaataaaacagtaaggttctaatgtgttttcatcgtaatttagaagtgcatcctctttaccttcttcagtaagtttgaaaagacttaaaatgaaagtattggtatacatttagaatgtttcttttgggaggacagaaaaaaagctctgcaaatatcaactatgttgcagtcattgtccatggtagttgctgggtataattaggacataatcttcaatgatattttagataatgatcttaaaagcttttcaatgcatttttctttaattattaaggaaatggaaaagcagttgttgtcaatgtccatatgggggcttatattttacttgtcacaagagtgtaaactaatgaaaacaaggtcacaaggttgacacacttgccagagaaagaacctacaatgcataatcaaagatgagacttaccatttaaaactcattcaatgacggctcgtattagtgatattcatgtgagaagtacatggaggagttaactatttcttcatatatccaatgtttgccatggatcatagctgtagcaaaaagtaaattcaataaatgacttttttatacactttcaaagcatttgaagttctgtttagtgagagaactttagtaaatatttttagaagtagtaatcagccattaggacaaatgagaaaaaaaatcactacaaataaatgtggacatggcaggagatccaaatgaacttcactggaagaaaagtgccactctactggtggggtagggcatttcaaaaaacaaacacaatgttagccttaacatttcatgtttaagtttcttttattttgtaccattaaatatgtatagtatgtagatttgttgttgacaatagcagccgccagccatatgtaactgttaaggactcaaaatctggctagtatgatttgaaatgtgctgtaaatataaaatgcacagtagattttgagactttaagaatttaaaatattttataatggttacatgttaaaatattttggatattaataagttaaatatagttttgttttgtttgagacaaagttttccacttgtcgcccaggctggagtgcaatggcatgatcttggctcactgcagtatccgcctcctgggtgcaagcaattatcctgcctcaggatagctgggattacgagcgcctatctcaggatagctgaggcaggcctatcctgcctcaggatagctgcctcccaagtagctgggattacaagcgcctaccaccacacccagctaattttgtgtatttttagtagagatggggtttcaccatgtaggccaggctggtctcaaacccctgacctcaggtgatccacccgccttggccttccaaagtgctgggcttgcaggcatgagccagcatgcctggccggttatttctttttaccttttaaaaatgtggctgctagataaattacttaggcagtttgcattacatttctatggactacactggaggagagatttctaggtttttttctagaacacacattacatctaatcatttgccactcgatttttaaacagatgcagcctcatttccaccttttgttgagaaaagccaggtattgcagttcttttcttctgatatttgcaggtaagacagatactgaagtataagtatgtctgagtcagaccccaggtgacaaaatgcagaccaagaaacttaaacacagcataggaaattcatcatgtttattaactaactctttgcaaaatgttcttctgcatcttccaatttttaatagtacaaattttttttttttttgccatttctatctaagcaagaaccattttgccttttaaaaactaaactagtagtctattaacgatcaagtccagaagggcgtgcccaatctttctaaagacatacagagaagatgatgcaaatgtaacagaactgtgttaatgtgctctgctcagatttgtggggcccagtagataacacacaagcactggagcctttaccactacccttgagcccaagctctgtccctaaagactgtatgcttgtgggtaggcatttaacatctctgaatttttttcttatctgtacaatttaagacagcagtatttcttcatatacgtgtatctggggataagaaaaatatgtgtattgaaccctatgatagacacttggtaaacgatggaaatgtaccaggtatatatccagcatgtatatgcatacactccagtgagtggtctttctttccaggattaattaagccgtgaaagaaactatttcatttaaactgatcacaaataaagtatttgaaggaagtcctataaatatttactctattggataaattgcctgtgagaagtaacttgagtataaataaacatggtacttcacaaacaagaatagttcatgcttggctattgagttttagtatgtgttaaaatttcccaatcactttttttctaagaatgaaacaagaatttaaaagagtatatgatgtttctaagttaaaacaagaataagaaaaaatgaatctccagaatgtaagttcaggttcctggaatgcagctcttttttctctgtatttaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaaggtgagtaaataacctcagtagcacagtccataccataatttgtgatattctttaagatgagaactttaccataatcctttagcaaccaaaatttaaaatatatcataatttgtgatattctttaaaatgagaactttaccataatcctttagcaaccaaaatttaaaattaaagtaagaaagtaattagggcagaagaaagaatggtggcagaaaattttagtgctgattttgtattttgggaagatcccacttgtgtttcagtattacaaaatttagttaaaaccacaccagtatttccttgtggctgcttttagatttagggtgaaatgaaaataattccgagaacacattaaacatcctgttattcatctgtcctaacttttttcactagaaaatggtacaggtaaatgtattttcagtatgtatctaaagctagagttaaacataaaatttggagactagcttatcctgtacatatttatcatactaacgtgggtgtggaagaagaaagaaaaaactagtgttaaataaattcttagtccatagacatattactgcctgaaagctttacatattgaaaattaatactgaaggagtttatagtagaaatcaactgacataattcttccccacccatgttaaaaaccatgtattttttaatgcaagaagctttagttttgtggaaatattttttgagttatatgtgaaatgaaggaagttattaattccaattgactcttaaaacttgtcttcagggagacctgtgtacatttcacttcctcattttctgtatgcaagtcctgatgtttcagaacctattgatggattaaacccaaatgaagaagaacataggacatacttggatattgaacctgtaagaaaacaccttattgatctgatttggttgatatttttaaaaatacaattgaaataaaaataatcttgtcgatgattatttattcaataaataatcatatttattgaatcacattcttgaaagttactgaaacttaggtcgatttcttcctatggtttatgaagtgattctaattggcttaaaataattttatataaatatttatgtttagatgaggagttattgtatattatgcaaaagtcaaagagtatatgtgagtttgactatacttattgtcaaaatctataaaattgttgtagcgcaacagttttaatcatctttatttttgtattttccttttcaaaaagtaaatgaaattctaggattttagtagttatgttttagtttaaacaatgacacatggattctaactgaatatatatttgaccaggaattatctgagatcttatattttgttgctgatttttgattttttaaaaaccatttcaagtaactcacaaatctaactaactaaaaccttgacattcgattgggcaaataaattgtgtgtatctatatggatgcatgtgtatataactataactatatatgcagttttaaaagtttcaattagtcctgtttaaccttaagttactaccttctcttctgctgtaagaaaaataagttttgaatagtataaaataatgtttttaaaagttggtaattatttagttgttctctttttagataactggattcactttacaatttgcaaaacggctgcaggtcaacctattggtcaagccatcagaaaaaattcagtgagtctcttgaaaatggttattttgatatgatctgtagtatcgtagtatcttcttgtaagaacatgagtaaatctatgtaagtaagtggaaataacatctgatatcaacttatctttagcttaatgtcaccaatcattattaaatgcttatgactaatttcacagattttggaatggttttatggttttatttgagcatttgatagcatctcttattttgttagctgcccaaatatttctatgacaataattaatttttggaattcatatttcagttccccgagaatttattgaaaggaaaaatccacacttgtgaaaaaaaatcaatgtgattagaagacatataagagcaaaggaagtcaaaaacaactatattaaaatttaaatgagtcattacaggaacaaaatcaaattagcaacagcaactaatttatgaacatttattttaaagtttgttatatataaatattagtttatatgttcataattattttcaacgtatattacagagtattaaagaatctgaagaggaactatattgtgcctattctttggcttaatgaggtttgtatttgcagctgttagtcattaaaaacaaccttctttgtatataaacaagctcttgatgtttcaaaagaatgtatagtatttaaagctatatgtatttccattacccatatggatgagtatacatttatttaacctatttgagatgatccaattgaacaaaaacatttcctatcatttaagattttcttcaaaaatgcatctattaaacacattttcttgttgtaacatttgtcttctattgcctgacaaggtatttttactataaatccatgcattgatagctataaaaataggaaaaacattgaataagtctttggagcaaatgaaactgttgaccctttgatagttctgaagagcaaatgaatcctagtacattgaagagtaccgtactctatctggcacttaattgcctttcttgacttgcaaaaggaattccattaacttgccttatagatactgatgactaacaccaatagaggtgttagaaaaaagggtgataggcaattgaagggtttattttgttttactaacgtacccaaataatgttgattattaacttgattacagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaa

SEQ ID NO: 2403 - DNA, 5185 bp, Homo sapiens
  source 1..5185: mol_type = genomic DNA
ttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtgagttgcctcatggctacccagccggggcccagcccctgccgctaacccagccctcatcttcccctgtggcccacccccgtatccgcatctcctctccccaggtcctcggcagcctgatcttctgcttcggcatctggatcctcattgacaagaccagcttcgtgtcctttgtgggtgaggggggctggggcaggtgggagggcctcccccaacccaagcaacttcctggggtctcccttgtctcagggagacctacggtgccctactctgcaggcaggctacaggctcccatccactgctcaccggaggcttcttggagcctgagtcttcttccggcaaatggggttgtgcatacaaacaacaatgatcatgagagccatttctcaagcacttcctatctgtcgggacttgtggctggtcagatgcccccacaaaccttcccctcgcttgaggttcagagaggggaagccccttgatggatgtcatacagcaaggacgtaaaagagccaaaataacattaataataggaaaataataatgaagtatgaccctaaataataatgaaatataaccctaaacgctcatatttaagaagtctttgccctgtgttgaggactgggttgaacacatgtcctcatgtgtctctcaaaatgaccctaggggccgggcgcggtggctcacacctgtaattccagcactttgggaagccgaggcaggtggatcacttgaggtcaggagttcgagaatagcctggccaacatggtgaaaccctgtctctactcaaaaatacaaaacgttagccaggcatggtggcacatgcctgtagtcgcagctactagggaggctgaggcaggagaatcacttgaacctgggaggcagaggttgcagtgagccgagatcacatcactgcactccagcctgggggacagagcgaggctccaactcaaaaaaaaaccctaagaaatagatatcatctcctatgcctcagggaggtttaaggagccaagccaatgtcacagaacaagtgatagggctgaaactactggggacgaggaggagctgaaggaggaaggagagggtaagaggaagagagacagagatccagggacgggaaacaggcccagaaagaagagaaagtttcagaaggaaacagggactcagggtggggcagggacagagtcccagagagaggggcaccaagatactgctccccacttgggtggctgcctaggtgggaaatggggctgcctggagctgtgccacacagctcatcatcactcccctcacctctcccaggcttggccttcgtgcctctgcagatctggtccaaagtcctggccatctcaggaatcttcaccatgggcatcgccctcctgggttgtgtgggggccctcaaggagctccgctgcctcctgggcctggtgagtgcaccatccctctccgtccctaggaacactcctatccccaccctcaaaaatggcctgggccggggttgcaggggtggtcagcctgatctctccactctgctccccagtattttgggatgctgctgctcctgtttgccacacagatcaccctgggaatcctcatctccactcagcgggcccaggtgagcttcctgcagtggccaccacccacccccagcagggaggagagggaagggagtggtgggagagggtggagagagaccgaaacaagggcagacaggggctaacctagataaagagaaataagaggctgggcctggtggctcacgcctgtaatcccataatcccagcactttgggaggctgaggtgggagtccaggagtttgagaccagcctgggcaacatagtgagaccccatctatatttaaaaaaaaaatccgggtgtgatggtgtgcacctggggtcccagctacttgggaggtcgaggtgggaggatcacttgagccagggagtttgaggctacagtgagccatgcactcagcctgggtgacagagtgagaccctgtctcaaaaaataaattaatagaaagacacaccgacctggaccaagggagacaggcataaacagctccaaagggaaacacacgggaaaaagagagaacaagagaaagaaatagacgccctgaaagaagagacagagacttatgagccgtagaaatagtggaagaaacagaaagacagacctgaagtacacagagctagccattcagtaaggatttgagactggcccagagatgcacagggcccgcctgaggctggcacagcctgagagggggaggggtggggcggggaagataaggcccagcctcactggtggcctctcagctggagcgaagcttgcgggacgtcgtagagaaaaccatccaaaagtacggcaccaaccccgaggagaccgcggccgaggagagctgggactatgtgcagttccaggtaagcccccctcctccagttccctcccggactgacccgcctcagccctgtgcttggaggagactccaccccaacgtgggcccgacccccagctctacgatcctaacacaccccaatccctcccaggcccgacgctccccactccccagatgacacaactgtccccggcgtcgcctggtctcccagtacccagaccctggcgtggcttcgccatctacctcgagagactccgcccccgcccccgccccgaccagaggttgtcaggcccctagtcccaagaccctagcgagacacggcttcctaccccgtagtgactctggcttccaccggaccccgcccccgatgagactcacatggtctcgcactcctattcacctgtcgggtatcagaggctcaattgcaccacccacccaatctctagtccacagcgcgaccctgcagctccttccccagccccaggtcaccccgtgactcgtctttcccagccccatgttcccgtaatgtcccctggctccggccccatcgtgaccccagcccactgtcccccactccacacccaccacttagtcccctgctccccgacctgacctcatacccatcaccttgtcccctgatccccaacatcatatgtctccagtcccggtccctctgactcgtatccctctcccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgaggtgggcaggggttcggagcataaacctgtcgaatggggcggggcctgcgggagggggagggctgtcagtgagtagcggcctgagaaagggcggggtctacgagaaaaggaaaggtacggcaggaggggcggggccctctgaagggggcggggtctgcaggaagggcagggcctaaagaaaaggctgggctggctctggaatacagatgtctagggaggggccaggcttggaaaaggtgaagcgagggtgcactagtaaggagactagagtgccctggtgactaggggagcgggtagatgcctgaagacggtgagggttggcctgaaaagaacgctgggcctgggcttgagagtcccagaaagaatccctttaacttttccctacaccccccagggctgcgcgcagggcctccagaagtggctgcacaacaaccttatttccatagtgggcatttgcctgggcgtcggcctactcgaggtgatctggccccgcccccacccgcgatcggccctaaatccctagatggccctgcccttcatttcgcgtccttcggttgcctgggaaggacgagctcagggcggagcgcagcccaccccggccctcccgccgctccacccagcaccggagggtgggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcgccagcaccccttcgacttctctgacctcatctcctttctctatagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaa

SEQ ID NO: 2404 - DNA, 5185 bp, Homo sapiens; identical to SEQ ID NO: 2403
  source 1..5185: mol_type = genomic DNA

SEQ ID NO: 2405 - DNA, 70776 bp, Homo sapiens
  source 1..70776: mol_type = genomic DNA
agtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgaggtgggttggcgactaaggcgcaccggtgggcactgcggggacagcagggccccgcgcgcagggaagccgcccggatcgcccggaaccgggcatcttccgtggcgggtcagccgagagcccgccgggtggtgctgagtagggagtcccgggctcggggctccgcgggccgctttcaggagcagctggccttggcaccgagcgtgcccgcgggaggcgggggggggcgctgctcggtggctctgctgcgtagccggtgaacacttggcaccgatgcccgccttctgggcaaggtgccctgagcccagcccctcgccgggctgcagcccaccctcggcgcgctcagcccgcttcaccgcttcagggacggaatagaactcgcagatgcagggtgtcgctgacattttcaactttttctgcggtttccgcccgctgtctctgacccgaaagtgcccccggacggttacagaggacacttaagtggtttgcaaagcctgtggtaggggaggagggtgtagaagggccaaaccacggaacttagttttattcatttatataaagcagcactccgattctttttgcgcggcctgaaatgcatgtgaccagagaagtaattaacaaaacaatgtcaacttctaaaaccgagacattacttagatgataaggcgcagcaactcggtgaatctgtacaaaccttggaaaaaaaacacattagtctatgggaccttccagttttctcatgctcctttccagctactaacctctcctaaagggaacaaccactttttggatttgattcccaggcctcgctttcaccgggaaattatcgttgcttgtaaaacagaagaagccgggaaggcaggcagggggagctgctactttacactctgtgctttgggatagcaaaatcccgcatttaagcaatccgaggaaacgagcaaatagacctccctcgcctctccgagcacactcaacagttccggttgcaaaatgtttgcctcctgggcttcccagcgtcccgttagttgttctatttacacataattagatacttaatggagagagaaactagaagttgaggcgttcctccaggctgtattgtaaagtatgaagtgaaatccaaaatgaaatggtaatgttagaaagcaacctcattaaaaaaaaaaaaagtaacactggtcttgaagatctttcaatgtgagtacataaagatctatctcatttcttttgacagcccatagtatttcataaactagatgtaaccatttcctattgacaggaaattagcttgtttccaatttttcaatcccattcattcatccaacaagtatctgttgagcacccactatgttccagacagtgatctagctactgatgacacaagagtgaatgacgaagttctcactcatgaaattttcaccttagttgggagaaacatgatgcaatgaaaatcttcatacatacattgtgtgtacatatgggagtatttctgtaggatagatttctagtgatgaaactgctgagtaaaagggagaattatgcatattttaagttttgatttttccaaattccaggtattccatatatactccaaaatagttgtgccattttactctcccatcatcagtctatcagaggggatgctttcccacaatctcttgaatgctgaatattttcaacttttttacttaagagaaaaaagagcatctaattgttccctcagtatcagtgagtctaagcatcttgtatatgtttatttgccatttatatttttttctgtgattttcctgtccagatacttgatactttctattgagctgcttatttatttcttatgggagatttttatatattttagataatattctctctctcacacacacacacacacacacacacacacacacacacacacacacacacatacagtcttacagccacatccctgaaatcttgaccttgtgaacatgttttactggcagcactctggactcgatcattgccttgagactatttcttttttgatattctttggaaagactaacaatgacagttttattttcaaacccaacaaatcctggcatggaaatgtttgctcttgattctgcttttaaaaaaataaagaattattttctctctttctttctgcaccttatcagaaacagctaaaagaagtgagttgggccaggcactgtggctcacacctgtaatcccagcactttgggaggcccaggcaggtggatcacttaaggtcaggagtacaagacctgcctggccaacatgctgaaactccgtctctactaaaaatacaaaattagccgggtgttgtggcgcgtgcctgtaatcccagctactctggagactgaggtgggagaatcgcttgaacccaggaggaggaggtagcactgaaccaagatccagcctggccaagagagtaagactccgtctcaaaaccaaaccaaaccaaaccaaaaaaagaagtgagttggcactttcaacattctgcctggaaatctccttaccaaacctataagatcattaggtatattttctgcactttgtattgtgacaggtgacagtgttaccaaactttttaccaggacataatagggtctgcctttcttctagttgctaacaatttcccccaagtccatcttgcctgcactaacagtctcctttagacctctcctctcctgcctgtcacacattcctagtactaatgctacagtatagtagtaagggtctccagagaaacaacatttatataacataatataaatacattaatagagagaaagagattttaagaaattggcttatatcattgtgaagtcgggcaagccccaaatctgctggacaggccagcagcctggagacccagggaagagttgatgttgcagctggagtccaaaggcagtctctggcagaattctcttttacttctgggaccttggtctttctcttaaggccttcaactgattggatgaggcccaccacattatgaagggtaacatgctttacaccgagtctcctgacttaaaatctaaaaaataccttcacatcacaactagatgtgtttgaccaaatatctggataccatgcctgggcgaattgccacttaaaattaatcatcacgtacatgttttaaggttttgttacacaagacctcacttccaagtatcactttctgttttggtcatcagttgctgcataataaacaaccaccctaaaatttagtgacttaaaacaacaatcatttattgtctgccatggttctgtggtttgactgggatcagctgagtggcctgtttcacttggtgtcagctgggggtgtaggcatctgcaacattgtcttggcaggaacatccaagatgtcccacttaacacgatggctcctgggctcagctgggctggtcaggcctcccttcctctctgtgttgccacacggcctctctctatccatgtggcctctccatatggtctctccctggtggaggtgaatttcttcaaggtttctaaactctcaaaagtggagcctggcaagcccactcaaagcttcagatccacaactggcacagcttcccttccacagattctataggttaaaacaatcaccggaccagcccagattcaaaagaaggagaaacaaactccacccctccatggaggaagtagcaaaaataatgtagacagtttttaccctttacatctggatttgttagcttttctgttttcattttcttctggtctttcttttgtccttctcttacacttattttattaccttttatcaattagcttttaagatgataaaaatctaatacatgcctcctggaatgtcttcttgagcctagggacttttgtttaatgatatatcttgaggacctagaatagtgcctgaaatacaatagtcattaaatatttagctgaattaaatgaatggtatataagccagggtattaaaaataacataaacaaagttgtaataaatatacttccccagtgaacgacctaataccattactccccaaaccctcaatttctgtcttgagcatagaaactgttaatttttcctttgtgtagtaggtccttagtatttctttagaggttgtagcactttatcttcctcactgttccttttccttggttgtccttttccaaacatctctcaacaatttctcccaagtccatcttgcctgcactaacagtctcctttagaactcccctctcctgcctgtcacacagtcttagtaatagtgccacagtatagtagtaagggtctccagagaaactcactttctgcaagttttttagtgtgggtaggtgagtattgaagcttgttcttggcgttaccaggttggttctttgagttgaaccaggggcattacatgcggaatattcctgaacagatcacctctggttctgctgtctcaagggccacacacaagagctgccttctgaccaagatgtctctgggcacatgagacctgaaatacacatggccaagactcaacaaagcgtttgctgactgtcagagctgacagcatctcggtactgtgggagggagcccagtgtctggtgatagtcaggacggacccaggtgatgtcaggggtggggtggggcctgcaggagggaatggagagccagcacctaggggaagctgggaatttaggaagatatccagagagtgtaacttcagttccactaatctcacctgggtgaaaaccagccctctccatggatgatggtgattgcaggtactgacgatagctgcagactgctggtggtctaggcaagcatgcagggatgggagcaggcatttctgagagctccccttatccctgccccaagacaaggtgggggccctgtggggaaggactattttattcacttctgcatctccagttgtctaacacattgcttatcacctaacagtctcttaatagaagcttgctatattgagctgccttgagtccacatcatgctggttgaacataagtagaaattgtgggagacttaatcagagaaaatctttcatctgtcttaccttacgttctaatgatcacttctgtgcccacaaggaccatcttttctgattcatgttcatgtcgatttcttttttatttaacttcctcttcaaaatttctggcaggatttcttgggagccaattctccatttttacttccccatgcctcccattttaatgactgtaggattttctcagggtctactcagcaaaacttgttagtacaacatgagcaaaacagcaaatttatgcaaacacttagcaaagacttagctgtctgcctaatgctagggtgagacatgggagattcacaaatgaagaaacacaagcattgatctccaggatcctgcagtgggaggtatgcggaggaccaacctgggaacagagcaacgcaacaccatgtgatctgtaatgaaaaagaggcctgtacacagccaagaggtcactgaggaaggagccattgcttctgtgcagttagtgctgcgctagattctgcagggatgtaagaaatgtacccctatcaaacaagaaagactatgtgaattgctgaatatgtgagtggagtaccagcacaatgccatggagatgcagacgtgccccatgtggtggggcagagtcaggaagcactttaagaaagaaatagcatttcaggtcttcctttaaaggtagaatttcaacaagagggtgctctggagagtgtgtgttaccctgctgagaaaatcctggcggtcaggtaagatgctactgccagggaagattggccaattgattgactaaacccttaaaggtttggggatcttggggaggattctgctggtgagagggtctggacttcctcttggtctgtccacagctggaccttctcagcacacaagagactatgagggtgaccattttgcacaggacagaattccagcatgtttttcccctggagtgatggaatgaccacctgctcaacatcagtgtcctcactgagaccatgagattcagtagagtgctggaaagcttcatgcttacctgtgtcttcttaatgcttagtgttatgattgaaggcttccttcagtcctaccttttgttctggggttctaagaatcttaggtgcaggcgaggcacggtggctcacacctgtaatcccagcattttgggaggctgacgtgggtggatgacgaggtcaggggattgagaccatcctggcaaacatggtgaaaccccgtctctactaaaaatacaaaaattagccgggtgtggttgcgtgcacctgtagtcccagctactcaggaggctgaggcaggagaatcgcttgaacctgggaggcggaggttgcaatgagctgagctcacgccactacactccagcctgggtgacagagcaagactctgtcttaaaaaaaaaaaatctcaggtgcacctgagacagattgaatgtggaaggggaagtgaaacaggccttccaggtgtggggcctgggtgctgctatagttacaaatggggaagtgagactataggtctcagttacctgtggaaggaagggtagagtggagtacttacgcaaattagctaattctgggagcttggggtgctaccagggtatcagggagaatacagccagggaatagaatcttcttgaagcaaaggctgtttggaagcccccagagtggatgaaaaggctcagtgggaaacaacagatatcaggagagggagaagaagatacctatttctataccttttggccttgtgttttgcttcagacactgttcccagcaaggtcagtggaacccactgctcaaaacacacacttgctccttgttctggtgtcataatagctctgcaagcagtggtggtgttcagcctggagaacgttccttttctttttttttttatcacaataaacactcatggcttctctgcttcttcctttcttctttgtcttaggactcttgaaaaacagctgccaaatgtcagtttagatattttggagggaaaaaagttgggaatcaatgtttacaggttgcctgcaatgtgctggaaactacatagttggttctttttaaactttctctgaatcctgtcaggaaagttccagcaatcacatcttagtgggtccggaattcgtgggttcttggtctcactaacttcaagaatgaagctgtggaccctcgtggtgagtgttacagttcttaaaggtggtgtgtccagagtttgttccttctggtgttggacatgttcggagtttcttccttctggtgggctcgtggtctcgctggcttcaggagtgaagctgcagaccttcacggtgagtgttacagctcttaaggcagcgcgtctggagttgttcgttcctcccatctggagttgttcgttcctcctggtgggttcatggtctcactgtgctcaggagttaagctgcagactttcgtggtgagtgttacagctcataaaagcactgtggacccaaagagtgagcagcagcaagatttattgcaaagagcaaaagaacaaagcttccccagtgtagaagtgtagaacgggacgccaatgggttgccagtgttggctccccccagcctgcttttattcccttatctggccccacccacatcctgctgattggttcattttacagagggctgattggtctgttttacagagagctgattggtccgttttgacagggtgctgattggtgcatttacaaaccttgagctagacacaaagtgctgattggtgtgtttacaaaccttgagctagacatagagtgctgattggtgtatttacaatcccttagctagacataaagattctctaagtccctagtagattagctagacacagagcactgattggtgcatttacaaaccttgagctagacacagggtgctgattggtccgtttacaaaccttgagccagacacagagtgctgattggtgtatttacaatcccttagctagacataaatgttctccaagtccccactagactcagaagcccagctggcttcacctagccgattgtgcaccaagtcagcaggcggagctgcctgccagtcacctgctatgcacccgcactcctcagcccttggacggtggatgggacgccagggagcagggcgcggtgctcgtcggggaggctccagcggcacaggagcccacggcagggagggtggggggaggctcaggcatggtgggctacaggtcccaagccctgccccgcggggaggcagctgaggcccagcaagaattggagcgcagcgccagtgggccagcactgctgggggacttggcacaccctccacagctgctggcctgggtgctaagcccttcactgtccggggcctgctgcgctcgccggccgctcagagtgcggcctggggagcccacgcccacctggaactcgcgctggcccacgagcgcctctctctctacacctccgctcaagcagagggagccgactccggcctgggccagcccagagagggtctcccacagtgcagctgtgggctgaagggctcctcaagcacggccagagtgggcgcgcagaggccggggggcactgagagcgagcgagggccaccagcacgttgtctcctctcattagggttggggaaatggaccctgagagagattaagtaatttggtgatattctatagtcactctggctatgtaatttatggagcctagtacagaatgaaaatgtggggctcatttttcaaaaagcaggaaacagcttttcctttcttccagggtctcttcctccacctgccatgctggtgtttggttgctatttaatgttgagccctcttgggcacagggatacttgcagggacagggtgtctgctcatttttctgtagacctcaaaggtgagtcctgaggcttcagggtcactggcctccttttagggagtcacgacgccttgtctttgtacttcaggaatgattacgaatctttgtaggtaaagcggcagaatgccacgtcctctcctggttgccaggacgtgttccttgtggtttaattgccgggtctgccctgcagaccctggctgagcgacagatgaaaggagtactcagacacaggtacgcagtgaaagagcggctaggggactgccgaagagtcagcagtctcaataaactggagctgctcacttttattcagtacagacataatgccgaaagcctggagccaacgcagtctgtgggtaattaacattgttgttccgccgtgcagggagcagtctcgccagaggatgatgaaaggttggtttccggaagtaaacaagcttatttagacaaactcccctacattcccttgtacccactcctcgccctctgcgtcagggtaagagaacagctgccttcagcttattctcccccgaagctttgcagagccttctgacctttcaaaaggtcttcttctttccctatcggttctcccactactctgactgatctcctatatttgatctcaccttaacaatcacttcttagagctgggtcaggaagtatgcagcatgcacctggcactcctagtactgtgcccatgatgggcattgctgattgttcagagcatattggatgagcctggttcagcctcagaatcttccacccagtgcaccatggagatgctaccaattggttggagttgctctgagaggtgacatttccttgtgattctgcattagaaacatgttgtttgtcagccgaaacagggaaacctgacacgttatccgcccccaggaagatcccatcatcattccatgcaccttcagtcctgggagcttactttaaaaaaaagtgactgacatatgagcgcaggtccccaaacagaggggaggcaggatgagaagccagatgaagagagtcaaggtcctggggctgcttagcttggatgaatctgatgggaggtggggtgcatctgagtgttctctgctgatgaagaacagacttgttgcacgggggtaggtgtgtgctgtgtaaacacacatcagaatcaggaccccgaatagtgaataggcaagagtaacagctgaatttgcccagctcatcacaatttaacatcagttttcaaaaaggtaagagcgtggctttcatagcatgcagaatcaacacacatcaaagattgatttactcatttatgaaggaatcagcaaaatgacaaacttagttcagagaatattttgaggctctgagtagatataaaactggttaatgtttctcagggcaataaaaagctataaacgttggggatttcttttttatcagacagaaattatttgcatacttaacagaaaagatctccaagttaccatctaacttcataaggttcgaataaaacttcatagagttattaatgaatggtaaatagaaaagacaaatatatgttttaccagataattaagtaattcttggtaaacctggcaaacagtaccccagtgtgactctgaaaagacatgctgcccatctttttgccttatttccacgttttaggtatttttgtaagatatctattcaataaatatgtattgagctcctatgatgtcccagaaactcttttagatcctggagatatagcagtaaacaaaacagatgaaattcttgctcacatggaacttatattctagtaggggagacagacattgaaacagaaaaatacatagtatggcagatggtggaaagtattaaaaagagtgctgtgtagtgtttacaacttactcatttatgaaggaatcagcaagatgataaactcagttcaaagaacatcttgaggcaccgagtacatttaaaagtggttagtttctcagggcgataaaaagccataaactttggggatttcttttttaggtatggaaacctaaagtaaagaagatgctatggtttgcacatttgtcccctccaaaactcatgtttgaaatgtaatcccagaagtggcaggatgagagattggccctttaggaggtgactgggtcatgagagatctgccctcatgaatggattaatccattcatggattactgattaatacgctaatgggttaatggatcaatgggttatccttggaatgaaatggcaggctttacaaggagaggaaaagggacttgagctagcatgctcaccctcctcaccgtgtgatgccctgtcctgcctcaggactctgcggagttctggtaagcaagaaggctgtcaccagatgtgtcccctaaaccttggactttttggcctccataactttaaggaataaattcatttttaaaataaattacccagcttcaggtattctgctataagcaacagaaaatgactaaaacaggaggctttactggaaggtgtcctcttagcaaagacctaaagaaagagggagagtgaaacatagaaatatctggggagaacatcctaggtaaaaggaacagcatgtgcaaaggccttgaaaagcagcaagccgctctccctctccctctccctctccctctccctctccctctccctctccctctccccctctccctccccctccccctccctctccctctctctccacggtctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagtgtctctgcccggccgccccgtctgagaggtgaggagaccctctgcctggcaaccgccccgtctgagaagtgaggagcccctccgtccggcggccaccccgtctgggaagtgaggagcgtctccgcccggcagccaccccgtccgggagggaggtgggggggggtcagccccccgcccggccagctgccccgtccgggaggtgaggggctcctctgcccggccgcccctactgggaagtgaggagcccctctgcccggccagccgccccgtccgggagggaggtgggggggtcagccccccgcccggccagccgcccagtccgggaggtgaggggcgcctctgcccggccgcccgtactgggaagtgaggagcccctctgcccggccagccaccccgtccgggaggggggagggggggtcagccccctgcccggccagccgccccgtccgggagggaggtggtgggggtcagccccccgcccggccggccgccccgtccgggaggtgaggggcgcctctgcccgtccgcccgtactgggaagtgaggacccctctgcccggccagccgccccgtccgggagggaggtgggggggggtcagccccccgcccggccagccgcccagtccgggagggaggtggggggatcagccccccgcccggccagccgccccgtccgggagggaggtgggggggtcagccccccgcccggccagccgccccgtccgggagggaggtgggggggtcagccccctgcccggccagccgccccgtccgggagggaggtggggggatcagccccccgcctggccagccgccccgtccgggaggtgaggggcgcctctgcccggccgcccctactgggaagtgaggatccctctgcccggccagccgccccgtccgggagggaggtgggagggtcagccccccgcccggccagccgccctatccaggaggtgaggggcgcctctgcccggccgcccctactgggaagtgaggagcccctctgcccggccaggaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaataaaataaaataaaaaaaaggaatgaatcaagaaaaaaaaagaaaagaaaagaaaagcagcaagccagccagtgtgtttggaatgttctcttatggaaaatttcaaagatatgtaaaactagggctaataatacaattaacccctacttacccattacccaacttcaacaactatcaacattctgctgttcttatttcatctatttacccattaaaaaaaaagtgtactttaaagcgaattccagagtttgtataattttgtctgtaaatctttcagtctgtatctctaaatctttcagtctgtaactctaaaaagaacattaaaaaacacaactatcataccatcatcctacctgacacaactgagtaatttttcatatcatccaatatcgatcagaagtttaattttccatgattttctttaaaatgtagttttataattgatttgttctaatcaagatttgcacattgcattaaaaatatatgtatcttaaatttcctttaatttacaaccatttccctcccccatttaagagtgcatattaatttattaaacagactgggcaattcatcttgtagaatttcccaccttctgggtttggccaattacatccttgtggtgttatttaaaatcctcctctattccctttattatctgttgactgacagcttggccaatcagaatcacttgaacgagctgattacaccccctctttctgaaacgttttcttcccttgagtctgtacacactgttggcttccaaatttatatctccaacccagacctctctccagtacttctgcttgctactgtgtttttcataactttctgatttttttagtatccaatgctagaaaatatatccattttgagaaagagacaaagtatgagctcatattgataatttcatttcaaagtaaagggaacaaagtttttatttaacatgttaattttatgcttgtttctcttttacactgaaaatcttagttctcaatgacattaatataattatgtatttacttcccatatatatgttgtatataattgttttatatatacatatgtgcatatatattattgctaatgaaacgtctactgaatgatgtaagttttctctgtgattcttttggtccttgggacacaggacttatcccactagtgatgtgtagtcaaaatactatgtaccagtgtttgataccttaattaaaggatctctctggctgctgcattgagaacagatggtagcaggacaaggacatcagcctggaagccatctggaagctctttagtgattcagataagatttgattttggcttggatggtgatggatgatgttgagaagtgggtggattctggatatgttttgaaagtaggttccatgtgatttgccatgggctaatatatggaatgtgagagaaaaagaagaaacaacaatgcttccaagattttggggcagaggtactgaaaaaatgaatttccatttatcagaaagagaaagactgtggtaaagcaagttgggaaggaaacagcagctcagttttccacattcagtaaccctcccttatctagggtttcactttctgcagtttcacttatccatggccagccacagtctgaaaatattaaatggaatattccagaattaaacaactcgtaagttttaaattgagcactcttctgagtagcgtgatgaaatctcatgatgtcctgctgtcttctgccctggatgtgaatcatccctttgtccagcatatccatgctgcatgttgtacctgcctgttacttgcctaagcaagtggatggctacttgcttagtgtccatctcagttatcagattgaaaaagcagtacatatacatagggtttagtactatctgcagtttcaggcatcactgagggggttggaacataaccctggcagataagggagactactgttttagtggagatgttgaccagaagactggttcatatgaatatgggggtcctggagagaggtctgggctggagatataaatttggaaatcaacagcgtatacagacacaaggaaagaaaacatttcagaaagagggggtataatcagcttgttcaagtgattctgattggccaagtaagatgaagattggaaattgaccaatggatcggtgacttggcaaggtcagtttgggaggagtggtagtgatgaaagcttatgtggaacaaattcaagaaaaaaacagaagagagaggaattagagattgttgtgcacagacaactcttgcaagaggttttgctggccaggagaacagaaatacaagtgaagtagtggctggatgttttccaaaacatgaaacttagttttcataggaaaaaaatggtttttctttttctacttattcaattttgtgcacaatttcattacattatataagtaaaaaccacaagcacgaacatgtttataaataggtaaataaataacaaagtagatagaaacaaaaattctcaggtgtgcaaaagagtagtttattagctgtgtagaagacagaaaacttgcttttatagagggaatgaatagtgttgattagtatagtgagtcagttaaataggtatcagttgaattttttgagacaataagtacatttagaattggctaggcattattcttccattaaaggaaactcttagtaatagattaggtcagaaaaccacaaagacagttttcttgaataagggggtggtgggaaaaaatggatgtaagatgctgagaaaaaacaggaaactcaacaatagatgaaatcaagaattagtttcgtgtgtgtgtgtgtgtgtatttcacagaaaagggctgaaaggggaggaatggttatattcacagatttttgtagttgatcttaatagggaataggagattacctttttttcagcaaaatattaccagcaaatgtctactctggaaatagaggataagaatcttctatttaaagaccaaaaaggtgaaaactgaggtcagaaatttaaagagtaaatgtagcaagatgctaacattcttgttccctctaataactcttcttttttaaaaattataaaagtaaaacatgcccattgaagaatatttggatgaatacaaaaatatagaaaagaatgtaaaatcgcttaagcccccaagtagaattctaaatagcggagaaacccacgatttaaaaaaataaataaggagatccacaaaaggaagatatatacctgcttaagtggacggcctcagcataagtagtcttacagttacaattaattttttttctattatacgatgttttaaaaaattgctaagctcagttgtctactccctgctagaatgtatcaaacatgctgcatccacatagtagacagttattctacatttttggtctttggatgttttgaagcaattagcaaagtttgatttgaagagacattataaatttccgacggcatatttttctctggccatgatccatatttgccttgatattgtccaaatgttcattttatcttatgactatcaagcaaatattataaagttatttgtgaatttggcacttcatagatgaaatattgtgaaattctgaataaaactgcttcattgattatcttggttcctaaaagagatagtttatgagttaaattatctctaacgttgtctaagttggcagtaattaaatctccatgggaattcttaataaaggcaaagaaggactgaaaacaccttgctgaaactgagagagatttaaaaccacaaaaaaaatgtaagatttagttagttgttcacgttttggggtcctgcttttatgtgttaatacttccagataaaattttttcaaaggtagttttgaaccccaggatctgaatatattaatttgtttatctctgaaaactgtatactttgtgtttcccaggtctggctttcttcatttttcctacttgagggaactccttttcttccttcaatatcctcatatcctccttcaatgtttctcagtcaatatctcctctcaatttttccatttaaaaattaaaaattaaattattaacattttaaatacactgaaatgttcatggaatagtagtacaaatacccatttacccaccacatggagttaatagacaataaaaatttgccatatttgttttacatcttttttctagtttttaaagaaataacatgttacaaataaaatcgaaatactctttccgccgattttcttttctcctgtctcagaggcaaatactgctacttgcttctcttgtatctttttagaaatattctctgcatatataagcatatatccatatatttttccacacatagtatctcttccgtgtcttagtttttttcattctacaatgtatcttgatgatcagtgtagctttgtttcattctaataattatatagattccactttacaaatttactatactttggacttgtatctatgaacgtttcgattgttttaaacctttggcaacattacagacaatgctgcaatgaaatccttctgtatgtatacatacgtggatgtgtgtataagatataattctggaagtagaattgctaagttaaagcatatgctacttaattttgaaaaaattgtcgaacttctcttcacaaggcaattatcttcttgaggtaatgagaactcctatttccccatacccatactacccagagtatcttcaaattttctgatttttgctggtctgataagggaacgttacctcagtttaatctttatttgcatttactatgtgtttttgccctgtagagtgaattttacttttctacctaacaatatatttttgtgattttaatgacattacttttgagatttacccatgctaatatataaactctggttctgcaattttaagtgctatatagtatcctattgaatgaccatactactcatttatttattattatctacttgttaattagtctgttatcttttttgtcagtttttgtgggcataaacaatgctaaagcatacatgtctacttgcgcatatgattttttcccagtgtgtttaatagaatgactaaggtagaatgactaaagttctgaggtgtggcaggtatgccatcttcacctttactgggtatgctagtgtgctgcagctgccgtgataaagtactacaagccgggtggcttcaacaatagcattgtactgtctcacagttctggaggctggaagtctaaaatcaaggtgtcagaagggtcggtgccttctgaaggtgtgagagagaatctgcttcgtgccctcttccaagcttctagtaacctcaggtgttccttgtcttgttgatggtgttgtcccagtgtcttcatattgtcttctctctgtttgtgtttgtgtttgtctctatgcccaaatttccccttttcataaggacccagtcgtatgggattagggcttaccctaatgatctcatcttaacttgatcatctgtaaaaccttatttccaaataaggtcattttctgaggtactgggtgttaggatttcaacatcgtttgggggggtaaaattcaatcaataacaacaggtataccagttaagatgtttttggctgcaactaacagaacattcaactgaaaaggtttaaaatatattgtaaattttaaacaaatgttttatagagatgagttctgactgtgttgcccaggctggtctcaaaatcctggcctcaagcaatccttccaccttggcctcccaaagtgctgggattacaggcatgagccacagagcctggccactttaaaatgttgttgacacacataacaagacatccagaagtggggtggtcataggatcggttcagcagcacagtgatggccgaggctctttccttccactcttccatctcccttgagtggctttcagcttcttgtcacaagattgctgcattatgtcctcatatacctggaacagagggcagggagaggggcaagagcacacccccatttcaagtctcttttcatcccaaagtaacatatttcccagcagccctctttcaaccctctctaggcttctccttaaatttcactggccagaattgggccacacggttacccaaaggtataaaagaggcttgagaagtgagaatttgatattttgaatcataataggagacatgctttgccaataggaaagaagggtaaaagaaatcttctggagagtacggaaccaacggcgtctgccacgttgcatatggccaaatggtcaccaaatttgttgtatcactttattttcacaaaattggtgtaaagtcctcattgctattcatcctcgtcatcattcggaattctcaaatttaaaaaatgcccatttccttgttgttttatttttttaattccctgatcattaacataagtaattatctttttatgtgtttatttgtcattcaggtttcttctgtgaaaagcctatttctgtcttttgcttgttcttatgttgaattgtctctacacattcaggattctaatcttctgtcagttatgtggattgcaaataaagtctcccagtctatggcttaactcttgacactatatttatcacgtcccttatttactaaagatttaaatatgatcaaatttatgttttcttttagggttgtgccttttgtatcttatttaagaactgatttctttaatgtgagatcacaaaagggttataaatattctaaaaatgttaaacttttgcttttcatagttagatctttgatccacttggaatttatctttgtgtgtggtgaaattaggaagcccatttcatttttccccagatggatagtcagttgtgtaagtgctgtttatcaaataatccatcctttatcgagggttttctgatgccacttctgttgcatcttgtgtttctttatgtatgtcagtttatttctggactctccaatctgttttatggtctgtttgtcgctataccactgccacgttgtttaaattactaatgctttgatatccaatagaacatgtctgctttctgttacgggagataaatttacatttttaagaagtttatataaatggaatacatatcatttactcttttgtgtctgagttgtatgtctttgtcatgatgtttttgtgattcatccatgttgtatgtattaatagcttgttcctttttattattgggtctattgtgtgtatatatcacaatttgtttatttatctattgatagacatttggcttgtagtcactttttggatacaatgaatagaggttctatgaacattagtgtacaagttattgtatggacatactgacagagcaggagcacagtcctcttggacaaacactgccactttaagttccagctccatttttagcctcatgcatctcagggaaatcacttctcttctaactacaagtagccagaaagagcaaacagtaaaccacagataaaacagctcaggcacagagggaggagggagaaaagtctcttgggtaactgccacacttcaccctcatacagtgggccccagtaaaacagtgggcgttaataaacacattattttcccttcaggtgcactaaaatagggaagctaaaagcagactcggggggtatgcctgcagctgcagaaaaatgtataaaaacagacacacaactctccctccaaaataagcacaacaaaaaacacaaaagcagtccaagcctctaataaactctcctatcctaaatccttaaaaactcttagtctgtaagagagtgtgctgttgacctagctcagccaaaagctcctcacaggttcgttttctctaaaataaacctgtcttaactggcaagccacctttcgtgttttttttcctctttctttaattcttacacatactgttttatttctcttgagtgaacacccagaaatagaatagcagagccatatggtacataagttgattagctttttgagaaaccaccaaactgttttataaggcaattgtatagttttacatgtgtagcatcagtgtgtgaatattctagttgttctacgtccttgttaacatttggtattgtcagacttttaaattttagccatctaaaaatttatagtgttattttatggtggttatagtttgcatttcccccatgactaatgatgctgaggatcatctcataggctttttgaagtatgtgttcaaatcttttgcccatctttaaaaattagggtttttgttttgtacaaatacttggaaattaagcaacatactccagaatgaccaatgggtcaatgaagaaattaagaaaaataaaaaaacttactgaaaatgatgaaaacatgtctaacaaataaaaattgatacacaacataccaaaatctatggaatacagtaaaagcagtactaggaggaaagttcatagtaatgattgcctacgtcaaaaaagtagaaagatttaaaacaacttaacagtgaacctcaggaaactataaaagcaaaacaacaacaacaaaacccccaaactccaaattagtagaaggaagtaaataataaagatcagaacagaaataaatgaaataggttggaaaagtaatacaaaagatcaacaaaatgaaaagttgttttttaaaaaaaattgactaagcattacctagactaactaagaaaaaagagggaagaaccaaataaatgaaaaaggagatgttacaattgataccacaaaaatataaaggatcgtaagagactattatgaacaccaataaattggaaagcccagaggagatggataaatttctgggcacctacaacctaccaagattgaaccaggatgagatacaaaatccgaatagaccaataacaattattgaggaacctcaataataatttttattaaacaacaataaaaagtttcccaattaaaaaaaaaagctcaggactggatggctttactgctggattctaccaaactttgaaaaataactaccaattcttctcaaactattccaaaaaattgaagggaagagaattcttccaaactcattctataaggccagaattaacctgatacaaaaccagacaaggatacaacaacaaaaaaagaattttgcaggccagtatccctgatgaacataaatggaaagttcctcaacaaaatactagcaaactgaatccaacagcacattaataagtttatttactaaaaccaggtgggattcattccagggatgcaagagtggttcaacatatgcaaatcaacaaacataatacatcccatcaacggaatgaaggacaaaaatcatatgatcaccacaatagatgcagaaaaacagttgataaaattcaacatccctccatgataaaaactctcaaacaattaggtttagaagaaggaacacacttcatcttaataaaggccatatatgacaaatccacagctaatattgtaccaaacagggaaatgttggaagttttttctctaaaaactggaacaagataaggatgcttaccctcactactctgattccacatagtactggaagttctagccagagcaattaggcaacagaaagaaataaaagacatccaaatttggaaggaataagtcaaattgaccatgtttgcagatgacatcctcttacctacagaaaaatctaaagactccaccaaaaaactcttagaattgatatacaaattcagtaaagttgtgagatacaaaatcaacatacaaaaatcagtagcatttctatacaccaataataaactatctgtaaaaggaaccccacttacaatagctaccccccaaaaaaaacctccacctaggagtaaatttaaccaaagaggtgaaagatctctagaataaagactacagaacactaataaaagaaattgaagaggacataaaaaattggatagatatcccatgttcatggattggaaaaattaatattgttaagattccatactacccaaaggaatctacagattcagtgcaatctctatcgaattttcaatggcatttttcacagaaatggaaaaaaagattcttaaatttgttaggaaccataaaagaccccaaatagccaaagcaattgtttgttttattttattttattttattttattttattttattttattttattttattttattttatttcacttcatttcattttatttttgagacagtctccctctgtcacacaggttggagtgcagttgcatgatctcagctcactgcaatctctccctcctgggttcaagcaattctcctgcttcagccacctcagtagctagaattacagacatgcactaccatgccctatttttagtagagatagggtttcaccatgttggccaggctggtctcaaactcctgacctcaagtgatccacctgcctcagcctcccaaagtgctggtattacaggcatgagcctctgctcctagccaagccaaagcaattctgagcaaaaagaactggagggatcacactactttactttaaaatataatactatagtaaaacagcattgtattggcattaaagcaacacataaatcaatggaacagaatagagaacccagaaataaattcacatatttatggcctattgattttctgcaacagcactaagaacataaactgaagaaaggacacctttttcaataaatattgctggggaaactggatattcatatgcagaagaatgaaactagagccccatctatcataatataaaaaagtaactcaaaacgaatcaaagacttaagtgtaagaccccaaattatgaaactactaagagaaaacataaggaaaatgttctgagcaaagattttatggataagacctccaaaacacagtcaacaaaggcaaaaatagactaatgggattacatcaaactaaacatttctgtgcagcaaagtaaacaatcaacagagtcatgtgacaaactacagaatgggataaaatatttgcaaacggtttctctgacaaggaattaatatctagaatatacaaggaacttaacagcaaaaagccaaataatctgatttttaaaatcggcaattgatctgaacagacgtttctcaaaagaagacataaaatggccactaagtatttgaaacagtgctctatgtgactaatgattagggaaatgcaaatcaaaatcacagtgagatattatctcacgccagctagaatggctatcatcaaaaagaagaaaaaataacaaagctagcaagaatgcagataaaaggaaacttaaaacatttcagcttttactttagattcaggggttacatgtgcaggtgtattgcatgatgttgaggtttcagaatatgattgaacccatctcccaggtggtgagcatagtacccaatatgtggttttgcaacccttccttcctccttccctccctcctcttatactccccagtgcctagcattcctatttttatgtccatgcgtacccaatgtttagctcccacttataagtgagaaatgtagtatttggttttctgtttctgcgttaacttgtttaggataatggcctccagctgcattcatgttgctgcaaaatacatgatttcattcttctttttgtggctgcatggtattccatggtgtatacataccaccacattttctttatccaatctgccattattgggcatctaggttgattccatgtctttgctactgtgaatagtgctgtaatgaacatataagtgcatgtcttttttttggtagaacaatttattttcctgtgggccatatacccagtagtgggatttctgggttgaatggtaattcagtttttattaatagttctttaagaaatctccaaagtgatattcacagcggttgaactaatttacattcccaccaacagtgtataagcgacaaagaaaattctcacacattgttggtaggaatgtaaattagtacagctattatggaaagcagtgtggaagttccttaacaggctaaaaatagaactaccatatgatccagtaatctcgctactggacctatatccaaagaaaataaaatcatatgtcgaagagatacctgcactcccatctttactgtagtttcatttataataatgaagatatggaatccaccgaagtgtctatcaacagatgaagagataaagaaaatgtgggatatatagacaatggaatgcagccataaaagagaatgaaatcctatcattggtggcaacatggatgagcctggaggacattatgttaagtgatataagccaggcacagaaagacaagtttcatatattctcacttacatgtgggagctaaaaaagttgatctcagagaagtagagagtagaatagtggttactagaagctgagaagggtagggagacagagattgatcaatgaatacaaaattatatatatggatagaggaaataagttttagttttagtgttctatagcattgtagggtgactatagtgaacaataacttattgtatattttcaagtactgagaggagaaaattttgtacattaccagcacaaagaaatgataaacctttgagataatggatatgccaattacacagattcgatcattatgcattgtatgcacgtattgaaatgtcacttcaccccataaatatgtgcaattacatgtcatttaaaagtgataagaaaaattagtttttttgatcttattattgactcgtaggaagcttatatattctgaaaagaagtccattttcagatgtgtactaaaaatattttctttcattttatgacttacctttccattttctttaatggaaacttttaaaaacttttaaaaaacaaagttttaaaaaaatctagttaaggtccagtttgttaacttttttctaatatggcttgtgacgcttattccttctgcctagaatgttcctgggatgtttgtggagctaagtcctcgcttccttcaattctttactcaaatatgtccaccctatttaatgtcaactgtccaccgtatttaatgccaccctatttaatatcactaacacctcctcccccctcactcttgacattcattctagtctattttacatttttttctcatagaactcataaatttctagcatgctttataacttacatattcattatgtttattgtttattgtccgtctttgttccagtaaaatgtaaactcctagaagaacagagacctgtgttttgttcactgatgtaccctaagtgctcacaagtgtttctagcacctagtatttgctcaataaatatttgctaggttgatgaattaatgatttctaagctttccttcagcctgaagagttttctgattgtaagattctacttagataatcctaattgtctcagtgactctcaccagtcactcacttctcccacaaggtggcagtctttaccttcaacacaggttctggtagcctcaaatttgagaattaatagctgagttaacctgcttgttttctttgagcccagacagcctgccctatgggaactgacagctgtaaaatttaaaggacgagtgtaattaccctgcaagatctgagtgcttttaggcaagaggatttagggggtgagagttttcctggagagggacacattatgaaggtgatattgcttaattgatggggactttgaaacatagttgctctttgtgagaatggtataggtttagagagaggtgctagcacagagctgtgacacctgaagtaggctgaccgcagacaaattggatttaaccaccaaatatatctgtgttttcatgtcttcctgccccgtgccctcttatctgactcactttaccccagcactggggaataactgtgccctattctggtcctgacccttttgtaccatctagggaaatgagaactcctcttggggtctcagatcctcatttctgttagaaccaatcctattctgtgggtagggccatggttgtaaatttcctgtgggaggcagcattgctttgcaaaaagaacacagtttggcatgtgaggcagctctgccacttggacaaggtgataacgctttagtctctttatttctaaaacagggaagatgctaataccccgcccatggactagtatgagatttaaatggcaggtacttggcacagtggcaggtggtgaatgctctttggtgatcatgactatccctttctcctggtagtgctgcctcctccctctgagcacctggagtcaatccaccttgggtaggtcagagaaggcagaagaaagtggtgggaggtgaactcgacggaatgatgtacagggcgatagggtgagtgagaggtctgggatctattggcaggagcagaatggtaggaaagggaaaacatgccattgaccttgaatcttgacatttgtgcccatcctatgctgtgttgagcctcaggtcaccgtttgcggaggtgagcagaaaactgctaacagatcgaggcttctccagccttctaggtaaactttcatcagtgggttagttgtcttgttcagaagctgatcacggagctttggccaagcataaacactgattatggcagtccaattgtcataatccctttgattctttaatatcaccttcaagattgtttgttattgtcaatgcccccacaacctaagaccaccaggaacacactgtaattgaaaaaggtgggtttgttgctctctgcaagaagggaggacactcagcgtagagactcatgagggtggggcaggttttatccgatgacgttagaaaggacttactgaggatttgggcttgttttaggagatttgggggaaaggttcaaggagactggcttttcctggatgctgccaggaagtagtgggatggtagtaagtctgtggtaggatgtttaaataaatttcctctactgggctggaagaatgagaaggctgaagctgtaataagtaaagaagtggcagtcactcctatcagctatgataaaaggatgtttggctattactttatggtttggatgctatttttgcttgtgttcacatcatggtctatcatggtgataggccacgtacacagtggccttgtctgatgctggtgtcccatggagttgattatgctcagctgaaggacactaaggcccaactgtgggggccaggccagctcctgagtgtcagggggggctgcactgctttgtcattatcaacatctccacatacaatacagcctgtgcatgtgaggtcccagaaggaaggagctaaagcagctagactgggatcactttactcaatttgaggagaggagtgctcttgagggaaccagaggaaggcagatgagctggtctgatctccttttctattggagctctatgcagatagactgaaaatatttgctaaaacaaagagctccatctctagaatacccttagcaggatgtccttgattaaaggattatttctgaaaactaaatccagaatccgtgaggcatgattccctggaagatcatgtaagctgtacaattctctatggaataaattggagacttcatcccttagatccctttgactgtgtgaggaaccccacgaaacctcacttagtgactttattcattcttctgggcctgaaagcatatgtctcatgcaggaaggaaggcaggaccagtggggctttgcaggttgtgccattctctccttgctttgcttgagactctttattacctgtctccctgacattatttgtagtgtgattctgggtgtgttctgtgattcttgtgactaggtatccaattttgcttaaggatgcaaggaagtgtttggggagaaagctctattggaagaggtctgtagtcctagcctccctccccaccccacatttcacatcattagacctcagcacatgggtctggggcaccaacactgtcttacctgttacacagtgtggtctttatctggatgagggatgcgaaaggatacattgtgaccaagagacctgggagaggcacaaaaataacaggtgaccaccaagggtgcttggacctgagatgtttccatttcctaagaccctccaagattctccaacatttggtatagttgcccaggcaatttaacaagaaaatcaaatttttgttatgacccccattgtaatttatgcttatcgcagaaaaattgagactataagaaggagaatagaaggtcacaaaaccactctatactagtccagggatagctattcttacaacatggattgatcagtgtggggtgatttctcctagtgttttttggacagagaagcattgaagatgccctggttttaaggtcttaggatgaaggaattatagttgaacagttcaaaatgatgttatgaattactttcagatttgtttgcttgattgcattagccttgcctggccctacggtaactatttggttccatcatggtggctgagtaggtggctctggaaaaagagctattcaagaaaagcttttctttctctaaaaatattgtagggggctcgccctctgttcttggaagcaacgtttgggatggcctcttgggaggctgtctggtgaagtgtctaggggtatgtggtctggacttggacaggacaagatgcaaattctggctgggatattctagttgtggagtgttgggcaagttacttggtcttctgagtttataggtaaactggagataataggtatgtgtgaatgaggatccaatgagatgcctgtaaaacacttagccagatggctgcgtgaagaaagcacttggtaaatgctaattgttgtggttgttataattagtacaatgattagtcattgctgattgttggctaactggcggtaagaaatgaaagtaaagtaaggcagtagcagctgagggaggtggtggagggaatcaggagacacttggaggttctggttctgcctgagtttaagtgctggggaaaactagttgaataactgctggtctaacatttaacagctgtgtgacctcgggctagtcacatttcctttataaacttcctttttctcatttgcgaaatgaaggggtttcgttaggttacttctcatcacccctggttgaccattagaatcgtttgggagacctttttagaaattcttggttctggggtcttccattttccccattctcacttggtgggtctgaaagcaggcactgcagcttttccaaagctcttcaggtgaccttgaagtgtggccagggctgagaacctctgacttccaacagcacttctggtttaggaaggagcaaatcaccggcacagaatgagctctcaggaacggctgctgagctagtaattgccgtgacactgtctccctgtcccaactgcaggcacccctagacgtctcctgatgaagacttccaattttggaacagaagaatctttgaaaaaaatattattgaacttccagaaatgattcattccttctctgctccttctttagttggaaagatctgcccccatccctgtctactgcagtcccaatccctttttatttcaacatatatatccaaaccaacaaaaaaattgactcgcacaaccaaggtgaggtgtttggctttaaggataaaataaatagtttcataaaacctgcccccagatttctcattgcctctactcattttctctaatttgtagggcacactgaaagctcggattcataagatgtagaaagggcagagagttaagttacaaactcttcctaggtctgtttcaactctaacgttctatagctctgctccgtctaaacaaggaattctgttaaatttgtaacctggactttcttgaatactgaggtaatgtttcttgaagtaggatatatatacccaagaagaataaaaataattctggaggtgtcttaattctctgtgggactcaataaaagttttggtgattatatataaacacacttatgaaagcatctggtacatgtaggtgctcagtgcacatgaatttctctttcctgccagatcttttgtagtggaaaattatcttattcttccatctttgtctgcaaagatgctgctaaggaaagatgtagaagagttttacaagggagttggagtatgggaacaggaagttcccaagaaggccactgcattaatagaattgaaacaagatcccctaaaggaaaatcgctgccaaatctcttttctctaaactatccaaaatggtgccccataaattttcattgacattgaagtacataatgtaataagcttttttttccttaaatatataatgtacggagaaaaccaggttgataatggtttcctggcatagctttcaaaggcaagtgtggatgaagtggaaatatggtgcacagatattggaaagaaaccgctgttgaactcttcacattttcatgtataacccaatgattctcaaacctaaacttgcatcagaattgcctggagggcttattaaaacatgattgttggatgccacccttgcattaattaattacacctgcaactgttctatttttaaatggtcacattttaaggtactgggctgaggacttcattatgtgagtttcaaatgggacataattcaacccctagcccaatcctagtgagtggtgagtggtatctcttcgttttgatttctacttccctagtgactaatgatgttgagcatttttatgtgtgtttattagccatttttatatctcttatgaaaaaatgtgtataaaattattggcccatttgttaattgggttatccatttattattgaattataagagctctttactactctggatgcaagtcctgaaacagaaataatatttacaaatattttaatccattctgtgaattttattttcactttcttgatggcgtcctttgaagaacgtaggattttaattttgataaagtgtaatttatgtattttttcttttgttgctgtgcttttggtatcatatttaagaaataattgcctaatccaaggttatgacaattttttattctatgtttgcctctaagaattttctaattttaccttttatatttaggtctttcattcattttgagtcaatttttgtatatggtgtaaagtatgggtcctaatttattcttttgcatgtggatatcttgttgtccctgcaccatttgttgaaaagtgttgttttttttttcccattgaatggccttggcactcttgtctaaaattaattgatggtaactgtaagactttatttctggactctttattccattgatctatatttctatcattgttactgagcaatgtgcttgctgcctgacagatagggaagccaatattatggaactggtttttgagaaaagcaaaagctttatcgtgaggttgacttgcaaggaaacaggatgcaaagctcaaatctgtctccccttctgggatctgggacaagttttatgggttagggagggcaagctggtatgcagaagcactggtagggcaggtttcaactggaagtactttaaacaagaccatttatggtaaggtatggtaagggtcttaacactggacatgcctgggctcaggtttcttgcttttaaaaatgtttgggccctcaggttccagtcatgtcttgaccattttcttctgtggtggggcaggagaggaatttttcttctgggtgttattcaaggttgaggtcttcttttctgcattgcttcggctgcatgacttaacaactttttgactttgtgcctgttaaataacttgacatactattatcatcagagtagggccagttagaactggtcctgtgattacatcattatgccagtaccaattatcttgattactgtagcattgtagtaagttttgaaatcaggaagtttgtgtctttcaactttggtcttctttttcaggatttttggctcttctgtgttccttacatttccatatgaattttaagttaaactgtcactatctgcaaaagaaggaactgggatttttatagagattacattgaagctgtaaatcagcttggagaatactgtcatcttaacaatattaagtcttctggccgggcacggtggctcacgcctgtaatcccagcactttgggaggccgaggcgggtggatcacgagctcagaagttcgagaccagcctggccaacctggtaaaaccccgtctctactaaaaataataataataaaaaactgggcatggtggcatgtgcctgtaatcccagctactcaggaggctgaggcaggagaatcatttgaaccctggaggcagaggttgcagtgagccgagatcgcaccattgcactctagcctgggcaacagggcgagattctgtctcaaaaaaacaaaaacaaaaacaatattaagtctcctgatccatgaatgtagaatgtttttccatttgttcaggtcttctttactttgtaacagtgttgtgtatttttcaatgttccagtcctgtaattctttgttatatttactcctaagaatattaattgttttgctgctattataagtggaattgtttaaattttgattttatatttttcattgatagtatatttttcattgatagtatacaattgatttttgtacactgattttgtaacctgaaaccttgctgaccatgtttactcgttctaacagtttcctttttgtggatttcttataattttctatatacagtatttcatgtcatccatgaaggggataggtttacttcttcttatctaatctggatgagtttagtttatttttcttacctaaattccttggctagaactccaatacaatgttgaatataagtaatgaaatcagacatctttggactgtacttgattttaagggggagcatccagtcttttgccattatgtataatgttagctgtggggtttaatagatgaattttatcaggttgaggaaattttatttctaatctgctcagtgtttttttcatcacaagagtgttggattttgttaatatttttgtgtgtctattgagatgatcatatggtttttgtcattctacaaaatacagcacattaaattgatggatttttacatgttaatttttttttaaattttactttaagttctgggacacatgtgcagaacgtgcaggtttgttacataggtatacatgtgccatggtggtttgctgcacctatcaacctatcatctaggttttaagccctacatgcattaggtatttgtcctaatactctccctccccttgctccccacccccgccgacaggccccggtgtgtgttgttcccctccctgtgtccatgtgttctcactgttcaactctcacttatgagtgagaagacgtggtgtctggttttctgttcctgtgttttttagctgagaatgatggcttccagcttcatccatgtccctgcaaaggacataaactcattcttttttatgactgcatagtattccatggtgtatatgtgccacattttctttattcagtccatcatttatgggcatttgggttggctctaagtctttgctattgtaaatagtgctccaataaacatatgtgtggatgtgtctttatagtacaatgatttatactcctttgggtatatacccagtaatgggattgctgggtcaaatgatatttctggatctagatccttgaggaatcgccacactatcttccacagtggttgaactaattcacactcccaccaacagtgtaaaagcattcctatttctccacagcctcaccagcatctgttgtttcctgactttttaatgatcgtcattctaactggcgtgagatggtatccattgcgattttgatttgcatttctctaatgaccagtgatgataagctttttttcatatgtttgctgggcacataaatgtcttcttttgagaagcatctgttaatacccttcgcccactttttgatggggttgtttttttcttgtaaatttgtttaagttgtagacttaggatattagatctttgtcaggtggatagattgcaaaaaatttctcccattctgtaggttgcctgttcactctgatggtagtttcttttggtgtgcagtatctctttagtttaattagatcccatttgtcaattttggcttttgttgccattgcttttggtgttttagtcatgaagtctttgcccatgcctatgtcctgaatggtattgcctagattttcgtctagggtttttatggttttaggttttacatttaagtgtttaatccatcttgagttaatttttgtataaggtgtaaagaaggggtccagtttttgttttctgtatatggctagccagttttcccagcactattaattaaataggtaatcctttctccattgcttgcttttgtcaggtttgttgaagatcaggtggttgtagacatgtggtattatttctgaggtctctgttctgtttttgttttttgttttttgttttttgttttttttttttgagatgagatctcgctctgttacccaggctggagtgcagtggcacgatctcggctcactgcaacctccgcctccctggttcaagcaattctcctacctcagcctcctgagtagctgggattacaggcatgtatcaccgcgcctggctaatttttgtatttttagtagagatggggtttcaccatgttggtcaggcttgtctcgaacttatcacctcatgatctgcctgcctcagcctcccaaagtgctgggattacaggcgtgagccaccgtgcccggccaaggtctccgttctctttcattggtctatatatctgttttggtactagtactgtagttactgtagccttgtagtacactttgtagtcaggtaacgtgatgcctccaacttcgttctttttgcttaggattgtcttggctatacgggctcttttttggttccatatgaaatttaaagtagtttttttctaattctatgaagaaagtcaatggtatcttgatgggaatagcattgaatctatcaattactttgggcaatatggccattttcacaatatttattcttcctatctatgagcatggaattttttctatttgtttgtgtcctttatttccttgagcagtggtttgtagttctccttgaagaggtccttatgtctcttgtaagttgtattcctaggtattttattctctttgtagcaattttgaatgggagttcactcgtgatttggctctctgcttgtctattattggtatataggaatgcttgtgatttttgcacactgattttatatcctgagactttgctgaagttgcttatcagcttaaggaggttttgggctgagacgttggggttttctaaatatacaatcatgtcatctgcacacagagacaatttgactttctctcttcctatatgagtacactttatttatttcttatgtctgattgccctggccagaacttccaatactatgttgaacaggagtggtgagagaggacatccttgtctcgtgccacttttcgataggaatgcttccagcttttgcccatttagtatgatatgggctatgggtttttcagaaatagctcttattattttgagatatgttccatcgatacctagtttattgagagtttttagcatgaagggatgttgaattttattgaaggacttttctgcatctattgagataatcatgtgatttttttcattggttctgattatgtgatggattatgtttattgatttgtgtatgttgaaccagccttgcatcccagagatgaagccaacttgatcgtggtggataagctttttgatgtgctgctggattcagtttgccagtattttagtgaggatttttgcatcgatgttcatcagggatattggactgaaattttctttttttattgtgtctctgccaggtttcggtattaggatgatattggcctcataaaatgacttatggaggagtccctctttttctattgtttgcaatagtgtcagaaggaatggtaccagctcctctttgtacccctggtagactgcatgttagacgagataatatgtatgaactacctggcatataatagatgcttcctaaataagattctaaaaaataattatgctccaaaaatatttttaaaatcaaataatttatgttttattttctgtgttttatctcagacatgtagactgccaaagtgtatgggatgctttcaagggtgcatttatttcaaaacatccttgcaacattactgaagaagactatcagccactaatgaagttgggaactcagaccgtaccttgcaacaaggtaattgggggcatgccattgattttaaaactggggataaaagccaatggtaacaattcataggtccaaatttttattagaatgaaggaagaggaaaaatccagacattatagtgtgagtgtggttggtaggaatggaatttgcaggccattgaggggccatgatataattaagatttaggacatctggagaagggagctaagagagagaaatagggatacagagataggaaaggggctttggccaaaaactaggcagaaaaaacctaacaccaaacccaactcgaacaaacaaattaacacgacctatataataacaaaactttcccctgacctatgataataatagtagtagtagtagtaataacagcaatgccaagttacacttgcagactgcttcttctttttcttgcttacaaaagactctcctaatccttactttcttaggccttcatagccattctctggaatgggcacatcaggtgtcagcatcccaatttcaccagtgagaaaactgagggttggtgtgtttaggtgaccagtgttgcccaagtttgacaggcttcaaagtgaccagtttaaatgtaaatggtatgagacctggagccacagaggcctggattctaatacattggttatattggaaaagctctatcagagtgcaccttttctatagccaatgtttaaggcaaaattccatgtgcctaaaattttctttgtgaagcccttaaatccatccagaaattacagcctctcattccattgttagtgagctggagtcattgtgaaacttctccattcactaggcgtgatgccctatgcagagaaggtgtttggcaaataataacccaggctgacatttgtcaaataagtgactatgcgatggatagtatgctaagcaatttacttgcatttatctcagttaatttccctagcaccccattagtttatttcagtcattatcattaccattttacaggtgtagaaagtggggcttagtgatgttttggttgctcaaggtgaaacacctgataagtgatgatgatgctgggcttcaataagggctgggattttagggcccatactttaaaccagtatccttcactgactcccattaagaatgaatagggggaggagccaagatggctgaataggaacagctccagtctgcagctcccagtgagaccaacgcagaaggtgggtgatttctgcatttccatctgagatcaggtttcctcgtgtgtctacaccaccagggccctgggtttcaggcacaaaaccgagccgctgtttgggcagacaccaagctaggtgcaggagtttttttcgtaccccagtggcgcctgaaaccccagtgagacagaactgttcactcccctggaaagggggctgaagccagggagccaagtggtctcgctcagcgggtctcactcccacggagaccagcaagctaagaaccactggcttgaaattcttgctgccagcacagcagtctgaagttgacctgggatgatggagctgggtggggggaggggcgtccgccattactgaggctttaataggcggttttcccctgacagtgctaagggggctgggaagtctggactgagtgtggcaacgtggttgtggccagactgcttctctagattcctcctcactgggcagggcatctctgaaggaaaggtaacaaccccagtcaggggcttacagacaaaacctccgtctccctgggacagagcacctggcagaaggggcagctgtgggcacagcttcagtggatttaatcattcctgcctgctggctctgaagacagcagctgatcctgacaagagggattctcccagcacagcacaccaactctgctaaaggacggattgcctcctcaagtgagtccctgacccctgtgtctcctgactgagagagaccacccaacaggggtcgatagacacctcatacaggagagctccggctggcatcaggccggtgcccctctggaatgaagcttccagaggaaggagcaggctgtcatctttgctgttctgtagcctccactcgtgataccttcaggtgcgggaggaacccaggtgaatagggtctggagtggaccccctgcacactgcagcagccctatggaagaaagggcctgactgctaaaagaaaaaacagaaagcaacaacatcaatgaaaaagaccccacaaaaacccatccaaaggtcagtagcctcaaagatcaaaggtagataaatgcaagaagatgagaaagaatcagcacaaaaatgctgaaaactcaaaaagccagtgtgcctcttctcctccagatgatcttaacacatctccaacaagggcatagaactgggctgaggcccctaaaaagagatgagttcatgtcctttgcaggcatatggatgaagctggaaaccatcattctcagcaaactatcacaagatcagaaaaccaaacaccacatgttctcactcataagtgggagttgaacagtgagaacacatggacacagggaggggaacatcacacaccagggcctgtcaggggtgggtgctaggggaggataacattaggagaaatacctaacgtaggtgacgggttgatgggtgcagcaaaccaccatggcatgtgtatacctatgtaacaaaactgcacattctgcacatgtaacccagaacttaaagtataaaaaaacaaaagatactagctacatttacccaatgttaaaaaaaaaaaaagaactgggctgaggctgaggtggatgaattgacagaagtaggcttcagaagatgcataataatgaaattcactgagctgaaggagtatattctaacccactgcaaagaagctaagaaccatgataaaacataggagctgttaaccagaataactggtttagagaggaacataaatgacctgatggagctgaaaaacacaacacgagaacttcaagatgtaaacacaagtatcaataaccaaatagaccaaacagaagaaaggatatcagagcttgaagagtatcttgctgaaataagacaggcagacaagattagagaaaaaagaatgaaaaggaacaaacaaaacctctgagaactatgggattacataaaaagaacctatgactgattggggtacctgaaagagacaggaagaatgaaaccacgttggaaaacacacttcaggatatcatccaggagaacttcttcaacctagcaagatgggccaacattcaaattcaggaaatccagagaaccccagtaagatactccatgagaagatcaaccccaagacacataatcatcagattctccaggtcacctataaagggaagccaattagactaacagcagacctctcagcagaaacctacaagccagaagagattgggggccaatattcaacattcttaaagaaaataatttccaaccttgaatttcatatctagccaaactaagttcataaatgaaggagaaataaaatctttttcagacaagcaaatgctaagggaattcgtcaccaccaggcctgccttgcaagagctcctgaaggaagcactaaatatggaaaggaaaaaccattatcagccactacagaaacacaccgaagtacacagaccaatgacactatgaagcaactacgtaaacaaatcttcacaataaccagctagcatcatgataactggatcaaattcacacataacaaattaaccttaagtgtaaatgggctaaatgtcccaactaaaagacatggaatggcaagctggatagtcaagatcaattggtgtgctgtatacaagagacccatctcacatgcaaagacacacataggctcaaaataagggatggaggaatatttaccaagcaaatgggaaacagaaaagagcaggggttgcaatcctagtttatgacaaaacagactttaaaccaacaaagatcaaaaaagaaaaagaagggtattacataaggataaaggggtaaattcaacaagaagagcaaactatcttaaatatatatgtgcccaatacaggaacaccgagattcataaaacaagttcttagagaccttcaaagagatttagatacccacacaataatagtgggagaatttaacatcccactgtcaatattagacagatcatcaagacagaaaattagcaaagatattcacgacctgaactcagctcaggatcaagtggacctgatggatatctactgaagtctccatgccaaagcaacagaatatacattattattggtgccacatggcatctactctaaaattgatcacacaattggaagtaaattactcctcagcaaatgcagaagaactaaaatcataacaaacaatctcacagaccacagcacaatcaaattagaactcaagattaagaaactcactgaaaaccatgcaattacatggaaattgaacaacctgctcctgaatgactcctgggtaaataataaaattaagccagaaattaagaagttctttgaaactaataggaaaaaagagacaatgtatcagaatctctgggatgcaactaaagcagtgttaagagggaaatttatagcactaaatgcccacatcaaaaagctaggaagatatcaaattgacatcctaacatcacaactaaaagaactagagaaccaagagaaaacaaatcccaaagctagcagaagacaagaaataaccaagctcagagcagaactgaaggagatagagacacaaaaatcccttccaaaaaaaaatgaatgcaggaggtggttttttgaaaaaaaattaatagaatagatggatcgctagctagactaataaagaaaatagagaagaatcagatagatacaataaaatgataaaggggatatcaccacagaaatacaaacaaccatcagagaatactataaatacctctatgcaaataaactagaacatctagaagaaatgaataaatttctggatacatacaccctcccaagactgaaccaggaagaagttgagttcctgaacagaccaataacaagttctataattgaggcagtaataaataccaaccaaaaaaaaaaaaaaaaaagcccaggatcagacagatttataactgaattttaccagatttacaaagaggagctgataccctttcttctgaaactgttccaaaaaattgaaaagtaaggactcctccctaactcattttatgagactagcaccatcctgataataaaaactggcagagatttaaaaaaaaaaagaaagaaagaaaacttcaggccaatatcctgaagaacatcgatacaaaaattctcaacaaaatactggcaaactgaatccagcagcacatcaaaaagcttatccaccatgatcaagttggcttcatcctcaggatgcaaggcaggttcaacgtacatgaatcaataaatgtaattcattacataaagagaactaaagacaaaaaccacatgattatctcaatagatgcggaaaaggccttcgataaaattcaccatcccttcacgttaaaaactctcaataagctaggtatcaaaggaacatacctcaaaataataagaaccatttatgacaaacccacaagcaatatcatactgagtgggcaaaagctggaagcattccccttgaaaaccggcacaagacaaggatgtcctctctcaccactcctattcaacatagtattggatgttctgaccgggacaatcaggcaagagaaagaaataaagtcttttcaaatggaaaaaaggaaataaaattgtctttgtttgcagatgacatgatcctataactagaaaaccggatcatctcagccccaaagcttcttaagctgataagcaacttcagcaaagtctcaggatacaaaatcaatgtgcaaaaatcacaagcattcctgtacaccaacaacacgcaagcagagagccaaatcatgaatgaactcccattcacaaagggaataaaatacctaggaatacagcaaacaagggaagtgaaggacctcttcatggatacctataatccactgctcaaggaaatcagaaaggacacaaacaaatagaaaaacattccttcctcatggataggaagaatcaatatcgtgaaaatggccatactgcccaaggtaatttatagattcagtgctattcccattaaactactattgacattcttcatagaattagaagaaactattttaaaattcatatggaaccaaaaaagctcatatagccaagatgatcctaagcaaaaagaacaaagctggaggcatcgtgctacccaactccaaactgcactacaaggctacagatgccaaaatagcatggtacttgtacaaaaataaacacatagaccaatagaacagagtagagatctcagaaataaaactacacatctgcagccatctaatctttggcaaacctgacaaaaacaagcaatggggaaaggaatccacatttaataactggtgcttgagaactacctagccatatgcagacaattgaaactggaccccttccttgcaactcatacaaaaattaagatgaattagagacttaaatgtataacccaaaactataaaaaccttagaagaaaatctaggcaatatcatttgggacacaggcacaggcaaagatttcatgaaattgccaaatgcaattgtaacaaaagcaaaaattgacaaatgggatctaattaaactaaagtgcttctgcacagcagaagaaactatcatcagagtgaacagaaaacctgcagaatgggagaagatttttgcaatctatccctctgacaaaggtctaatatccagaatttacaaagaacttaaacaaatttacaagaaaaaaataaacagccccatcaaaaagtgggcaaagaacatgaacagacacttctcaaaagaagacatccatgtggccaacaaacatatgaaaaaaagctcaacatcactggtcattagagaaatgcaaatcaaaaccacaatctcatgccagtcagaatggcattattaaaaagtcaagaaacagcagatgctggtgagattgtggagagatagaaatgcttttacactgttggtgggaatgtaaattagttcaaccattgtggaagatagtgtggcaattcctcaaagatctagaactagaaataccgtttgacccagcaatcccattactgggtataatagaaatcattctattataaagatatgtgcatgcatatgttcattgcagtgccattcacaatagcaaagacatggaatcaactcaaatgcccatcagtgataggctggataaagaaaatgtggtacgtatacaccatgaaatattatgcagccataaaaaggaacaagatcatgtcctttgtagggacatagatggagccagaagccacatcttcagcaaactaacacaggaacatgcaaatgctgcatgttctcacttataagtgggagctgaacagtgagaacacatggacaccaggaggggaaaaacacacactgtagcttgttggggttggggtgaggggagtgagaacattaggacaaatagctaatgcatacttggcttaatacctaggtgatgggttaataggtgcagcaaacccatggcacatatttacctatgtaacaaacctgcacatcctgcatgtataccctggatatacatgcccaggatatacattttatttaaaataaaaataaaaataatagattcataaaacagaatataattctgaactttgactccctgtacctttaagagggacccttaaatttaaaaatctattgtattttttttttagtaggggtagggaatatttagggaatttggaaggggttatatagttctttaagaatcaaatagcacatcttcctgaaaatagcacgtagacaaagtttttttggagataaccttaggaatatcgtaactctctgatgccacctccatatgtgatcctatgttgattataagattttgatcagtggctttcagacttttttgactgcaacctagaataaaagattcatttacattgtgacctagaacacacacacacacacacactctctctccgccactctcctgcacacagaaatcattgatgcttacaacaattcttactcttactatgggtgatttactttgatatgctctgttttttttttcatttacaaaactgtggattaattttttttgacatgctaaattgatctcagtaatagattgtatttattcttccttagattcttctttggagcagaataaaagatctggcccatcagttcacacaggtccagcgggacatgttcaccctggaggacacgctgctaggctaccttgctgatgacctcacatggtgtggtgaattcaacacttccagtgaggctctgggccctgtgggattgcccagggatgtggagggtgaacagagtgacttctgctggaggccctgaatgattagtgtggaggacagagccacaggcacccatcctgatgccatctatacttatattagtccatttgtgttgctattaaggaatacctgaggctgcgtaatttataaagaaaagaggtttatttgactcacagttacgcaggctgtacaagaagtagggtaccagcatccacttcgggtgaaggcctgaggctgtttccactcatggagaaggggaaggggagctggcatttacagagatcacatggtgagggaggaaagcaaggagaggtcaggggaggtgccaggctgtttgtaatgaccagctgtcctgggaactagtagagtaagaactcattactataaggacagcaccatgccattcgtgcaggatcatccctatgacccaaacacctcctactagtcccgagctccaacactgggggtcgaatttcaacataaggtttggagagttaaatatccaaactatagcactacccttaatggcaactcaggctgatataaagtagcattccctgttttcttgaaaaattgacttcagagttggggattgcccatgctccctaattcccttcttttgagtgctcacatagcctgcttccgaattcttggtattttgctctctgtaaggtcatcattcaggtccaaagaagtctagaacaggatgaggtctcagtgggacctagaccaaggttcttgctcttcagaatcatcacagtagccatggactggactcttccatctcaggcactggctttgccatcatttttcagatgtagccttatcctgcccagaaagactcaacacctcaccaggggaagggatttcctacaaccaaaaccctactgcagttttcacttcttttttttttctttttgtttatatggtggatatttttactttatatagttttattcttatttttactgtttttcattgtttgtttttaaaagcttatcttattatagcttctttgtcccaggtttgcattactttcaattacaaaaataaagcatgattatttgaaaaaaaaatacttgcacattacagaaatgcataaaagcaaaaagcaaatgtcactctgaattttcccttcacctcctacctccgcatcacttctcaaagggtaactattatcagcaatttgatatagatctttctagacttttcctatgctaatgtaaacatatatatttaaaatgtacacgcgctgttgtgcaacttgctttattcacttaaaattggtaggtataaagatagctatcctcttttaaaaggctttatcattaagaatcctattaatggatattaagttgctttagttttggttgctattatgtcattattgtaagaaacacttttgtgcgcacacacacacacacacacacacacacacacacacacacctgcatacttgaacgataaatttttataaatgaaacttcaatgttaaaggataaattgtaatagaaactggtaacatgtcatttaaaagatggtaactataccctcatcaagagtatatatatgaggccaggcacagtggctcatacctgcaatcccagcactttgggaggtggaggagggaggatcacttgagcccagtagtttaagaacggcctgggcaacatagtaagaccccatctctattttacactaaaaaaagaaaaaaaaagaatgtatatgagatagtttatttacctatatccccactaacaccaggtattgttactttaaaatttttggctcatttcagaagaaaataatacctcaatttagtgtgaagttctttgatggtgaggctactatatatacataaatggtagattttctgtttcttctgtaagctggcagttcatatattttgaccatctgtatgcggtatctattattttctaattagtagaagttctttataaattaataagagctacgatgtattaagtacttacaaagtgccagtgttccatgtgctacgtaagtagtcactcatttaatcctccacagccccatgaggtcatatggtgatcccattttagagataggaagtctgaggcatggagttaagtaatttgccagccagtaagtggcaaagcaagaagcaaagtttctcagactaacttgagaaactttgctcttaactgccatgtttttctgcccactttctggctcaagttggcgaatatatttttcttattttggactttacacggtgtttatggtctgtcttttgccacccagaaatgcagaaaacctgtctgttctcttccttatagcttctgtgtttcatatcttccttaaaaagatcttcttagagaagcattcttctgtattttcacctactatttttactttcacaatgtttaaaatattttccatatttagatctgagtcttcccacctagaatatggtaatataaatatgtttttccattaatttttttagattttacagtttttcccatgttccatgttttcctttttaaatttcccttttaacaatgactgttttattggtcattcatttaacatttagcttttaaatgtatttacagtagacttctctccttttgttttattttttaatttgttcaatttttcttgaaataaagtagagaaaatgaaataatttatttttaagaactgatttatttacagttcagagttccttatttttgccttcttttaaattgaattatgtatatgtagttttatttatctacattctaatactttggcctcaatttttaatttcttcttattttatagattatctttcaagttcctgatgtatatgtatttatttactttttattctaagttgacaatttataattgtatgtatttgtggggtgaaaaatgaatttatgaatacaatgtgggataattaaatcaaactaattaacatatccaccgcctcaaatactttttttagtttttgagacagggtctcactctgtcacccaggctgaggtgcagtggtgcaatcacaattcactgcaaccttgacctaccaggctcaggtggtcctcctaccttagcctcccaggtagctgggactacaggtgcctgccaccacacttggctaattttttgtattttttttagagacagggtttcaccatgttgcccaggctggtcttgaactcctgggctcaagcgatctaccctcttcagcctcccaaagtgttgggattacaggtgtgagccaccaggcccgacctcaaatacttattttttgtagtgagaaaatgtgaagtttactgtcttagcaatgttgaaatgtacagcacactattattaactacaatcaccatgctgtgcaataaatatttttaaaaaccctttctaactgagattttgtactctttgaccatcatctccccattccttccaacttctggtctctgtatccaccattctattatctgcttctatgaacttgattgttttagattccatatgtattaggacatgcagcatttgtctttctgtgggtggcttattttacttagcatattgttttcttgttccatctatattgtcacaaatgacagaatttctttctttttaaagtctgaatagtattccattgtgtatatataccacactttatccattcgtctattgatggactcaggttgattccatatcttggctattgtaaatagtgctgcaatgaacatgggggagcaggtatctctttgacaaactgatttgaaatcttttgggtaaatacctagaagtgggattgctggatcatatggtagtattctatttttagtttgttgaggaactttcatcacattttccataatgggtatactaatttactttcccaatagtgtacaaataaccccctttcttcacattcttgccaacacttgttatttatctttcatctttttgattatacccttctgacaggtgtgagatgatgtctcattgtggttttaatttttgtttccctattaattaggaagcttgagcattttaaaatatatttgttggccatttgtatgtcttttgaaaaatgtctattcaggtcctttgcccacctttaaattgattttttttcttgtttttgagttgtttgagttccttatgtattttgtttttgtttgttttttaatttttaatttttgtgcatacataataggtgtatatatgggatgtgtgtacatgagatgttttgatatagatatacagtgcataataattacatcatgaaaaatgtctctttccccataagcatttatcttttgtgttacaaacaatccaattttattcttttagttattttaaaacaggggtgtccaattttttggcttccctgggccacattggaagaattgtcttgggccacacataaaatacactaatactaatgatagctgatgggctgaaaaaaaatcgcaaaaaatctcctaatttctaagaaagtttatgaattgaacttatgtgttgggctgcattcaaagctgtcatgggctgcttgagacccatgggccatgggttggacaagctttttttaaaatgtacaacaaaattgttattgactacagtcaccatactgtgctatcaaataataggtcttattcattctaactattttttggtaaccatccccacctccccacaatgtcttgctacacttcccagcgtctggtaaccatttttctattctccatgtccatgagatcagttgttttgatttgttggatgctaaaataagtgagaacatcctatgtttatctttctgtgtctagcttatttcacttaacataatgacctccagttctattcatgttgttgcaaatgacaggaacacattcttttttgtggctgaatagtactccattgtgtataaataccacattttctttatccatttatctattgatggacatttaggttgtttccatatcttggctattgtgaacagtgctgcaataaacatgggagtgcagatatctcttccattgactgattttctttctgttgggtatatatccagcagtggcattgctggatcatataatagctctatttttatttttttgagaaacctcaaaactgttctccatagtggttgtactaattcacattcccaccaacagtgtacaagggttcccctttctccacatcctcatcattatttgttattgcctgacttttggatgaaagccattttagctggggtgagatgatatctcatgatagttttgatttgcatttatctgatggtcaatgatttgaacacattttcatatgcctgtttgccatttgtatgtcttcttttgagaaatatgtattcaaatcttttgcccatttttaattggattattagatttctttcctatagagttgtttgaattacttatctattctggtttttaatgccttcttgaatgggtagtttgcaaatattttctcccattctgtgggctctctcttcactttgttgattgtttcctttgctatgcagaagctttttaacttgatgtgatcctgtttgttcattttgctttcgttgcctgtgctcatggggtattgctcaataattttttttgcccagacaaatgtcatggagagtttccccagtggtttcttgtagtagtttgcagtagtttcatagtttgaggtcttagatttaaatctttaatctattttgattttatttttgtatgtgatttgagataggggtctagtttcatttttatccattgagccactctgtgccttctgattgtagagtttagtccatttacatttgacgtaaatgttatatttttaagtaaggacttactcctgccattttgttacttgttttctgtttgttttgtggtcttctcttccttctttctttcctttctgtcttcctttcagtggaggtgattttttcagtttcctgctttttattttttgtggaactgttatatgtttttgagtttgaagttaccatgaggcttaaaaatagtatcttatatcccattattttaagctgataacaacttaacacagtttgcataaagaaacaaagacagcaaacagaaagctaatacaaactctataccttaacttcattctcccactctaaaactttttgttgtttctatttatgtcttattgtactttatatgtcttgaaaagttattgtagttattatttctgattggctcatcatttagtttttctacttaagacaagagtagtttacacgtcatagttacagtgttataacattctgtggttttctgtgtacttactactgccagtgagttttgtaccttcagatgattaaattgctcattaatatccttttctttctaattgaagtactccctttagcatttcttctaggacaggtctcgtgttaattaaatccctcaccttttgtttgtctggaaaagtctgtgtttctccttcaagtttgaaggatattttcaccagatatactattctagagtaaaaacttttttttttgtctttcagcacttcaaatatgtcatgccactctcatctggcctgtaaggtttccactgaaaagtctgctgccagatgtactgaaactcccttgtatgctatttgtttcttttctcttgctgcttttaggatcctttctttatcttggacctttgggagtttgattatcaaatgctttggggcagcattcttgggttaaatctgcttggtgttctataaccttcttgtacttgggatattgatatctttctctaggtttgcaaagttctctgttattattgctttgaataaactttctacctgtatctctttttctacctcctctttgacaccaataactcttggatttgcccttttaaggcaattttctagatcctgccagtgtgcttcattgttttttattcttttttcttttgtctcctctgactgtgtattttcaaatagcctgtcttcaagctcacaaattctttcttctgcttgatcagttctgctataaaaagactctgatgcattcttcagtgtgttatttgtacttttcagctccagaatttctacttgattctttttaattatttccatctctttgttaaattcatctgatagaattcttgaatttctttcagtttcctcaacatggctattttgaattctctgtctcacatatctctgtttcttcaggattgatctctgatgtcttatttaattcatttggtgaggtcatgtattcctggatggtcttgatacttgtagatatttttctgcatctaggcattgtatttattgtagtctttacaacctgggcctgtttgtacttgtccttggaaaggctttccagatattttgaaggactcggatgttgtgatctacgttgtatctgctgtagggggccctgcaagcctagtaatgctgtgggtcttgtacacactcatggaggtaccaccttgatggtcttggacaagatctagaaggattctctggattaccaggcagagattctttttctagtccctttactttctcccagagtctctctctttctgttctgacccacataaagctggtgacacactccaccgcaactaggactttgctgggtaagacttgaagccagtacagcacttgcccagggcctgcagtaaccacttcctagctgccatctatatttgctcaaggctctggggctctacaatcagtaggtgagaaagccagccagacccgtgttcttctcttcaggttggcaagtttcccaaggccctgggttggtccagaggtgccatccagaagccagggactagagtaaaaaaccttagaagtctacctagtattgcattgtactgtgactaagctggcattcaaaccacaagacacagtccttcccatgctgtcttccccttttctaaggcaaaggagcctcacctcatggccaccaccaccacaggcccacagggagtactgccagtgtactgttaatattccaaggcccaaggactcttcagtcagcttgtggttaatgctgcctggcctgggactcacccttcaaagcagtgggctcccctctggcccagggcaggcccagaaatgctatccaagagccacatcctggaatcagggaccccaagcccagttggtgctctacctctctgtggctgtacctgaagccagcaagtcacagagtctcacccaaggcccatgacatactaattgggtatcacttctggtttttcagggcccaagggctcttcagttagtaggtgatgaattctctccagatgtcgttgtgaagataaaagaggtttattttcatgaaaacatatatactttaaagcaccttatgaaatgtatgtccattccaccatcaacatttttacctctgttgggaagataattccttttgactccacaataattatttatatctacacatgggaatgtttcttttttatttgtgtggttttggttttaaagcatttaatcattacaagactcctagaattactatatcatgtgctctctgaaggcaaagttcccatctaatttttctattttatctttctacctctaagacctaaaactcaataaatgtgcattaaggcagatatccttgggagaagtgacacagaaactatgtattcatgctctgtgtccattgtacttcactcagggttaagactgccttgatgagggcaagtgtaggaagactctgaggccatctgagagtaagtggtgaagacttaagaagtggggcaggaaacacagcaagagagagttgtcaggaagcagaaaagcagttggcaaaagcaaccactgaaggactggttttacctctaattcttcctggactggggataatcctagagggcttgtctctgtcagatgaacttttggtagcatttcccagaaccatgactcaaaacttgccactgtgttcccatctgggatttggaagataaggtaagaacttggaaagaattcaggggacacttagttaaattgggtcaaaatgtgtccattctccagcctccgtcttggcagtgacacattggaaaatggttccactatgactgaacagccagggaagagtacagcttatttatactctctgttttccactttattttctacaaactatgtcttttagaaataaactatcaatcttgcccagactggagaaaggactgcagcaacaaccctgtttcagtattctggaaaacggtttcccgcagggtaagtaccaagtagtgaaattctagagctttggagaccacagaacttaagacgttactcagtcagtgcttggttttaacacttttggattacaaatacttttaggaatgaaaatataggattcattcctgagaaaaaggttcagatgcacatgccagaaaatttacacatccaattttagaacattcttagagggtccatgggctccagttgcagaatctttgcacgtacccactctgactttggctaccaggaacctggggcttggtttaatcctctgattcaggtattagtcaatcttagatacctgggacagtcgtaacaatctacatgtatagaccccttactatgtggcaggtacggtcctcagatctttacatgaactagtaacttgcatcttcaccagaaccctgtgaagcaggtgccatgagtattgtaaccatttaacacataacgtgaaggtacaagtaaacaaggaatctactaaatgtacagaattagtaagaggcatatgtgggagtttatcccaagctgtctgactccagattcagaatctaggctgggaaaaactcaccactccaccctctacctattttttttaaaaaaattgatacataatagttttacatatttatggggtatatagtgatgtggtgatacatataaggtatagtgatgaaatcggggtaattaacatatctgtcatctcgaacatttatcatttctttgtgttgggagcattgaatatcccccttctggctagctgaaactacatattattaactgtagtcctcctacagtgttattgaacaccagaatttattcctcctatctaactataattttgtatcttttaacaaatctctacctatctcctcctcctcctacttttctaagcctatggtggcctctgttctgccttttacttccataagatcaacttaattttagcttccatatatgagtgagagtatgtagtatttaaccatctgtttctggcttacttcacttaacataatgccctccagttccttccatgttgctgcaaatgacaggaatacttttttttttttttttttttttttttttttttgagatggagtcttgctctgtcacccaggctggagtgcaatggtgtgatctcggctccctgcaaccaccacctcctaagttcaagcgattctcctacctcagcctccccagtagctgggactgcaggtgtgggccactatgcccggctaatttttgtattttcagtagagacggagtttcaccatgttggccaggctggtctcaaactcctgacctcaggtgatccgccagccttggcctcccaaggtgctaagactacagccatgggccaccatgcccggctaatttttgtattttctgtagagacagggtttcactatgttggccaggctgtctcaagctcctaacctcaggtgatctacccaccttggcctcccaaagttctgggattacaggggtgagccactgcacctggccaggaatacattttttaattcctgaatacaattccattgtgcacatatacccccatctatttctaactttactcaaagctacctgtgtatatttatttatcttgtaagttgcttcagtgttaagtggacaaggaaacatttcttttcaagtgtgttagggaaaaaaagagaaaggaaggaagaaagaaatgaaagaaaaaggtgtgagtaacaatacactaattataactttcaaaattaaacttagacatctgaggaactggggcaggtggaaatgtatttgttaagtgcatatgtcttagtccatttgtgctgctatcacaaactacctgagacttggtaatttttttaaaacaggagttttattttctcattgtgctggatacttgggaaatccaggattaaggtgccagcagattcaatgtctggtgagggctgctgtctgcttccaaaatggtgccttcttgctgtgtccttacatggcagaggcagaggggctaaaggaacctagctagttccctggagccctttcataagggtgttaatcccattcatgagggcagaacccttagggcccaattatctcctaaaggactcactacttattaccatcacattggtcttaggtatcaacataagaaacacatacattcaaatcatagcagcatatctgtgacaagccttgaagtagttcctctgtcattcccattgagtcatccccataggtagtgtgacaaatccctacattaaaggtgaagaaactaagactcagaagttaagtgactcatccaagttccctgggctaataagttacagacctaagagcctaacctaggcctccctgattccaaagccatgctcttcaattttgttctttgaatctgcttattggttctgtcttttaaatgacaggtttgatcttaactctaggttggtacctagctaaatctctgtcttagggggattcatgtaaaccctggtacgatggaaacagaaaaacagcctggaagttgacataaggagaccatgtttaaacttgggcagattcctttactcattctgatcttctgattcctcatttgtcaaatggaaatcaaaatatacttgttccatagggttactgcaatgtttaaatgagataccaccatcctataacataacccaaaatccacccacttcaaaaataattcattgagtacttactatggacagtgaacattcatgggcactttatagtttttgtttgtttgctttttctgagaatagtttccatttcactactctatggtatgttttaggacagtgctgttgctaaaatcttttaaagccaagtcacattttatatgtatcaagaacctccttgcgttccccactcagtccctggcactaggaatacagaggtgcacgtgattgaaggcgtcctgcccttgtgagctaccagcacctttattttgccaatcactcatggatgtatgtggatggacttcttttttcagacttgtccctttctttttctgataacagaggccatgtttttttttaatttttaatttttgtgggtaggttaaactcatcattataatacaatacagttggataatgtggagggaatgtaagatgctgtcagagtcagagaaggggacttgagctagtcccaggggttggggaggcctcctggagggagcatatagaacactattttgttcatttcatttttccaaagtctaacaaagattcctgctgaatgtttcttgcatggagaaataagaccctttgctcaagcatatttattcattcacttattcagtcctcctttctctctgtgcttttccaggcctaagggtcccctgttctctcctcaggttcccctcttatggtgttcccatttccctcatccctgaatcatccacctgttcccactaaatgaagcataatgtttacagtgcatgacactgagaaagcactttcatcttccccctctagacattcctcttactcctctggacttctgacttctgaaccactgaaccaccagctctatgaactataacactgaacattgttcacttagagattggagcaactgcttcaagaactctgatatgaagcataatccgtccagtggcttggaataaaaattgtgtagacctgacattcctgggctaaaaccatatgggatatccttccttaaccagctattgctaagtattgttttgaatgaaactgctggaggatggtgattaagtttgcatgatgaatggtgggcatttttttttttaagtttgcagaagctgcctgtgatgtggtccatgtgatgctcaatggatcccgcagtaaaatctttgacaaaaacaggtacacatttattttgcatcctgtttgcaagtatcctgttgcaaatatcacagtgaatatttcatctctagaaagaatatgcttttcatgtttcaggtcagttctgaagattagggccaaaaaaggtaaaaattttgaattccgtggagagagttgtctcctgtcaatgtgtttgtctgatttctcctttgccaaaaattgtctaccaggttctaatggccactgcactgtatctagcccctgctcttaacttttgcaggcctggtgtaattttctcagctttctctcccgttaccctccaccctacccattgctcaccattgttcacaccgttcccccatatgacctgcctcccctgctcccctgctcccttctgtctaaatcttcaccatccatgaagacctgccttgaccctcctctcctccaggaaaattgtgtaccccaattcagtagtaaaactactaccgggaacatcgggaactgtgctgggctcttggccttcactatctttttgcagacattgtcaacaatgtactgtagtggttgaaagcaggtactggcggtcattacatatcatctgtgtgacctcaggcagggcagtcaacctctgtgagcccctgaatatgtaccaaagagttgatggtgatgggaagattaactgagacaacagatgaaaaatgctgagctctgtgcctgacaacagagaaagtgctcaatgagaatcagctattattctcatttgctgatccttgccactgaatctggccacacctgtgccttccttggctgatctccttctatatttacagtttttactatgttgattaccttttcggcctttgttctctaatttttgttctctaatcccacataaggctgactgaaaggaggaagcatatattaatttgccttataaactctaggtgccccaaattaatttttcttctctcctgttttaatatttaattctacaaggaagcatttgtcctttcgtcttctgatcccaatttttttgggtaaaagcattaacatttcagaattttatgatctaatattatggttcaagcacttgaaacaggagtgtcagttgtcagagactaacagggaagagtttaggaatgggattagggcaggcaaccatagtctttcaaagcattgcctctcaaacttcactgagcatgtgaatcacgtggggattgttcaactgcagatcatttcagcaggttatagtggttgaaattctacatttcttttttttttttttttttttttttttgagatggcgtctcgctctgttgcccaggctggagtgcagtgacacggtctccgctcactgcaagctcagcctcccaggttcacgccattctcctccctcagcctcctgaataactgggactacaggcacccaccaccacgcccagctaattttttgtatttttagtagagacggggtttcatagtgttagccaggatggtctcgatcccctggcatcatgatctgcctgcctcggcctcccaaattgctgggattacaggcatgagccaccatgcctggctgaaattctacatttctaatgagttcccaggtgatgttcattaggttggtctaaggaccactcttcaaatagcaaatatttaaagaatcaacattaatgcacaaattaagaattttattttgagaatcttgttaaccgagggtcatgctgaataagaaaaggttattgactgatttgcaatttgatgtgtcaactctaaaggataggtcctagccagtgcctttctgcctgctggttgttgaggggggtgtggatgctttcgtttggggttgatgtttggggttctttgtttcttctattttagcacttttgggagtgtggaagtccataatttgcaaccagagaaggttcagacactagaggcctgggtgatacatggtggaagagaagattccaggtatatcttactactttgtacccaagtgttattttatgaatcagtccacaaaagaatccacagtcacaagcacgcactgggaacaaattgactcaggaaatgaaactacatgaatgtgcatgaatcccaacagcctcttaactttatctccacaaaggatatttaactgcttgacacttcagctctcctgctgacccaggagctcttagaggatttacctctactttacctctttatccaagggccttgtccagggcgtgctacaaaaacaaagagactccaaaaatgtttgtgagatcttgtaattttaatactttcttctttcttccccagagacttatgccaggatcccaccataaaagagctggaatcgattataagcaaaaggaatattcaattttcctgcaagaatatctacaggtaattaatttcttcttgaagaaaaaaatgactgtcttgtcacctgtagaatttccttttttccttagcctcctctgagcttggagggctgtgtgaatctttcttgggccttgatgatgatcacagatggcaacctctggtgatctctgtccctccttccaagccgagtccagaaggtatccaagctagtggccttcacttggctgcctttcctcatccgtctctattgatcccaagtaggacttgcctctaaagctgacacaacctttgatggcatattttttcattcccagtgtgagtggcccagtccagggttcactggcctactaggtttcaggggagcaagggaatgttttgctaagccctttctcccaagttgtaaaatccttgtgacttgacatcattttgcaagtgaagcttccttagttggatctgagtacagatgcctaacacatgacaaggcgtcacacggcagtctaccaaaatctatattttttaaattaaaaaaaaaagtatttacaaaatttttctgataatttgtgtttattagaaaacagtttaaaattacagatagatatatattttttaaagtcacatataattctagtttcaaaactgagacccctcactcatttttaagcagttgtgaccaatggtgtaggtaggtactcattggtagaagcatctttggagatttttccacgtataatagcttggaacaagattgatgcagagaggaaaagctgttcaaaggaggtagaagctgagatgctagaatattgttcctgtttccatgtcactaccttctctcactaaccacatcagaaaagcagaaggatagattctggagactctactgatggcttttgtttcccaaatgacctgaattccccatgagtcaccttgcttctatctggaaacagccagaaaaggccatgagcattctacagcagttagacaggaaaacagaaagaatgaatgaaggagcaactgtaaaagcaatcttgcggcggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcacaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccgcgagactatatcccacacctggctcagagggtcctacgcccacggaatctcgctgattgctagcacagcagtctgagatcaaactgcaaggcggcaacgaggctgggggaggggcgcccgccattgcccaggcttgattaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcttcaagtgggtccctgacccctgacccccgagcagcctaactgggaggcaccccccagcaggggcacactgacacctcacatggcagagtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacatgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcaggttaccctcaaaggaaagcccatcagactaacagcggatctctcggcagaaaccctacaagccagaagagagtgggggccaatattcaacattcttaaagaaaagaattttcaacccaaaatttcatatccagccaaactaagcttcataagtgaaggagaaataaaatactttatagacaagcaaatgctgagagattttgtcaccaccaggcctgccctaaaagagctcctgaaggaagagctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagatgaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaactgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctccagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatataaccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaataaaaaataaaaaacaactctcagaagcaaaaaaaaaaaaaaaaaaaaaaaaaaaagcaatcttgcagatatctgacgagtctaagctgttcaaagatatgttgcatggagaaaatagaatagtagaaacctagacaaagactgggaaataaagatggtcttatccccaatactcttttaccttttttgtcttatgaaacattaacctttttctcataaatgaccagaagacctttatattataattcgtcaactcccctcatttgtgtctgctttaggctccaagtgagctcactcattctccatctggaaagaaaatatgggcatggcttccatttggacttgtacagacagtggcccataatgggaaccaggtgacacatcacaagggcaggttctgacacctcttccttccagaagcccaggggtgctggcagctgcttctgaggatctctctcttccttggctcatatttagcaaaatcaaatttaaagaaccccattcctcgctatccaccatccccctattcatgtgccagccactcctattggatcctgttgctttagctaatttttatgaaaataatagtcattcacctgttaggtacttatctaaggtttgtttcaaagcaagtttggtccccttgctgagggtctccagctttttcccagactctgcctctgaccctggattcaacattccctcaggaagcttcggaagagaggaaagcaaattagccacagaagctgtgggggtccgtggccttggttgctgctcctgctgtttttttgaccagcaggtggcatggatagctcccctcccgacatgtcactgcaggagaggagtttatatggatgctaagtggtctgtgcaccttgtcgtcgctaaaaaaggggcttcctccattagcgaattggacgacagatgtatcctacggtctcttgatttccttttttgctttcttgtcatagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcactttaattctcatgtgatccttttatgttatttatatattggtaacatcctttctattgaaaaatcaccacaccaaacctctcttattagaacaggcaagtgaagaaaagtgaatgctcaagtttttcagaaagcattacatttccaaatgaatgaccttgttgcatgatgtatttttgtacccttcctacagatagtcaaaccataaacttcatggtcatgggt

SEQ ID NO: 2406 - DNA, 43479 bp, Homo sapiens
  source 1..43479: mol_type = genomic DNA
cacttccgccccgggcgcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccggtaggaccccggggcgggttcgcgcgtccgcggcgagactagagctctcctcagtcgggcaagagtcgcggggcggggctcacagcaggccgtgcctgtttggggacagggttctctgaggggtgcagtgctcagatcccgggggtatgtggcggggaatgcggggaccacgcagagcccgaggtgaagcttgtttggtggcgtcgtgtgcgcggccagcatttacgcaggatctggctgcgtccctaaaaaaagcgtgaatcgtgttttcgggattgagccagtcggccaggggagcgcggactgggcgccctaggtgagggcttgttctggagtgcacaggtgcgtgggagtgttgctagggcccgtgctgtgtccgtggtgagagtttgccctgtgttcccttggtgccttggtgagtggggtgttcattagggcttggacagtacccgcggtaagggttgcagtgcgtctgctgtgccccatgtgctgggctgggcgagcaggggcctggccaggtgttgctgggagcgtgctgtgcgtaagtggcctgtgtgcagagttcactgtgggcaagacagctcaactgtttgctttgaatggagtgagcgcggactctggggctagggagggcatgttgagtgagagcaggctctcggtgcctggggttagagaggtggtaagggcgcgccatgctttttgtgccttctgtgaacagtctccgtgttacctgagctcctattagtttgtaaatggctgcttttttggggggtgggtgggccatcgagtcttcttcctgttcccaaccaatatagatagtatctgattccattgcctaatggctttttgacattgttttccttcttttcattactttgagtcatatttgagagatgtgaaacaacctaaaaaacaatggtagccaaacctagtgagaaattagtatcctaacaaaggaaggcagataatgttaatcttgttttcccctgcagctcataagctaaagcttaaggcctatcccactaaatttattttgtatttcattgaatggaatcaatacttttaaaaatgcatgctaggccaggcgcagtggctcacgcctgtgatcccagcgctttgggaggcccaggcggggtgattgcctgtgcccaggagttcaagatcaacctgggcaacatggcaaaaccttgtctctacaaaaaaatacaaaaattagctgggcatggtggtttatgcccgtggtcccagctactctgggggccgaggtaggagattcacttgagcccaggaggtgaaggctgcagtgagctgtgatcatgccactgcactccagcctagatgacagagtgagaccctgtcaaaacaaaacaaacaaacaaaaaaaaaacccgctaagaaatacatgcttattgtgcgatacgaacagaatcaaaagacagctatttttaatattttggcatatttgtttctgccttcatgtgcgcgtcatgtgtatctatgtccaaattatatttaggatccaataacatgtatagtttctacgttgcatttttttccttaggagcattcattcaacgaatatgggtcttgtatgtctggtgctattacactggtaggcaataacaaaccattcctattttcttgatccttttttcactatttgtttacacacacattcatgcaggaagataagcagggactttgttttgctcaatgataagtgctcagtgccgggaacacagtagataaccaataaattatttgctaaaatgtattgggattggcagacattaaaatccaaaacataatagtgacaaataaattatgaaccaagggaagtgctctggaggcaagcagtataattttcagatataaatctgacagcatttaacaaatgattggagagagggaaggcttctctgctcatcaaacagactttggggcatctgtgcttgctgttccctcagcccaggaacattctcctcctgacctgctgcagaaacagtctcgctcttctgcaaactcagctggaatgttacaccctcagagaccttctctgatcaccccacctcgcgacccccccatctcaggttgaacacatacaacccagttcaagtccctcttcacttgtaatcacccttttaaaatgaccttttctgttctttgtctcaccctgtcagaatgcagggatcctgtctgtcttgtcgcacttgtggttccaaaagcccgatttgtttacctctgtatctgttaaataccagaaaattaaatatactatttggctggggcttagagcctaggaaaaagttcctcctgcctccaagaggaaggttctttaaagagctatgctcaggatggtctttctgcggtacctaaaaagctagggcagtggcagctgagagccagaaaggatctgtctcccctatttgttgactctgcagggcttccagtacttcagtcttgcatctcactgatcattaaaacgttcattttgaaggagggtaatgggagtagggagtagtggtgataagaagaaaacaaaaggacttttttttttttcttttaagattaatgtttagaataggcttagtgctagaagttcagcctggacagcataagcagacctcacctatacaaaacatgtaaaaaaaaaaaaaaaaaattagccaggtgtgatgttgcatgcctgtggtcctagctacttgggagactgaagggggaggatcactggagcccctcatggtcaaggctgcagtgagccctgatcatactccagcttggataacagagcaagagaccctgtctcaaaacaaaacaaaacacacacacatacacacacaaacaaacaaaaaaagaaacaaaataggaagctgaagaagataatgaaagcgatttgaaatagaggaacatagaattatgaaatgaatagggtgcaacatggaaaataacaaaactaagaatgaagagaaggaaaagcaaggttaagtttgaggttcataagggtaaatcaagacaggtatgaaacctagagaaagtaaaaatgagaagtcacgatgctaggcagagagaatacgtgaattaaaataaacattcaatttttggagcaactcactctcacaaggagaaggtttcgtaagcagacagtgctgtgcatgggagacctgccctctcaaaggtagttgccaaatggttccagatagttgaaggaaacatgtatcaaatttcaggccagtctcattcctccagaagaggagctgcttttttggacaaaacccgcaatctcctgttgtgcgtggtctcttctgcctattttaggtgttttccttatttccagtgaaagaagccaagatcagtaagcacttacacagtagcgtctcagtttccttactgggcatactacaatgcaaagagagcagtccatatctggtcacctgccaggataccagaagactgggagataggcagcacaagaaatggcctaatcttctttctccattgtgctgtagaatgattattttcaatatgaaattgattacaatatattcttcacattgttttgtgtttgacagcagtggattttgaataccaaattttttttgaatagctactctgagtgacatattgtgctgggtgttgtggccacatggatgaatggagttggccttgttaactattaaacacaaaagcatgtgatagttacctgagagatccatgcaggggagagtccaggggaaggtgactgatcactgcttcccagggggaggcagaaaatgcttcctggaggagatgatgggtggattaaggaagatgagttgagcaggagttgtagctaccagccagggaggaagggtattcagagcagaggaagcaaggtgagcaaaggcaccaagatgtgacactactggactgccaagctattcagtgtggcagagtagggcaaaggaggcaagaaagaaggaagaggattaaatcacagggtgagtaattctgaaaagcaacagactcatcaggagtaaacactcaccatcataaattcagactttcacgttattacctgtccttttagggcaacttgagccttttgtttgacttagcacaacatgaatccaaactagggttgttttgattttcccaggcacggtagcagacaatttcttgaatacttatttgcagatagagtttgtcagtgtcagcatttcttgtgcacccacaaggtgagtatagtagaaaaagaagaacatggttcttgacccccaggaacttgccttttaagagaagacaccctgaagtgacaagctgttataagttagtgttttaaactatggaagaacaatctgagcagagtactctatactgtagaagacttcttagaggagaagttacttttgaaatgaatttagaaaaatgtggggaaagatgcatccatatatattttaagatcaaagacattaatgctgtctcttcagtttattgtcgaatgtttattcccaaacaaaccaaaagctaataggatgttacttaaaacatgcaagtcccatttcctccactgctatgagcactcaggtaaaagcatggaacagtcatttaaaatcttgccaagggcctttctgttttttctgtactacctgctgccagaccacagtccatggctgatgaaagtgatatcagtacttcatcttcatgttcctattctcttatccctagatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagtaagtaaacaaacctcttttttttttctgcttgctctagagatttgcatacattttggggtacatattccactacggtgatgatgattttcttcttgtaaaatgaggttcaagataacaatgcatttttgcaagctttgagaaatcaaaatctccaagaaatcattttcctggcaatagattgcctgggtgaatatgaatcttaagtttgcccttataataagtaaataatgaaaattatattcccacccattcaaaagagcactgcagaattttgattttgattcagatctgttttataactggattgaaaactatcaaaattattttctttcaggagaaacatgtccatatatacgggatcctttaaatggccaagcagtccctgcaaatgggacttacgagtttggttatcagatgcactttatttgtaatgaggggtaagttgctccttagaggaaataagggaagtgttagtaattttatttttgttttgcttctcttcttaagcattcctgtaaacttaattttgctttctatgtgacaagttatacttctagccaaacaactcttggatgttttatggagataggcaagatatatagtaaatagaaagtaattgatatttaaggaaagcaaaactacttgctgtttctgacaataagtctgttgtaagcattaagaatgtagtaatcatgagaatttgtccttcacaactgagtgtcccctatttaaatctgccaactcttagagttgaagtagggctcacaaaaatgagaaatagaattgccaactaaagatacacttgtatccagatgactctgtaaagtgttatcagaccaaaactgacgcggttagcctttaccatcatgttgatcaaaatctctcagttgaaaaaccttatttttgagactgctacagtgtgaagcatctcaagagcaggtactgagccctcggtaatagcctttgttctgtagggttttgaagttgtatatattggagatactagacatttaagataaatgtgcatttatagagtaaatgtaagtattctgctataacagaatacttgaggctaggcatttataaagaaaagaaatgtatttggctcatatttctggaggctggagagttcaaggggatggcagtagtgtctggcaagggcttttgtgctgcatcataacatgctggaaagtgaaagggaaatttagcatgtgcaaaaaagacaaagcacaagggagggggttctcgctttataacaacgtgctcttatggtaatgaatccaagcctacaagaatgagaactcattccctgaagaattaatgaagaccctctagaaaggcattatacctcttaatgacctagtcatttcttaaaggccccaccacctctcaatgctgttacactggcaattaaatttcaatatgagttttggtagagacaaaccagattcaaacaatagcagtaacacaccataatatagaaaaagtaagtgagtcttggaggaaaaatcagctgtgactatgtaaggcaactgacagtttttaaaatttggtcaagtagaaatattggaatattcagttgacacatactgcttgctaggcacaccgagggataccaaaactttaagacagtgaccttcctaaaagaagttctaaccttattgagaaataatatatactgagagcaataaaagcaaaatactaaatgagaaataccaaataagtagaattattcatgataattactctaagagtccagaaggaggagagattcctgtgaatttaaatcagggaagatttcattgagtataggggtatacttaatgaaagtattcttatactcagtgagctattcctagaaatacactctgttctaaataatattaatagaagctaaaactcatgtagcactatctatgtgccaaatgctaacttatctaatcccctaaacaaccccatgtactgttatccccttttaatcaattaggaagctgagtgaaggaactttaagtgacttacccaagctcaagaaactagataagttgagaagcagggacttgaatctatccattccagctctagggcctgttctctctacacagtccttgtccttactgtgcaaagtggtgtgagaaaaggcacagaaatgaatgtgtaatgtgattgcaggaggcagcaaagaggctgggtggaaaggcacagcagatttatttagacatctttgctcttggccaatatatattcaaatggggaaactctatttgattaaattgcagatttatttagcactttcgttatatagtatgttgtttaagaaaccaccccctcaaactactgtagtgtagaaaagaaaccatataaaaaattccttcattattatgtgtgtcttattaattgctatacaaaacagtaaccctttcttttctcatttagttattacttaattggtgaagaaattctatattgtgaacttaaaggatcagtagcaatttggagcggtaagcccccaatatgtgaaagtaagtaaattctttttttttaaatttagaccagtagtcctcaaagatttttgcctcctttacaccctttacactttaagattaacaaagatcccaaagaggtttcttttatgtgggttatatctattggtatttatcatattggaattcaaacggagaggtttttaaataattattgattctttttggttttgtttgtttttcctaagacacggtctcaggctatttcccaggctggggtgcagtggcacaatctcagctcattgcagcctcagcctctccagtagctggggcttcaggcatgtgccactatgcctggctttttgtaatttttgaagagacggggttttgccatgatgcccaggctggtcttgaaatcccatgctcaagcagtctgcccccgtgggcctcccaaagtgctgggattacaaatgtgagccaccccacctggcctgattaatttgtaagaataaatgcaatacaaattaacatatgtaacataatttttatgaaaaataataattttccaaatcaaaataaaattagtgagaatagtggcattgttcacattttttgcatatctcttcaacatctggcttaaagcaagattgtatttggcctgttgtgttatcacacaatatgtagcctttggaaaaatatcactatattcttattaggatcagagtgaaaaaagacaataatattttggtggtattgtgaatcaccaatttagaaaatggatatatttataaattgcaaaggatttcttaactagcaccgagttaagcatattttctcattaattgtcagcatttcttgtgatgactagaacagaacttagcatggccttccaaataaatacaggcgtattaggccgttttcgtattgctctaaagaaatacctgagactgggtaatttataaagaaaagaagtttaattggctcatgtttctacaagctgtacaggaagcatggtgctggcatctgctgggggtttgggtaggcctcgggaaacttaacaaccattgggaaagacagaaggagagcaaggtgtctcacatggcaggagcaggaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgcgatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaacagcttgtagaaaccctatattgacaaatttattgaagacacagaaattttactaatgctgtcttaatcttttacatttcctttcctctttttcttcatttttaagaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaaggtagtgtttcaatttatttccttcttcatttgtaaatactatggaaacattttgtaaatagtttcatctacagataaacaaagcaggtgtatgtgcttcctcctcctgtataattggtttctaatttattttaattcaggtcaattcaagtcaaaaaatagttctagctagagttccctatttctcacccctacatgttcttggcatttcattttatacagtgtgaactactgtgtacctgcatgagttagaagtttttgtttgaaagaaccaaaaaaaaaaaatacacactggcttaaagaaagtttcatcttgtattacaagaaatctaagagttctggctatggtagtggtaaactgtgacagactaatcgtctcacaaataaaaatgataaactctggataaaaaaaattttttttttaaagaccaaatgtttaaggcactctggagtgaccaaaagtatgaagaccatgtaggggacttgcccatttaaagaaagaaatcactgaataacagtgatttaaaagtatatactccccaagtacacatgaaacattctccaaagtagaccatattctagacaataagacaacttttaacaaacttcagaaaattgaaatcattcaacatgcattatcacaatagaatgaaagcagaaatcaataacaaagccaatccccaaagaattggaaagtgtacaggacacttctaaataacccatgcataaaagaagtagtcagcagggagattagaaagtgttttgaattgaataaaaacacaacatctcaaaatatccaaatatgtaggatgcagctaaagcattgcttacaggggaatgtatagcataatatacttgtgttagaaaaaaagaaaagtctcaaatcaatgatctaattttccaccttaagaaactaaaaaagagcaagttaaatcccaaactagcagatgtaaggaaatgataaaaatagagccaaaatcaatgaaattgagaaaagaaaaaaaaatagaggaaatcagtgaaaccaacagttgctacttggagatcaataaagtgtgtaaacctgtagccagactgacaaaaaaagacgcaaattaaccaatactgagaatgaaagaagtggtggccaggcgcggcaccccagccagcttgaagaccctgccctcctgcagccggcaggggcagtcactcccggacttgtccttttagaagttccagctttaccacttgctggtggagcccaaccactgccgcagggtcctcatcgccaacacgcctggcagatccaagaggagatggcccaggatgagacgtggcacacacaggcacccgagagtgtggggttggcgttgttccactgcctggtttctgcagagatcctgtgcctgtggcctgtgcccgccatgtggaagccagagggggtgtgccatgccccccgctttggacactgctgcgtgaaggggccagttttcagacctttgctctgtcacctcagcactggcgccaggagccctgaagagcagcatctgggagacggacagccctggggaaaatagaggaggcgttcagaagtagctagatgagatatttgaaatactgaagaccaaaaaccccagtttgcatggaagaactggcctcagatgtggtcagttcctatgatgacctggacacacggtgctgacccacacgatgggaggtggccctgcaaagcattcagaggcttgggcctgctgccgtccggcctcccacctccagctgcaattgcattctgacctgggcaagtaggaacacgtagtggagatcctgatggagacctgagccaggcgtcccggagtgctggccaggcgtggagtacgggatccagctaagggagactggccagcctatagccccccagccttgctggctcctctgctaattccagcagggtctgcagccccagacccatccccttccttcccgtctgcagagggcaggccagaggctggtctcagtgggagctagggctctcctcaagggctttttgaccttgggccagtcttgacatccccacagccctgcgcccctcatcacttttcgtgtctctcggagacggcgagctgcaactgcagcaatcttgtttaaatttaggtaggtgaatttcttagaattaagtttcatatgttttgagcaataagttttcttaagatatatatattttaatctttttagttttatctctgaatattttttattttttttcaatgtattttttttctggaaacattctgtgctgctacattagagcctacacagtttagttggtacatttcattcttttaaggttcaaataagggattttattttccagtgagtttccttgcattgttaacaagtcaacagcgttaacgtatgattttttggttttttttttttgtatactttaaatttgtgtgcaacccttctcatttatgccctgtgttacagtgagagcttggtcaaagtggggaaaacacacacagctgctacactttttttttttttttttgtcattggaacatttgtgccatgtcttcctagacttaagtgtaaattatggagggttttatttgacaatttatatgtaaatgtcattgaaggctaaggttaaatctttggaaatcacaggcaccagttgatctttagagacctcagatcccctcaggtggcgccttgtgataggcggtgttctgggaggcttcctgtcaggttccacagcacaggcacctgctctgggcacggactgagctcctggggtgtgcacggagctgcggtgcgccagtcacatgcgcttggaaacagcgtgtgctgctggattggaaatgcctacgttgctctgttaaattggtgctggagccaaaacctaaggttaaatttaagtctagaatgaaagaaatctgaatccatgtaattaatggccgctcgatcttgagagtccttgacggccctgcctcaggaagtgaggtgggggtgcctacacctttcactttccttcctcacgtccaccccgtatgtgtttctcatcctttttctgacttccccccatcccttagccaaaaagctttatattcttttgtgcatatggtcattctttaatatcagtgatgtaaactttacttgattactttacaaaattattcaacagacaaacaaaagaatgaaaaagagaatatcactaaatatcctacagacatttaaaggatgacaagggaatattataaacaactttatgcctacaaatttgacaactgaaatggacagattccttgaaagatacaaaatgtcaaaactcacttgaagatatggataacctgaatactcctatatctaccaaagaaataaaatttgtagttaataacctactgaaggtccagatggcttcactggggagttctaccaaccatctaaggaataaatcacagcaattctacacaagcgtttcaagaaagtgcaagaggagggaacacttctcatcccattttatgatgatagcattgtccttatacgaaaaccagaaaacaaaaacattataagaaaattacaaataatatccttgatgaacacaggaccaaaaatcttcaacaaaatattagcaaaccaaatcctgtgatacataaaaagaaaagtaaatcatgaccaagtaggatttaccctatgaatgcaagattagttcaaatgcaaaaattaatcagtgtaatttgccacatcagtagactattaaggagaaaaaaaatcatgtggttatcttattagatgcaaaaaacaaagaaaatgtttgacagaattcatcatcttattttttcatgataaaacttctcagcaaactaggaacagaagggtactatctatcttaccctgataacagacatctacaaaaatctcacagctaacattacacttcatggttcaaaaaaattatacttagtggtaaaaagtaacattgtacttagtggttaaaaaaaccttacttacatttctgtctaattaataaagacctaattctggaaggaaaacagtgaggatgtccactcttaccactccattcagcattatattggagatcccacccagtacagtaaggcaagagaaagctattaggcacacatgttggaaaagaagaaataaaaactgtctctactcacaatgagatgccactaaatacctattggaaaggccgaaatgtaaacacacacaccccaaactgacaataccaggtattgacaaggatatggagcagatgaaactctcatatactgatggtgagaatcaaagtgcaatgaccactttgggacatttttggcatttcttataaagttaaacatactcttatcatacaactcggcaacccaaataaactgaaaacattttcacacagaaacttatatgaggatgttcacagcagccttattcataatcaccccaaactgcaaatcgccacatgttcttgagttggtgaatgaatgaaccacctgtgctacctctaaaagatggactcgtactcagcaataaaaaggaatgaactgattcatgcagcaacacaaatgaattttgaaagcatcatgcttagtgaaataagccatactaagaagactgtaatttcatttatgtgacattctgaaaaagtcccactatagggataaaagcagatcaatggttagctggttgtggaagtggggatgagggggaagaggggtaactcacaaaagagcatgaggaaattctggagagtaatggaacttttctgtatctttactatggtggtagttacatgattatttgcatttgtcaaaactgatacagctgtacacttgaaatggtgaattttactgtatgtaaattatatccaataaaccaacctttacaaataacattaggtacaattagacacaacaaaaggtcagtgaacctgaagacaggtgaatagaaattgaaccttatttaagaagaaatgttgactaaagaaagagagaggcttacagacctgtgggagagtatcaagcagtgaaacatacatgtaattggagtttcagaaagacaggagagagaatggtgtaaaatattatttgaaaaaatattggccaaaaattatccaaattagatccaaaacaacctcagatccaggagattcagtgaaccttcagcaggatgaataaattattaaaatttaccaccaccaccacccccctgcagtagtttggtaaaaactaccaaacaaaattttaaaaagcagccagtgagtggggaaaacaacaaaaacccgtattacatttaggagggcagggacaagtaagaatgacagccagccaagttttcttaagaaaatgtggttacaatatggttatctctgttagtgctgaaagaaaaataaaacaccctagaattctgtatgaaggagaatatattagttaacatttaaagtcttttaaaaaatgtttttaacatcttgcattccattccttgtctctgttcacactggaaattactactttgtactactttttctgctaaagcagatatccattaattctgaggtttctctaattttccagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcaggtttagtaatttcctgcttatagtttttcaaaaatcctttaaattcctggtgattttttataaaatccttcaaatttctggtgatgttcacttatttttagtaatgaaaggagggaggacatttgtatagccattttagttgttatacatagtgattctaaaattatttgccataatctgatataaacaggaatatgaccttgggaaagttgtataaattttgaatgtgtttatatatatatgtttacattatatatagagaaattgatttagtaccttccttattgggtattagtaaggtataagtgggatgcatttaaagcacttagcacagtgcctggtgtagagaaagctcttagagctagccaatatgacttatcctacacttaaattaatgttagggaaggggaaggttcatgtatgtttgttagtatgtgtgtgtgttaatatgttaatatgtttgtttgttaatatgtatgttttgtgtcatcaactttgctattttattcttttcagaagtgatctgttgacacctttactgagtttgttcctattgcaggactctttcatttcctggaatgcaactagtttgagtcttctgatgtaaaacatttaaacagggaaatttctgctgtcctcagaacaagatctgtatttctgcctcttccctacccacccctcttccacacctcataatgttatttattttttttctctttagtgggcagttttatctggcaatagcaactcaattttatagcaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagactaaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccaccactatgccggctaattttttgtatttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaatttataaaatcaaacttatttttctaggtcctaggcctacttacaagcctccagtctcaaattatccaggttggttaactctttatcctactgatattgttaagaatttatttatttatttttattatactttaagctctagggtatgtgtgcacagcgtgcaggtttgttacataggtatacgtgtgccatgttggtttgctgcacccatcaactcatcatttatattaggtatttctcctaatgctatccctcccccagcccctaacccctgacaggccccagtgtgtgatgttccccaccctgtgtccatgtgttctcgttgttcaactcctacctatgagtgagaacatgcggtgtttggttttctgtccttgtgatagtttgattagaatgatggtttccagcttcatccatgtccctgcaaaggacatgaactcatccttttttatggctgcatagtattccatggtgtatatgtgccacattttcttaatccagtctatcattgatggacattcgggttggttccaagtctttgctattgtgaatagtgccacaataaacatacgtgtgcatgtgtctttatagtagcatgatttataatcctttgggtatatacccagtaagggattactgggtcaaatggtatttctagttgtagatccttcaggaatcaccacactgtcttccacaatggttgaactaatttacagtcccaccaacagtgtaaaagtgttcctgtttctccacatcctctccagcatctgttgttcctgactttttaataatcgccaatctaactggcgtgagtggtatctcattgtggttttgatttgcatttctctgatgaccagtgatgatgagcattttttcatatgtctgttggctgtataaatgtcttcttttgagaagtgtctgttcatatcctttgcccactttttgatggtggtgtttttttcttgtaaatttatttaagttctttgtagattctggatattagccctttgtcagatgggcagattgcaaagattttctcccattctgtacgttgcctgttcactctgatgatagtttcttttgctgtgcagaagctctttagtttcattagatcccatttgtctattttggcttttgttgccattgcttttggtgttttagttatgaagtatttgcccgtgcctatgtcctgaatggtattgcctaggttttcttgttgggtttttatggtgttaggtcttacatttaagtcttcaatccatcttgagttaatttttgtataaggtgtgaggaagggatccagtttcagctttctacatacggctagtcagttttcccagcaccgtttattaaatagggaatcccttccccatttcttgtttttgtcaggtttgtcaaagatcagatggttgtagatgtgagttgttatttctaaggcctctattctgttccattgatctatatatctgttttggtaccagtaccatgctgttttggtcactgtagccttgtagtatagtttgaagtcaggtagcttgatgtctccagctttgttctttttgcttagggttgtcttggctatatggactcttttttggttccatatgaactttaaagtagttttttccaattctgtgaagaaattcagtggtagcttgatgtggatagcattgaatctataaattaccttgggtagtatggccattttcccaatattgattcttcctatccatgagcatggaatgttcttccatttgtttgtgtactcttttatttcgttgagcagtggtttgtagttgtctttgaagatgtccttcacatccatcccttgtaagttggattcctaggtattttattctctttgtagcaattgtgaatgggaattcactcattatttggctctctgtttgtctattattggtgtataggaatgcttgtgatttttgcacattgattttgtatcctgagacttcgctgaagttgtttatcagcttgtggagattttgggctgagacgatggggttttctaaatatgcaatcatgtcatctgcaaacagagacaatttgacttcctcttttcctaattgaataccctttatttctttttcttgcctgatcaccctggccagaacttccaacactacgttgaataggagtggtgagagagggcatccttgtcttgtgccggtttccaaagggaatgtccagtttttgcccattcggtatgatattggctgtgggtttgtcttaaatagctcttattattttgagatatattccatcaatacctagtttattgagagtttttagcatgaagggctgttgaattttgtcaaaggccttttctgcatctattgaaatagtcatgtggtttttgttgttagttctgtttttgtgatggattatgtttattgatttgttaatgttgaaccagccttgtatcccagggatgaagccaacttgattgtggtggataagctttttgatgtgctgctggattcagtttgccagtattttgttgaggatttttgcatcgatgttcatcagggatattggcctaaaattatctctttttgttgcacctctaccaggctttggtatcaggatgatgctagcttcctaaaatgaattagggaggattccctctttttctgttgattgaaatagtttcaaaggaatggtaccagctcctctttgtagatctggttgaattcggctgtgaatccatctggtcctggactttttttggttggtaggctattaattattgcctcaatttcagaacctgttattggtctattcagaggttcaacctttcctggtttagtcttgggagggtgtatgtgtccaggaatttatccattgcttctagattttctagcttatttgtgtagaggtgtttatagtattctctgatggtagtttgtatttctgtggggtcagtggtgatatcccctttatcattttttattgcgtctatttgattattctctctttacttctttattagtcttgctagcggtcatttttgttgatcttttcaaaaaaccagctcctggaatcattgagtttttgaagggttttttatatctttacctccttcagttctgctctgatcttagttatttcttgccttctgctagcttttgaatttgtttgctcttgtttctctagttcttttaatggtgatgttagggtgttgattttagatctttcctgctttctcttgtgggcatttagtgctataaatttccctctacacactgctttaaatgtttcccagagattctggtacgttgtatctttgttctcgttggttttaaagaacaactttatttcagtcttcatttcattatttacccagtagtcattcaagagcaggttgttcagtttccatgtatttgtgtggttttgagtgaatttattaatcctgatttgcactgtggtctgagagacagtttgttgtgatttctgttcttttacatttgctgaggagtgttttctaccaattatgtggtcaattttagaataagtgcgatgtggtgctgagaagaatgtatattctattcatttggggtgtagagttctgtagatgattagtaggtctgcttggtccagagctagttcaagtcctggatatccttgttaactttctgtctcattgatctgtccaatattgacagtggggtgttaaaggctgccattattattgtgtgggagtctatgtctctttgtaggtctctaaggccttggctttatgaatctgggtgctcctgtattgggtgcatatatatttaggatagttagctcttcttggtgaattgatccctttaccattatgtagtggccttctttgtctcttttgatctttgttggtttaatgtctgttttatcagaaactagaattgcaaccccttttttttttgctttccatttgcttggtagatcttcctctgtccctttattttgagcctatgtgcatctttgcatgtgagataggtctcctgaatatagcacaccgatgggtcttgactctttatccaatttgccagtctgtgttttttaattggggcatttagcccattttcatttaaggctaatagtgttatgtttgaatttgatcctgtcattatgatgttagctggttattttgcccgttaactgatgcagtttcttcatagcatcgatggtctttaccatttggtatgtttttgcagtggctggtaccggttgttcctttccatgtttagtgcttccttcaggagctcttgtaaggcaggcctggtggcgacaaaatctgtcagcatttgcttgtctataaactattttatttcttcttcacttacaaagcttagtttggctggatatgagattctgggttgaaaattattttctttaagaatgttgaatattggcccccattcttttaaggctcgtagggtttctgctgagacatccgctgatagttggataggcttccctttgtgggtaacctgacctttctctctggctgcccttaacatttttttccttcgtttcaaccttggtgaatctgacgattatgtgtcttggggttgcacttttcaaggagtatttttgtggtgttctctgtatttcctgaatttgaatgttggcctgtcttgctagtttagggaagtcctcgtggacaatatcctgaagagtgttttctaacttgattccattctccccgtcactttcaggtacaccaatcaaacgtagatttggtgttttcacatagtcccatatttcttggaggctttgtttgtttcttttcacttttttctctaatcttgtcttctttttttcattaatctgatcttcaatcactgatatagtttctttccacttgatcgaatcagctattgaagcttgtgcatgcgtcacgaagttcttgtgccgtggttttcagctccatcatgtcatttaaggtcttctctacactgtttattctagttagccattcatctaatcttttttcaaggtttttaccttcctcgagatgggttagaacatcttagcttggagaagtttgttattactgaccttctgaaacctacttctgttaactcatcaaactcattctctgtccagttttgttcccttgctggcaaggagctgtgatcctttggaggagaagaggcagtctgttttttggaattttcagcttttctgctctggtttctcccatctttgtggttttatctaccttttgtctttgatggggttttggtgtggatgtcctttttgttgatgttgatgctattcctttctgtttgtgtgttttccttccaacagtcagacccctcagctgcaggtgtgttggagtttgctggaggtccactccagaccctgttttcttgagtatcaccagcagaggctgcagaaccacaaatattgctgcctgatccttcctctggaagcttcgtcccaggtggggcacccaccacctgtttgaggtgtttgtcggccgctactgggaggtctttcccagtcaggctacatgggtgtcagggacccacttgaggaggcagtctgtccagtgtcgaagctcgaatgccatgttcagagcaccactgctctcttcagagctgtcagacagggacgtttaagtctgcagaagctgctgcgttttgttctactatgccctgcccccagaggtggaatctatagaggcagtagcccttactgagctgcggtgggctcctccagtttgtgcttccagttctctttgtttacactgtgagctactcaagcctcagcaatggcagacattcctcccctcatcaggctgcagtgtcgcaggtcaatctcagactgctgcgctagcagtgagcaaggttctgtgagcgtgggacctgccaagccatgcacaggagggtatctcctggtctgctggttgttaagactgtgggaaaagtgcagtatttggtcaggagtgtactgtttctccaggtacagtctgtcacggcttcccttggctaggaaagggaaatcccccaagtccttgcgcttccgggtgaggcgatgccccgccctccgtgggctgcactcactgtccagccagtcccagtgagatgaaccaggtatctcagttggaaatgcagaaatcacctgtcttctgcatctatctcgctggagctgcacaccagagctgttcctattcagccatcttggacaagatttttttttacttaaaatttttttaaattaaaaacttaagacatatctaaaaaaatgttaagaatttttaaatgatgggtgaaaaataacatcttgttttaatttgcatttcttggttcttggtttttagttgtttttgtttttgcttttttgagaccgggtctcactctgttgcccaggctggagtgcagtggtgcaaccacggcacactgcagcctcaacctcctgggctcaggtgattctcccacctcagcctcccaggtagctggaactacaggcacctgccaccacacccagctatttttttgtgtgtgaattttttgtagagacagggttttgccatgttggcaagtcttttctccaactcctgggcttaagcgatcctcctgcctcagcttcccaaagtgctaggattacaggtgtgacccaccatgcccggccaatttacatttctttaattatcagtgaatctgaactttttttgatctacatttatttattcatgtgctttgtctatttttctgttaggtttctaaaatatttttcttagtgatttttgagagctcattatgaattaaagcccttttaatatgaagtgaacagttttttccaggttcttttgttttgtcagttttaagcttgttatactactggatatagattactttttataacttttaattacatgagtagtgtatgaatatacttttgtagaatttcaaacattacaaaagtatatagagtaaaagattagttttatttttaactcattacccaagttaatcactgttaatagtttagggtttctttttaaatctatttttgtacatcaacatctttttttaaaaagttttattttagatttgggggtacaggtgaaggtttgttacataagtaaacgtgtcacagggatttgttgtacataactatttcatcacccaggtattaagcctagtacccaatagttaccttttctgctcttcttcctactcccaccctccccggtcaagtataccccagtgtctgttgtttccttctttgtgttcattagttcttaccatttagcccccacttataagtgagaacatgcggtatttgggacgttcctgctgaagacatgcgctcgttcttttttatggctacgtagtattccacggtgtatatgtaccacattttctttatccagtctgtcattgatgggcatttaggttgattccttgtctttgctattgtgagcagtgctgcagtgaacattcatgtgcatatatctttatggcagaatgatttatatttctctgggtatatacccagtaatgggattgctgggttgaatggtagttctgcttttaggtctttgaggaatcgccatactgcttcccacaatggtggaactaaattacactcccacgaacagcatataagtgttcccttttctctacaacctcaccagcatctattattttttgactttttaataatagccattctgactggtgtgaaatggtatctcactgccgttttgatttgcatttctctaatgatcagtgatactgagcttttcttctgtatgttttttggccacatatatgtcttcttttgaaaagtgtctgttcacgtgctttgcccactttttaatggagttgtttttctcttgtaaatttttttaagttcctgtaaatgctaaatattaggcctttgtcagatgcatagtttgcaaaaatgttctcccattctgtaagttgtctgtttactctgttgatagcttcttttgctgtgcagaagctcttcaatttacttcaatcgtacttgtcaatttttgcttgtgttgcgattgtttttgatgtctttgtcatgaaatctttgtctgttattatgtccagagtgatattgcctaggttgtcttccagggtttttatagttttgggttttacatgcaaatctttaatccatcttgagttgatttttgtgtatggtgtaaggaagggatccagtttcaatcttctgcatatggctagccagttatcccagcaccatttatttaatagggaatctttttcccattgcttgtttttgtcagttctgtggaagatcagatggtcatagatgtgcagccttatttctaggctctctattctgttccattggtgtatatgcctgtttttgtaccagtaccatgctgttttggttagcgtagccttgtagtagagtttgaagtcaggtaatgtgatgcctccagctttgttctttttgcgtaagattttcttgactattcaggctctttttggctccatatgaattttaaaatagttttttctagttctgtgaagaatgtcgttggtagtttgataggaatagcattgaatctgtaaatagctttgggcagtatagccattttaatgatattgattcttccatccatgagcatgggatgtttttccatttgtttgtgtcttctctgatttctttgagctgtgttttataattctcattgcagagatgtttcacctccctggttagctgtattcctaggtattttattctttttgtagtaattttgactgggattgcctctctgatttgactctcagtttggctgttgttggtgtataggaatgctagtgatttttgtatattgattttgtatcctgcaactttggtgaagttgtttatcatctggagcagcttttaggccaagactgtggggttttctaaatatagaatcatgttgtctgtggacagagatagtttgacttcctctcttcctatttggatgccctctgtttctttctcttatctgattgctttgcctaggaccatcaacatacttttatgtgtaattatacatgtagtttggtgttttctcttttcttaaaaatgatattatgctgtacatatttttctgcaactttttccacttacactcttagattgtagttgtgtttagatttattctcatactttctaatgatgacttaagtatataccataccttatttaactattctcctatcagaggtcatttatatgttcagacgttttatattaataggtagttggatgtattgatcttttccctaatggctatgactttggtgtctttcttactaaaactttaggtcttctgtatgctgaaattgtatgaagatttcaaccatgtgttctgactttggtctttgcacttaaatcattagtaaatctgaaatttattctggtgtatataatgagatatatggttccacctcgccccaccccagcaaccaccatccaatagctaaatagcaccattttttgaataagttgtcttctccccaactgatttgaaatgtcaatttgtatcatacattgcattcataggtgttccatcctcttttctcctttgaactttgtccattcttctattcttgtagcaaaagcaagtctttttttttttttttttttactgtagtactatatgttttaataactgccgggaacacttccttttcagaaatttctaaggaactctatgttattttttccaaataaactttttatcttatcattttgaccattttaagtttacaattcagtggcattcagtacactgacattgttatgtaaccatcagtaccatccatctctagaatattataatcatcccacactgaatctctactcattaaacagtaactctccattcctccctatccccatcacctgatgataaccactatctactttttgtctcatgaatttgcctattctaggtaaatttatataattataataagtggagtccacttatatggcatcccactatttgtccttttgtgtgtggcttattttacttagcataatgtttttaaggttcatctagatctatcttgtgacatgaatcagaacttcattcctttttatggctgaataatagttcgttatatgtatatactatatttcatttattcattcatctgttgctagacacttgggttggtttgtttttaccttttggctattttgagtaatgctgttataaacataggtgtacacatatctgtttgagttcccgtattcagttcttttaggtatatacctgggagtagaattgctagatcataagggaattctatttttaatattttgaggaactggcatactgtattccacagtggctgcaccattttacattcccaccagcagtgggaacctttaacaaaggttccaatttttccacatctccaccaacacttattaaattgtttttttagtaatagccaagtgtcttagtctgttttgtatgtgataacagaataccacagactgagtaacttataatgaacagaaatttatttcttagagttctggaggctgagaagtctaatatcaaggcatgggcatctgtgagggccctcttgctttgtcataatatgatggaaggcatcacatggtggaaaggaaaagagacggtgagagagagagtaagagggacaaaaccatgccctaaataacaaacacacccctgcaataacgacattagtccattcatgaggacagagccataatgacccaaacacctcttaaaggcgccaccccaataacattacattgacaattaaatttcatcatgagttttgaaggggacattcaaaccatagaccgtcctaatagatatgaagtagatatgcatactagatatgcatttccctaaaaattagaaatgtgttgagaatcttttcatgtgcttattggtcatttgtatatcttctttagagaaacatctttttaagtcttttgcccattttcaagttgggttgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactaaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttcttaatttccttttcagattattcattgttagtgtatagaaatacaactgagttttgtatgttgattttgtaacctgccacttaactgaattcatttattagttctaagagatttttgcatgtgtgtgtatatgtgggatccttagggttttctaaataaaagatcatgtcatctgcaaacagagcgaattttatttcttcctttctaatttgaatttctttttcttacctaattgctctgattagaactttcagtcctatgtcagatagaagtggcaaacatggacaccctgtcttgttcctgatcttagggaaaaagccttcattcatttaacattgagtatgatgttagctgtgggtttttaatatatggcctttattatgttgaggaagtttccttccatttcaggtcaactctaaagcatttatttttattaatccctcttttttttttttttttttttttttttgagacagagtctcgctgtgttgccagactggagtgcagtggctgtgtctcggctcactgcaacctccgcctcccgggttcaagcgattctcctgcctcagcctcccaagtagctgggattacaggcacgcactaccacacccagctaatttttgttttttttttttttagtagagacggggtgtcaccatgttggccaggatggtctcgaactcctgacctcgtgatccgcctgcctcggcctcccaaagtgctgggattacaggcgtgagccactgtgcccggctaatccctctatcttttaattttaattagaatcacattggatttatagactaattttgagaaaatagtacagataaatttgcatgttgaaccacagaatgttgtcacagaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaaaaatctattacctttcatttcttagactagtttggtaatggttaatcattttatataatgcaccttaggcttgttttttagtatttgccttacctccaaaatctgtggtccaagtaaatctgttgccatcttaaactgttaaacacttgataactgtttatgagatgagaagagcagagttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtattgtttgtgaagactttgtaaataccatctgggcaatagaataatagaaatttatttatgactcactctacagatcacttttggaggaaaaaatacaaattaaatgtctaccaaaataagaaatgacagaatgactgttgaactaaaccaactctcatgggataatacttttcaaaaatcattttcctttactatagtgaattctaattactctaataactttaccgctaaataacctgatgtggtagctatagagaaaaacagtgaaaaatgaggttcccattaagagtttcacaagtggaacccttaacctggaaactggttagaagggttctatgatcaaaatgacctggatgccctagcagtcatgctaaaactatataaaaaatttttttttcctctgtagtcttgtattagtccattctcaatgctgttgtaaggaacagtctgagaccgggtaatttataaaggaaagagatttaactgactcagttctgcagggctgaggaggccccaggaaacttataatcatggaggaaggggaagcaaacacattcttcttcacatgatggcaggaaggagaagtatgagaaccaagtgaaggaggaagccgcttataaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatcttggaactgttttctttctcagatgtttgggtcattgctgtgattgttattgccataggtaagtatcacaaattttgacaccacttaagtcaaaaaattattgtgaagacatgcattttaaaaatagtttttcagtttctatagttttttcagcttgtaaattggttaaaccgatttaggaaaacctgactttttatttgatatacttaactacctaccttgtgttagtgattttatactctgttatattctgtatatctacttagtaacaaagcctaagtaatacatattttctcaagatgatcagtaatattagttggcttcccaaatgtgcttttgatagttttctaaattaagcaaggacttttctctgacttactatggactgtgtaagtgattatggggagttggatttagatagcaaagagtctggatggaatataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatcttttttttttttttaaaaaaatgcctgcattagtttgtcctaccaattgcatttctttgctaaaaatattttcagctacttctaacatcactgcaacataaaaacatctgtgcagagttcctacagctattatgactttaagaaaaatttcttttggatttgaggtttaagttatttagcaaatcatggaccactcactatgaggccttctctaccctattccctatttccaaaattgcactaatggccaaaattaaatttaaagtatttcactgtggagactttgacagttgtattcactggaatttttataatgaaagtttccacttgtctatatagcttagctagttgcaagaagctatgtaggcatatcatttaaatacccaatttggtgtcttttcatttaaagttgttatttatacatgttaaactgggggattcaaaacaacactatccgatttccctcttatgttctctgaatttaccagattgcagtaaaactgatagggttaaagttaaaattgctgagaggggttagatctataaggtacctcaattaactgtgtcttttaatatataaaaatgtaaaaagtgagtgggtttagaatagaagaaaaatgtacaagtacatatcttctaaagaaaatagggttttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaataattttaagacttttggtactcatggttttatgatatatattccttttatactgatcatcaggtttgggctaagtcataaaagtacaagctttactcataaggaactcaaacttttttcatattacttggttatcttttgaaatacccataatcccttcacttgaatcttaaatcttgtattaatggaacacgatatgcatatttgatttatctatcagttgtatattctaaaagttacatatctacaacgtgagtacaaaatattatcaatggaatatttttacaaatccataaggtttgcgtagaaacaagttctaaagaaaacaaaacaaagtcgcattctgcttattttccttctttgtttaaaatatcactgcatcagaatttttaaaggttcattaacaagtattaatcaaactctctctagctagcagttaatggtttttctgttgttgttttttgcttttttgtgatggagtcttgctctgtcacccaggctggagtgcaatggcgcaatcttggctcgctgcaaccttggcctcctgggttcaagggattctctgcctcagcctcacgagtagctgggattacagtcgtgcaccaccaccaccggctaatttgttgtacctgtactagagatggggtttcaccatgttggtcaggctggtcttgaactcctgacctcaggtaatccgcccacctcggcctcccaaggtgctaggattacaggcatgagccaccgcgcccggccttaatgggtcttttaaagctcaacagttatctgactgttacactcccaaatgaaaggttcaatagcagtagtgaactgagattccaaaattaatttgtccagtgatttttttttaaagcccatattttacagcatagggtccaactgacagttgccattattaaaattttaaaatattttgggaaggtatgatatctttagccaatgcaacataattaatcctgcaaatagtagcacaacttgaggaaaaatagtccagaaaatggtgtgagagacgaaactcctaattgcctttgaactttaaaatataaactgcgtgggaatcttttagaatagatgttaccctttttatgacaggaacatactcgattggaaattcagcatatgtaatggctgaatccaaagctaggctctctttatggatctattattttgtagttccatgttattttgatagctgaactgaatgtgagggtggtttatctttcttcttcagagtctagaggaatgtttctctgactttaatgtgcacattagtcacctggaaatctgttaaagtacagattctgattcattgggtttggggtggagcctgagaccctgcctgtctagtgagctcccagtgctgatgctgctgctgtgcctgggctacactgaccagggtgttgcccactactgatgtgcctatattgttgaagtctgaagaaacactatgaagcttattggcaaatttttctaatatttaagataattgaagtttttaagattcctcatccatgtgtatccttaaaaaaaggctatggggtaataaatagtacttggcttttcttaccttctttaactcttaaaaaacaaagatttccagccgggcctggtggctcacgcctgtaatcccagcactttgggaggccgaggcgggcagatcacgaggtcaggagatcaagaccatcctggctaacacggtgaaaccccgtctctactaaaaatacaaaaaaaaaaaaaaaaaaatagtggcgggcgcctgtagtcccagctactctgggaggctgaggcaggagaatggcgtgaaccccggaggcggagcttgcagtgagcgagattgcgccactgcactccagcctgggtgacggagtgagactccatctcaaaaacaaaaaacacaaaaaaaccccaaagatttccattattttctttgcactgtttaatgtccataatcttgtccccccagattggctgttgtggccttagaaacttcttataaagactataaaatgtctggaggcacttctccacttccgggggtaactggaagcaggctagcaggcacaaataatctcaaattgttgttaaagcctggcacaaaatgtatttcttgtaaactggtatttatggtgatttgggaacgtaattactcttctgcagccttcatctcaaaatacaaaaatagtgtaaggagtcattttaagatcatccaacatcatttacattacttgataaaaagtgggcaaaaggttaaagtattctgccacttttctgtttcatagctctcagctgagaacagtataggataccagtgggtccgaaacaggtcccatccacatgctccctccttttcccttcccatttcctttctttactaattcttctaccatactttttagtcttggaagccacagccctgtctttgctactgcttcagtcctgtattgcatggcatgactgtgcttctgaacaacagatgccttttgtttacataaatatttaagtaatggttttttttaaatgcatgattattttttaactctagttaagcatccctggataagtgacagtttggctaagttagtgaaagttatttacataatttatatatttattacctgtgacaaatagtttttccttttttccattaatggtatttattattttgtataacctaaactgacttttaatgttacattaatattgactgacccaattactttattaaaaatagtggtcagttcaggtaattggggcatatagtgacatggggcaaaaaaaggatcaaattaacttaaatgtttttctagttggcccttaaattcttgagcatttaacccttcaaaaatttttgagcaactacaaaaatgttttgtaattagtttagaaagcatccttacaaaattagatccatctcagaaatatgagacgccatgtaatacaaagttttgcaacgatgtctcctcaggttgaaaacagatgtgccacaggaagacacttcttaatgtaaaagtccagagacatctgaaaatacatgatgtcataaagttgatttctagataatattacatggatttgatacatactcaatgtattccctcaaaattgagggtgttaggccgggtttggtggctcacgcctgtaatcccagcaactttgtgaggccgaggcaggccgatggcttgagctcaggagtttgagatcagcctgggcaacatagtgagatgctgtgtcttgaaaaaaaaaaaaaaaaaaaaaaaaaaaatcaagagtgctagagaccggtaccatttctccccaacaatctgttattccttgaaaacattttgacatgaatcacttcatgcaaaatggcttcaaagataaacatattaaacaggaatttccagtctgtttatctgctggatgatctatatgacttcaaagttcaagtagcttctagcacaaaattcatgtttccagtccttcagtgagaatgagaaagtcttaagttatgaacctaattctcagctttcctgctactctcttacactggattttatcccacttgttatgctactcgtttctttttggtttgaagtcactattttattcagccgttttctcttcctctgttcagcacatacctaactgatgagacccacagagaagtaaaatttacttctctctgagaaggagagatgagagaaaggtttgcttttatcattaaaaggtatctgttttctgttgtttattttcagatgtcctttcttttgaaaaatattcagtggatatatagatatcaataacctgagcaaagagatattggcagtaaatatcaaagaggaaatttacattcctgttccctttgctaaattattgatgtgttcttataccattccctttgaaaacataatgtgtactgacaggctttgacgtaggctttaaatagagttatgttcccctagtccttttatcagacgatctcacttctaccttgtaaaacagctgtgaatccaaaagtaagaatttgtgagccaactgggaaataaccacagaatcaactcattttaagtgcaaggaggaaaaatgcccttttatagaaaccaaaatatattttacttagttttgtaaatttattcaattccaacgtataaataactctgtaaagacattttatcagtttccctgggctgggatatttttagcatatcaaaggaaaacaaaaaagtcctcagattttgaaaagtaatggattgcattgccttaaacccttggaccctgtccaccttctgtctttgaactgaactggaattattcctctgtttgtgctagaatgtgtgtccgcagagctgggaagagatggagatacatatcccacctcttataatgtgaggccctaacctaggttataattaaaagtttgggagcaggatctacaaaggccagctggaaggacaatttcttagtaaaagcaaagtgatgtctttggttacaggaggaaagggaaagacaaaacataccaaccagaattggcggtctgggcctacccagtcctatatacagtagttccttcttatccacgggggatacattccaaaacctctagtggttgcctgaaacctgggagagtactaaaccttatatatactgttttctcttaagcatgtatacctatgatcattcaatttataaattaggcacagtaggagattaacagcaataactaataactaataatatcaattataaaaatatgccagcatcactactcttgtgctctgaggccactaagtaaaataagggttacctaaccacaggtactgtgataccgtgacagtcaatctgataaccaagacagctattgagtaacaggcacatagtgtccacagcatgggtatgctggacgaagggatgatttatatcccgggagggatggagtgggacagtgtgagatttcatcatgatactcagaatggcacacaatctaaaacgtagttctgtaattttccatttaatatttttgaccgtatttgactatgggtaactgaaaccgtgcaaagtgaaaccgtggataagggaagcctactatatcttcttagtctcttaggacacttttgagactaaagccaactaggaaaatagtttttagactctctctgagcttcagggtatctgtaaacatttgaagataatttaatgaatgctgtagttaatattttgccatcttcaaaatagcttcattgttatatccaataaatgtttctttaaatttatgttaatgccttttatctttggcatagattggatttttatttaaaactttatttaaagaaagagattctactactatgggaaaaaaatatttacttagaaaaatatagtggtggccagtcctggtggctcacacctataatcccagcactttgggaggccgaggcgggcggatcacttaaggtttgagaccaggttggccaaaatggtgaaaccctgtttctactaaaaatacaaacattagctgggcatggtggtgcacacctgtaatcctagctactcaggaggctgaggcacaagaattgcttgaacctgggaggaggaggttgcaagtgagccaagatcacaccacactgcactccagcctgggtgacagagcaagactctgtctcaaaggaaaaaaaataaagaaaagaaaagaaaaatatagtggtcttggagaattcagtgacaggccaaaccattaagtctgtcatcacaacagtccttagggaactgcaatattataagtatagtaatgacgcagtagagaaccataatgatggcctccccggcaaagaagaaccaacccgtttacgcctgaggttgcaattttttgaatttttgcagtcagaccctggcgatgaccttgagcagtaggagataaattccacatgcttagcgttccagtaatggaacactaggcataaatgggttattaaagtatccagaattaacatgcttagctgtgacattggaaaggcaatgtgtttgctgtggcacacatactagtaaataatgactggtccgaatttggttttcgtttgtctattaaagtcaatttactaaggcagggagggcccagagctgtgctgtccagttcaatagccatgcgtgactgctaaggacttccaaagtggctagtccaatgtcaggtatgctgcaagtgtcaaacacacactggatttcaaagactaagccaaaaaaatgtaaaatacatctcaatattttggttatactcggttaaagaaaataaaattatttttgcctttttatgtttttaaaagtggcttctggaaaattttaaattacatgtatgactggcatcatctgtctttggccagcactagactagaataataggttttataaagatgtctattgttatactaaaagtgtgacgtaaactttagttatttaggagactcttagtggaatacatgattttcttgacagtgaggggtagatgaggcatcacatacttgaacagttagaaccactatctttttaaaggttctgtgccagagctacagctttaaaatggagggatcaggaaagcatgcgtttgtctccagtctttcccattggccctacatcaaaatgaggacatagttactaagtactttgtgtgctactgctctatttcttgttttggaggggatcaaaaatataagacagggataaaggaaggttttttttacagtgagaccagttgaacatttgaaattattttaaaagaataatttatttcccaggttggtggctcattactatatttttttaattgttcattttctgaataggcttctggaatttaatttctgtacttaattatatttatctttgacatgatctttataccttggtttgcaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttcatga

SEQ ID NO: 2407 - DNA, 43479 bp, Homo sapiens; identical to SEQ ID NO: 2406
  source 1..43479: mol_type = genomic DNA

SEQ ID NO: 2408 - DNA, 43479 bp, Homo sapiens; identical to SEQ ID NO: 2406
  source 1..43479: mol_type = genomic DNA

SEQ ID NO: 2409 - DNA, 43479 bp, Homo sapiens; identical to SEQ ID NO: 2406
  source 1..43479: mol_type = genomic DNA

SEQ ID NO: 2410 - DNA, 43479 bp, Homo sapiens; identical to SEQ ID NO: 2406
  source 1..43479: mol_type = genomic DNA

SEQ ID NO: 2411 - DNA, 43479 bp, Homo sapiens; identical to SEQ ID NO: 2406
  source 1..43479: mol_type = genomic DNA

SEQ ID NO: 2412 - DNA, 43479 bp, Homo sapiens; identical to SEQ ID NO: 2406
  source 1..43479: mol_type = genomic DNA

SEQ ID NO: 2413 - DNA, 43479 bp, Homo sapiens; identical to SEQ ID NO: 2406
  source 1..43479: mol_type = genomic DNA

SEQ ID NO: 2414 - DNA, 25394 bp, Homo sapiens
  source 1..25394: mol_type = genomic DNA
acgccaccccgccctctccctctctgagagcgagatacccggccagacaccctcacctgcggtgcccagctgcccaggctgaggcaagagaaggccagaaaccatgcccatggggtctctgcaaccgctggccaccttgtacctgctggggatgctgggtgagtacccctcccaggtgtcctgcgaacacccgggctcgctccagtgcaaggaaggagttcccagttttacccaaggctgactctgggatccacatgtcagccctctggagcgttgtggagatttggggccactgggatccctgcctgcccccactaagccgcagcttggccctctgtcctgcatgtcccacccgccaggagcacaaccttgcctctctcatgcgctgttgagaaccctgctttacccttccagtgcaagagagactgcaggggggacccgcatttgatggggcccagacaacttgattcctaggctaagttggattttagcagagcattcaggcctccctctgcgaggtcccccactgacagcccagcctttacttggtcgcctccagagacatggaaactcgccgtctccgaggcagctctgatgatgctctggacagacagtgggccgaggcagggtggagccgcctctgaggacgatgtctgagcaaatgtcaaggactcatagcggaagtcctaggccctctcatgcccagtcctgggtcagtcccagaggggcccagccaggccggctgggatgagtacacgctgggcctgctctcactccagccctgggttgtaagcccaaccctgtgtgacctcggataggtccccaagcctctccaggccttgatctccccatttatgaaatgtgggggttgggggtgtgaactggatgaggcctgacccacttcctgaggatttagaaggtctggcagggtgacagaggtgcgtgactctgggctggaaacaggaggatgcgagcagcttccaggctggcagggagagggtccggaggccttgcctgcctgagcagggagcctcagcagccttctagggaaaccgggtgtgcaggtgtgagtgtgggggaatgcatgtgtgtgtgtctgtgtgcatgtgtgtgagaactgtgtgtgggggaatgtgtgagtctatgtgtgtctgtgtgagtctgtgtgtacgtgtgtgagaactgtgttggggggtaatgtgtgactctgtgtgtgagtctgtgtgtgagtctctgggcatgtgtgtgagtactgtgtgtaggggaatgtgtgagtctgtgtgtgagtctgtgtgtgagtctctgggcatgtgtgtgagtactgtctgggggggaatgtgtgagtctgtgtgtgagtctctgggcatgtgtgtgagtactgtgtgggggggaatgtgtgagtctgtgtgtgagtctgtgtgtgagtctctgggcatgtgtgtgagtactgtgtgtggggggggaatgtgtgactctgtgtgtgagtctctgggcatgtgtgtgagtattttgtgggggggaaagtgtgagtctgtgcgtgtgagtctgtgtgtgagtctgtgttcatgtgtgtgagaactgtgtatgggggaatgtgtgagtctgtgtgtgagtctgtgtgtgagtctctgggcatgtgtgtgagtactgtgtggggggaatgtgtgagtctgtgtgtgagtctgtgtgtgagtctgtgtgtgggagtctgtgcgcatgtgtgtgagaactgtgtgtgtgtgctttcatgagcacaatgcggcctccaaaggcaggattatctccccaacacatgtgacaatggcacctgtgcacacatgttcacatggttcttctcacatgtaacaacaacaggtacaaaatgccttctgtcccaaagtaagaggcctgagacagacctctggctggcttcagggaccctgctaaggagggaccaggcccttaaaccccccacctgctcctcacctctggcctcagacttcattgagatagggcggctcccagctgagtatgggaacccgtgtcctgctctagggccctcccaactgaatcccatcatgggtgaggctcctgatggcaccaggcaagtcccctggcccaacacaggccacagtcaggaagacttggaggtagccccttcaccccagtatggggacctccttgaaccccaggaatactcagttcccagtgtctgagtgagccggtgggtaccaagcattccctttgttcagtgggtaacggtttacaaagcacttttaaagccattttctgctgcaagcttcacaacagccaatgaagtaggtgggcccattggccccattttacagtggggaaaagcgaggcccaggaaggccgagtgcaaacccagggtgcagcagctggtgcacagccgagctgaccccagcccagcattcctgccttcacagaggcccctcccttagctaaaagggaaggccaccaaaggcacttccgtgtgcaggaaaatggccctgggacacaacctccaccagcagagatacagccaccagagctggggacaccaagggccagggttgctggagtcaaacagtgcaggcaccctttgagccattccaaggagagaggcagcaatgccagagccctggggacaccacagcctcctggctggcatcggggcttggggacctttggatcctgaggcatgaagatgcccccagcaggcctgggtgctagtgacaggccagggcttcccacagttgctcccctctcagccccagcctgcctggacagctgctggcagtgaggcggggaagcggctctaacacaaactgcacgtccctgactggcctagccgatgcgactctgaaagccagcactgggacgtgggaaagtcatggactctgcagtttgaattccagtctgccacttaccaactgggcgaccttggactagttctgtaagcctcagttttctcatccgtaaactgggtgcaacagtacctcatagaggcttataaggattcaatgaatcaatgcacacagagcttaagtacaatcctggcatatagtatagtaagtactcaataaacaataataacagcaacaactatgattattattattaccagggtcagcaagaaacaatgcgaggtaggagccaatggggaggagggtcttgccagaggcctgcacagccgtcaatctctctacccctcaatcctcttgcacaggctatttattcactaattcattcatttttcatctacaaatattattgagcatctcctgtgcatccagctctgtgcaaaacactggggatacagggaccaaggcaggagtccctgccctcaaggatttgatcagctaacaggagagctgttagagaacacaagtaaacaagcaccaaagaccgggcatggtggctcatgcctgtaatcccagcacttcgggaggccaagacgggtggatcacctgaggtcagaagttcaagaccagcctggccaacatggtgaaacctcatctctactaaaaatacaaaaattagccgggagtggtggcacgcacctgtaatgccagctactcaggaggctgaggcaggagaaccgcttgaacctgggaggcggaggttgcggtgagccgagatcgcgccattgcactccagcctgggcaacagagcaagactccatctcaaaaaaaaaaaaaaaaaaaaggcacccgaaatatttacacattttgaaatactgagtgcaatgaggagaacagcaagttcctcaggcacaatacagtctgcactaggataggaggacatccctttggctgggcaggcagggagggcctctctaaggaggcgaggtctcatctgagaatccgagacctgaatgagggacggagccagccaggcagagaaaaaagggaagagggtcccaggcagagcggatggcagggcaaaggcaagggggaaggacaggcctgagagggtggggctcctactgggagcagggcagcaggcccactgtcccaggctgggcgaggccctggttggatcatcctcctcgaagacccagagctccccacctccagcagggaatgaagggacctgggggcccaggaagggacctggccttcctgggtcactctgtcaccatcagttcagaggggttttccctgcagtgaccaggcggcgaattcagctcaacctgacaaaattgattgaacatctattctgtgtgtgtgtgtgaaattgaacatctactgtgtgtgtgtgtgtccatgtgctgtgtttgcgtatgaacacatatgtgcacagccctgtggaggggagctttggagcaatgcagacctagtttgatttctgcttggccacccacaagtgaacatctctcagggtctcatctataaaaataggggttccttgctgtgtccacctcaaaagatcactgcaataattacatcgggtttattcagagactaggtatggattgaacacctactatgtgccagatgctgttctaagtgctgaggacacagcagtgaacaaaacggtggaaaatccctgccctggtggatctggcataatagtcagggtgtgatggggagacaaacaagacacaagctaagctagtgattatgcgaatactagacggtcatgagaggtgtggagacagacagatagaggagggctgggaccggaagccttggtggggtgtgaggtacctggggaggattcagcggctctcatgagaagatgatatttgagtcaatatttgaaagaagggagtgagcccaccgtgtgggacctgaggagaagcgttgcaggcagaggggcctccagctgcaggtcagtgggggatcgatgaggcagccacgagggccacggatgcccccgtgaggacttgggctttttctcccatgcactggacagccacacaggagcagagaggtgagcataactctcacctctccaggtcctcaagtgcatcttgaaccccaggccagatgcatttggaactccagaagctttcagattgtagaaggaaatactgtgtacatactgtgtgctcttaacacacgcagtgaggcctggggcagcaccctgcgttcaacacattcccatttctgcagtgaaacatgaatttgcacacttagagggatgtaaagacagcaaacaccctcccaccaaatgcattagaacaagacttttagattctggattttgaattgcagataagagactgtgggcctggatcacttcttctatagctaccactatcaccgtgaccagcatcatcatcaccatcatgtacctttcaaggcctgactttcatggtgtccagagggaccctaatactcctctccgggggacagatacggtaggaatagcgtaggaaatgggtggtggcagtctgcagagacgacaagggtcccatgcactgccacagattcccacagagacatctggaatgaacccctccctccttctggccccagtttcccccatctgtactccagagcaagcaggctctggggcctccctggggtagactcccacaggccctgtcaggtgatggagacagggtttctctcctgactctaccaccagctagctgtgtgaccttgggcaagtcactcagcctctctgaacctcggtttcctgatctgaaaatggaggtgagcatggtcccttcttcacagggctgtgggtagaaagaacaagtctagtgcatgagagagctttggggtaggtaaagctctaaacaaaaccaaagccttgtctctgtgacagcagagacaccgtatatggtgcgaaactcatgcaacagcagactactagtgggagagagaaataacaattcaaacagcaaaggtcattctgcccacgacccactgtccgctcactgggacaggccctgggtgagccagattagagacctgaatctgctgttccttcctgcgggctccattcccaggcctctcctggtgtaagcccagtgtgactctatatgtgttttgcacataaaagccgcctaatcataaaccaatcatttcatctgtgctcaacccaagaaagggaattttggtcctttacgaccttcgtttccctaaagccctgatacagctccaactctacagatgactgtcgtttcagaaaagaggggcttctgacctttcaagtcagccaacatataggattcgaggaaggaaaatccagaatcctacccaaaacacaggcagatctattgtatttcatggacatcgatggctgtagctatggggaggtctgtggactgttagaaggaatcactgtttacgggaaaaagggaacacctgacttgcaaactacactaaatcagtcataggtgttttatctgtggaacaaagtggtgatagcaccccgtcttctgaggctctagaaagaaatggggtcttctgtgaaaaatccttgtcctggggtctgcacagggtaaggatgctgtcattttattatcatcggtcattatcacaggcctgtgaatccgggtgcctgccaaaccctaagcaggccacacccttgcctccatttcccagggtgcaggggcggcaggacctaggagtgagccagaggcaggggccaggagtgcaggttacaaagccagccgccctgggctgaattctggccctgccgagttctcactcccatgcaccacgacagcctcctcctctgtaaactgggacccatcatgcaagtcaacaaatattcatctgtaattccaaagcccaaaaaacatttgtaagtttctggcaaatgcatttggtgcaaatcctgacctgaacgaatgggaggctatttataatcttgacacatcccccttagtgtgaaactgcatatgtttcgctgcagacactgccatgtgtttgaagccaggtctctccacacacatggcgaccgtaaggtgccagcgaggcgtggacgaaacagaagtcaagggccaccgccactgcctggggcctccagagatgcagccagtggagccaggatgtcctatttttcaaaaacgcctggatcttgaaatgtgtttaaaaagcaaaacaaaattaaaagaaacctttttttttttaatttggctcaaaaaatttttaaacactgtgcagagcaaataaaactcatgggatgccgtaatgagagccaaagtgagaattatcctgaatactgtgggggcaagaggaatgagagggacagggaggaggatatcctcaccaagacctcagggcaggcagggccaaaaatattgtctctgccaatgcaaagacaagagacgggagctccaggggtgtgataagccgtctgacttctttagccctgaattttgcctgggtttgcccagtccaggccctaaattgtgggagctgcaaggggaggtgggcaggagaaggaaggggtcttcagagaattctcatccgtagccccagttgctcggggtgaggggtggctggcggataaggaaacggcatagcacttccaggcctcgggggcctcctggtctggagtctcggggattctgtccacagttttggcaatagcaggagcctcaggcttcatgaggctaggaaggatggtgcaggagtaagctgtagagcccccagagggggtcagggagaccctgaacacagaccgcagggctcaggggatggagggtgctggtctgacccctgtgagaagcaactaaaaaatagaaataggttatggaccctcaaaacctcaatgttcattctgctccctagattataagtgaaaaacaaacaagcaaataaaaaaaaaacctgaacatattcatggacaggctgaaagaatatacacaacacactcaggaagcttccaagtcagctgtacatctcaccgccctccctccaccagctgctgaaatccatcaggagctaaagattatagatcacaggtgtttgaaccagggggaaggtgagggactgtggaatctaacttccttactttacagattaagaaactgagcccagagaggctgagtggcttgccaaggtcacacagcacttcatagctaagtcttctcactgcatgttttactgactgaacggaatcacaagttcattccctttgatcaggattgcacaccagggtggtgcaggaatcaatgaaacctggggcaggccatcatgggcttcctgctggagggaagggaggcagtttgggcctcactggcaaaagctcaagactcagtgccaggcggctaggtttgagttcgggccccagcactcattagctgcttggacaagtcatttaacccctctcaagtttcctggtctgtaaaatcgggaccaaaataatagcacctacttcatagcactgtggtgaggactgggagagttaatgtgtaaaaggcccggaagagtgaaaacttttaaagtgttggtgatggtgacagtgatggtgatgatgatggtgacggtgatggtgatgatgatggtgacggtgatagagatggaaggagaggagaggaactgctgctcatctggggaccagacaggcacccagaggaaggttccagggcgacactctagaatgcataaatatcttttttattaaagcatttgttagagcattttttaaagaatttcacttggttctccagcttgttcagtctttcctgagaatgttctctgagcaagacctaggctgttctgtgtggaatctgccaagattgtcaggcccagtccctgtccccaggccttcagggtctggctgcacgagcgcttccaggtcagacccaggtggtgttcatctctgcatctccaaagctggcactctggaggagcaattgggtggctgggagcagagagcatgggttttggagtcagacacatggttcgactccacctgccagccatattacccgggacagggcatttgccctctcctgacatttataccaggaacgtactcaactctcgtgatggggctgtgtggaagattaacaacaatatctgtgatgaaccataccgtgggctaagtatgcagcaggtgctcaacagttggcagctgctgttaataatgaacgttgagtatgatgactcgggaaatagagatgctccttgacctacagtggggttgcctctcaataaacccattgtaagctgaaaacatcctaagtcaaaaattcatttaataccccgacaaacccattgcaaacttgaaaagtcgtaagttgaaccaccctaagtctggaccatctgcgcgaagtttccaagttaggagaaggaagtggtgagccccatggcttggctctctgtgctcctggacagggaatcttcccactgggaaagctccccgagggtctgctgccctgggcacagcttcccccagcccaccctactccacagatcagtagcaccagctctgagcactaggccaggaagcactgggctaagccctttacaccgattagctcatctcatcttcacaacggctctagaaagctagtcccatgctcatcctcatgctatgagtgaggaaatcgtggcttggaggcacagagacaggacagacgtgctccccagactctataggcaggaagtggcagagctgatactcagaactggagcagtagaaagtcatcggtgactgaaaacccatcctgagctgtgtagcactgaagggcagatatttggactcccactccccacaggtggcacttcaagctgccttagccctcgagacttagccagagggatgactccttcaaggcagactgccctgctcctgatgggcagctgggatgagagggaggtgggaatgagaggtcaggagtgagaggtgagggcaggacaaaagggcctccttcctgatttctctcgctagctggacatctccctgatggcctcctgaggctgccctgcccactgcaatagatcagatgattggctgggcgcggtggctcatgcttgtaatcccagcactttgggaggctgaggggggtggatcacctgaggtcaggagttcaagaccagcctggccaacatggtgaaacctcatctctactaaaagtacaaaaattagtcgggcgtggtggtgcatgtctgtagtcccagctactcgggaggttgaggcaggagaattgcttgaaccagggaggcagtggttatagtgagccaagatcatgccactgcattccagactgggcaagagaggaagactctgtttcaaaaaaaaaagaaaaaattgatcagacgattgacaactagaccatccttttccacccaggccagagctctgtacacttccctgttggtgagaataaccttccccttccaaggcccgtgactcctagagcaacagccacgaaaggatcttgcagattcaggggaaacttatcacatggccatgatgacttcattacaaagagtcttgattcggggacaaggatgaactgtggagcacatcaccccttaaaattcaaccgccagcttgagaacactcaagcaagaacagctttttcaaagcacacctattttttaagagacggggtcttgctatgttgtccaggctggactcgaactccttggctcaagtgatcttcctgcctcagcctgctgagtagctgggactacggccttgagccattggcccagctaaacacacctattttttaacaccaagcaaaaatttctcacaaacaatttgaacacagcctttcactattaatatataaagcagtctccttgacccagtgccgtaaatccaagagtaaacccaagtcggacagatggaaatcaaaataccgtacttgcacctaactgatcacgctaggtggtgaatacagaggttaagctttgaagccacgtgagcttgctacttcacctcgtccccacccaaattaaacctcttccccagccacagatgagctgctctgctgagagccccgcaatgggcaactttgcccccactccacagtgagaccaggctacaaggaggcagagcttccacgtggtccacatgggggaaggctggttccctgcagacccgtgttccctgggcctgtcgccttggctcccttgtcaactagctggctacactactgtgggcaggtcacgccatctctttgagcttggtcttctccagaaatgggcagctgttaaagataagtggctgtcattcttatcctgccttgggaatgctagaaagtagcaaatgttctcttggttccctttcttgctcatttctttctttccttttttttttcttgtaaagacagaatctcactctctcacccagtctggagtatagtggtgcaatctcagctcactgcagcctccacctcccaggttcaagcaattctcctgcctcagcctccagaggagctgggattacaggcatgcatcaccacgccgagctaatttttgttatttttagtagagacagggtttcaccatattggctaggccagtctcaaactcctgacctcaagtgatccccccacctcggcctcccaaagtgcttggattataggcatgggccaccgtgcccggcccctttctggatcatttctccattctctagaactaaggagctcaaacttttttgagtggaaacatgcgggacatttttacattgcaacccccaacacacaaaaagtgatcagtgcattctgacattctcttttttatttatttaaaacaaaacaaacaaaaaaaaacagggtcttactctgtcacccagctagagtgctgtggcataatcatagctcactgcagggtccaacttctgggctcaagcggtcctcccaccttggcccccttaagtgctgggattgcagtcataagccaccgtgcacggcctctctattctactccatttcatttttaaaaaaattgatggcctgagtgctgtggctcacacatgtgaatcccagcacttcaggaagctgatgcacgaggatcacttgagcccaggagttcaaaaccagcctggacaacatagtgagaccccatctctacatacacacacacatacatgcatacatacatacatacacacatacatagtaaaaaaattagccaggcatagtggctcatgcctgtaatcctagctactcaagaggctgaggtgggaggattctttgagccagggaggttgaggctgcagtgagctgtgatcatgccactgcactccagcctgggtgaggagagtgatatcctgtctcaaaaagtaataataataataattgatggttacattattacaaaggttagcatgagggaatttgaggtagggagtaatggaactggtgtataccttgattgtgatggtggtcacacacatctatatatgtgacattcacggaatcatgcagtaaagaaaaatcaatttcacgtctgttcattttaaaagtaacgttttttaagaagaaaaaaaatcgatagttgcagcccactagatagaattcatatcactcaggggttccaacctggagtatgaaaattcctgtccctaaaacccatgatagtggatagggggaggcagaaagggccattgctcgggctgtgggtgggtgagctggggagaagggagagagtgggaggtttcacttcctgaccctcctctcttctttctgcagtcgcttcctgcctcggacggctcagctggtatgacccaggtaaggaagagccacatggagaaaggcctggggcagggggagagtggggctgtggtttcatcaggccatcggggacctctcgatgaagccatcacttctgccagagtgaaccccaccctatagagagagtgaaccccagcatacacacaggcacatagatgcagacactgcacattaagatgctcacatgcaggtgggtgccctcgacagccgtaaatcacccacaaatgccagatctcatgataattattatgacccgctcaccatgcacagaagacatcccagctcataaatgtaccttgcaaagtcttatttcccacccaatcctgacagatgctccatggtcaaagatgtttagagcggagtctgcagagagaggccgcagactgatggtaaagtgtgtggaacgtccagccttagacgttggagtttagtcgtagaggctgtttcccaaatagggttccatggagcatgttggacaaagggcaggcaacaccgcatctcccactgaagactgacagtgtacaccggcccagtaaaggatctgagaaatcctgcagcgaagaaatacatgacactttttaacccagcactttgcacccttatttcaccacagacctctccttcacattgactgggataacatcgtgctgaatgtacctggggagaattgtggctgaagggtcttgagatgccactgtgcagccagagggggtgacaggggccttggcaggccctaagcacgatctgggccctgcactgacatcctagctccaagctttggcacactgcttgacctcttgagcccgtttccccagctgtgaaatgggaagaaaatctcttgcctggtgaagcggcaacgagccagctcgctgggcggacagcctgcaaatcaccccaccaatgttaggtgttgagacgcgctcgttctccctctaaccagccaagtgcccttggcgagccctggccctgagctttggccccagagtgtcctcgtcggaagaaaagggtagcctgacccgtggttcccgaccagggaaaacctccccctcagaatcacctgggagagcctttcacatttctaaaaatttcttgaatcagtgacacattcatccagctcaaaaatttaaaaaaatataaaaagatctgtagtgaagagtctcacttccatctctattcccgtctatcccagtcgcccccgacgtcgaccccaacaccccaggtaatgactacgtttatttgtttcttgcatattcttcaaggagctctttatgcaaatacacacacacacaccccacacagaccccacacacacaccacacatacacacaaccacaccacacacacacaccaccacaaacaccacacacacaccgcacaccacatacacaccccacacacaccaccacaccacacacacacaccaccacacacacaccccacaccacacacacacaccacacacaccacacacacaccacacacaccacatgcacactacacaccacacaccacacacataccacacacacaccacacacaccacacacaccccacacacaccacacacaccacacacacacactacacacaccacatacacaccacacacaccacatgcacactatacacaccacacacacaccacatacaccacacacacaccacacacaccacgcaccaccacacacacacaccacctgcacactacacacaccacacacacatacaacacacacaacacacacaccaccacacacacatcacacacaccacacacactacaccacacagacacacacaccacacacacacatatatttttcccctcatggagtttgataaaatcacacaagacacatgtctacccatgacccagcaattccattcctaggtatttacccaagagaaatggaaacgcccacacaaagacctgtatgtgaatgttcacagcagccttattcatagtaggcaaaacccggaaacaaatcaaatggtgaatggaaaacaaattggcatgtccgtgtagtgaactatcattcggcaataaaaaggaatgaactacttatgcgtccagtgacatagctaaatctcaaatacatgctaagcgaaaaaagccaaatcaaacaaaataaaatccatgctgtatgagtccatgtctatgacattgtagcacaggcaaaactcatcttttgtgacaaaaagcagatcagtgtttgcctgaggctagattcagggaaattaactataaaggggccttagggaactttctagatgatggaaatgttccatatctagattatggtggtggttacatgcatgtatacatttgtcaaattccatcgaacagtatccttaaaatgagtgcatttcactgtatgtaaaattacctcaataaaattttttttttttgagatggaatcttgatctgttacccaggctggagtgcagtggcgcgatcttggctcactgcaacctctgcctcccgggttcaagcaattctcctgcctcagcctcccgagtagctaggattacaggcgcctgccaccacacccagctaatttttggtattttttctttttttagtagagatggggtttcaccatgttggccaggctggtctcaaactcctgacctcaggtgatctgcccgcctcagcttcccaaagtgctgggattacaggcatgagccaccacacctggcctaaaattaatttttaaagatctcttaaaaagcagacaccagccccaatctcagaccccttgagacagaatttccaggacaggggccatcctgctggacagtgggtgccgagaacaccttgcccatttatctgagctcccttctgactctgaaatctggagccccaccctcctgggtctagcttcggggctgcctgggtcagggtcctctgggaagcccctgcagtgccccagaagggacgaagctcacaaggggcaaggcaggcagcccacggggcaggagggagctcaactgggcgtcctagggagagggcagtgaggggtgccagtggggaacccctcccagcctgacccccaccacacctttctgacccccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttaggtgggtaactagccagccacacgggcaccctgggcctgggcgccagccccgaggagactgcccgaggcctgtgatctagggtctgagcaggctggtggaaggggtggggggaccccagtttataaccactccccaagacacatacccaggagggggactggaaggggccagcacccatctgtaggatggcaatggaggacctagttctgccaatcactgacttcatcgtcgcctctgaacctccattctcccatctgtgaagtggggtggtacttcccgcctcgcaggaggcttagagacaacgtgtgggtcaagtggacctggtgtgccaagcggcactcatgccaggagctcctggtcctctcaaggctgctggctgcccccggccctccccacaccacccattcctccctcaccagagtgtctcattgcagaaccccagaagacaacacctccaacgacaaggcccccgcccaccacaactccagagcccacaggtaagaggattctgaaccccccacagggagtcagagctagcaaataaaaacccaggatgcccagttacattggaatttctgacaaaggtggaaatgtttagtattggtgtgttctacgcaatatttgggaccccatcacctcccaaggctaagcgttagtcagtagttgtccacaagttggggccaaacagcaaggagtgcccaggaagccctcggcgctcagggtggctccccctcctgctctctcctctcctagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtaagtgagacctggccaagccccatgacaccttctgctgccctaggtggggtcacagagcatcccagaaggtcagggaacatgtgtgcagcacagggcactatggagaatacaagggaagtggaggcctggtcttggcctctaagaggtaacaagggttggggtggggaggatgcatccacactcaatgccttggtaatctctgcaaagctacacaccccaagcccaaaggaaccgctggctcagctgccacatggggaaggggagtcggcaggacttccaggaggaggcaaggtctcttcgtgggtctgggggagaaaaaaaaatgtctaggtaggaattatggcttgtgccaaagatggggcacttggaggggtgggccttgcaggaagggcatttgtaaatcccaagagttggcattgcagcaatggtgagaggtgggaggtccctgaggcccgggagtcagaggacagcaggcaaagagagaaacagagacagcccccaagagggctctgcagagggtcctgcgccgtgtgctgacaaggtaaagagaatgatgccgctgtgtggttgaggggaggaggcaggtgagactgagtctgtgagaccccggtgggccaaaccaggatcaatgaagaaaactaaagggaagaaaccacagctgaaacgaagggagaaacggagaaacttcgcagtacgcctccctccggaagtagtgggttcccatggccggaagtgttctcagtgaagtccacactgtacttaccgagagcttacttcatgcagggaccattcctggacattctaaatttttcacatggccttaggaggtgggtgttattattatcatccctttttacagtgaggaggctgaggtttagagaggctaaacctctcgcccagtactatggagcacttgctgggatttctgttcaagcagggtcactctagagcctgttatctgagccttggtgactcagtgtggtcctggaacagcagcagctggttagaaatgcaggtgctcaggccccagcctggaccttccgaatcagaatccacttttcagcaaggtcctcagtgatttatgtgcacaaatctaggaatcactgctcggggccacctggctgtcctgcaagcacgctgggtacctggtgtaaattagtaaaatgctgcccctcccccagcagaagcagctcccaaggggctcttggcctgatgaggagagcaggggctggctcgcagtcccaccggcccctcagctactatccttcctgcaggctacaacctgtaaaaccatacccagggttcttgcctttgaagcttcttctaaatagatttactagggctttgaaggtggatgttgctatgggaactgggcaaagctggtgagatcacaactctctctaaactgagcatgtgtgggcctcagctacagactcccaggccccaccctggcaggcagaaataaatgtgtgcctctgttgagccaggccccacttgctgaaagcctggccctcagcgttcagtgcctgggcagcacgatctgtcccaactgtgaactgccaggactcagggcagtaggtctttccaacccccaggcctcagtttccctcttctgaaaagtcctccttcttcccaaagtgcagcgggataatgacaagatgtttccaagtgagaagtggacctaggtggagcctatttcccacgctcttctcttatctccacctggcatggagccgactccctgctggtggctgccaacagcctccctgcagaaagcgcctatgctgctgtgtctcaggatggtgctggcagctgcccagaggcaccagagacagtgctgggtcaggggaagagccacagagggtgccagaaggagggaagggcagaaaagaaggctgcctctcctggtggtcccacacagtgccttcccctagccagggccccgatttgccagtggcatggggccccaggaagcagcacacaggctcaggttcacacttgcaccctcctttcccattgcttcccctctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgtgagttggccacagcccacagtgggtggaagcagttactactttacctctaggacccggtcagggtgcatgtctctaaagggaagccctggggagctagacagagagtcccagagacccagaaaggatggagacagggaaattggaaggctagggagcaagagtactcagacagcaatgggcatgaacaataataggagacagggcaagcaacaggcagatcactgtcaggcagctgatgagtcatagaacttctccttctaccttctacttttgcaaggtggaagccagaaaatcaaatggtagatagcacatatttgctacatgaatggtaactaaacgggaagtaaaagagagaaatggatggatggatggatggatggattggtgggtgggtgggtgggtgggtggatggatggatggatggatggatggatggatggatggatcggtgggtgggtggatggatgatggatggatggatggatggatggatggatggatggatggatggatcagtgggtgggtggatggatggatggttggatggatggatggatgagtggactgatggatgggtgagtggatggatggatggatggatggacagaagggcggatggacagatggatggatggatcaagaatagaggccccgctggctattggtatgcaatcatatattggtttctgatggtatatgatggcaaggtgatcactaataactggcaaatggtagaaaattaaatagcttataacaagtgtggcaaatgatagctagatgatcaactgttagatgacaaatggtgggtgggtgagtgggtagcagggaatcctagagatagatggagggatagccaaatagatcattgccttccgtgcatgctggtgaatttctcagatgagcaaggatgacggcggaagccaggcagccagcagcttccctcccacagtttttctccccccaggactgggactgacctaactcttcctccttccccaggccaggatccaaaccccgcaggcctggccgcaggcacggtggcaagcatcatcctggccctggtgctcctggtggtgctgctggtcgtgtgcggcccccttgcctacaagaagctagtgaagaaatgtaggtgtcacggccctgagtggctccgttcccacgtgcagagactggaggggctgcactagagtcctccggaggaggggtcatgcctccagagagctgggcacgcaggacacctctgcttcaccacccagccttcccctctcctgcccattagccattttctgccccaagtaacagaaacacaaagtaaacaaaattgcaattgctgatttgtccatctctggagcccagctgagacccactccaggtcagagagaaggtgtggccattcccaaggctgtggcaggcccagagggtgttcagtacagcctctgatggtaggagacacacatcccaggcctagccccaccacttaccactgcccaagatgctgattgggacacttcctctctctgaccctcagtttcttcatctaccaaatgggcaatcgcacaccttgtgaacgcggggggttgttctccttgccttgcagaacttaagaggaaattattcagacaaagaagtgagaggggagagattgggaacagagggcccagcaggacagtgttaggtcctagtgcctgcccaggtctagttctaaacgcctgtggtcttttctcctggggagccgggcacctctacaccatcctcggcctgctccttcggcacaggatggctgcaattcccttcccgagcaagttaggaaactgaggcctacgagagactccagggggcagagcccagcagccctgccctcagctgcacctgccgccaccatctccctcccaggcccagccccatccccacccctgcctgcccccacccatacctgcccccaccactctgatgtgcctttcttgtctcttgcccagtccgccagaagaagcagcgccagtggattggcccaacgggaatgaaccaaaacagtaagtgtccccggaggcaggagcctccctcaggccctggacagaggccatggaggcagagtcgaggctctctgctgaccacagacggagcctgtggctgcttgaagcctctgatctccacggtgcttgtctgacatgtgactgtggccaacagacgtccccacaccagggagggcggaggcttcttgatgggctgatggctgagcggtttctaccgctgaagcctcagagtgtagaaacatctcatggtatcctttctgtccctcgccccatctctagggtccccagcagccctcacctcctccagcagtattccccaacacagtagccagtggatgttaacaggcagcactcacaagaggcctccctgatcaacagatctggaaaaccatgagttaggcacagctaagcatagctatttcaggacttatcagaaccttaatgggcatttttgtattgcccatctccaaagcaaggatccattaagaagggctgtccaagttattttcatcatggaacaacttacagggccagtattaggacattttggtgcagccagcccaacaccatccctggtcttcatcctccctccttccagccacagtcagagacaccctaatggatggagacatggcgctcttcctgcctcccattctgccttcttcccccttcccaagtccacagccaaatccttcaagagggctctgttgaatttgttattaagaaaggctctggaaactttcttaataacatacaggccctcagctcctggagggcagggagcagatctgtcccgtcacctgtgctccagtctcctgcttggtaaatgcttgatgaccgactcacggaaggccccaccctgccagtcagattgctgggttacccaaacctgctctaaaagtctgctgctgatcctgctagcatgaacctcccaggaagaaaggagagggggatgcattgaaggggctgtgggtgcctttgtcctctccccgctaacatcatgggaataggagattaaagttctgggcacctgctggggaaggagacggaggacacagccacaagtctgacactgtctcctaccatctgcccagtgtctttccatcgcaaccacacggcaaccgtccgatcccatgctgagaaccccacagcctcccacgtggataacgaatacagccaacctcccaggaactcccacctgtcagcttatccaggtaagcaccagcgggtgctcccaggcacgcaggcagggctgcagcaggccgccaaggcaggtcacgtgatgcccttgaaggtcgggtgatggcccaaagacagaatggagaccccagggtgcaaggggatcaaacatcgcaggatgcagcaggggtacggaagggatatagcctttgcaggccccagctgtcccgtttgagaccacaaactactcatctggagagaagaatgcactcagaaagccatcaaccccagccttgctgtgacctaatgggcctgtttcccttcagggccttgaggggcctggatggtaaatgaggccccttggattcctccgggctagaagagagccattaagtgggctgcaggagcgctgtactaaaggctcccagactggcactaccaattaagccccagggagcctggagttcagcatcattagtgaacgtttggctgatttgatcaaaacagataaggggttgtcaccggctcataaagcccctgtgatcttccaacccactgtgggcagcggctctaggatccaaggggctctgtggagtcaaaaaccctctgcaaacagcgtcctttctttccccagctctggaaggggctctgcatcgctcctccatgcagcctgacaactcctccgacagtgactatgatctgcatggggctcagaggctgtaaaggtgagcccgtctccagcctgaccccagcaccccagggtcccccacagtcctgggggtgagcagcagccactcaatgcctcccctcagtcccaccctgcccatacatgaataggggacccccagcatcttgattcttgtaaagggaaagacaaacgtcagctgtttaggttatacgagctgatttgacaattagagcagagcaatcatgaactttaacaatcaactcttaaactccattcggaaggccacacaggcagagtccctaagagctccgtgatggagtcacacccctctagagctgccaacctgccagcgggcagaaggagcccctggctcaggacagcagccgtccccaagatggagcccagagcatgggtcctgtccccgacctccctgcatcacctctgcggtgtcttcctctaacacgtttccttctcaccccacagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggcccggcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaa

SEQ ID NO: 2415 - DNA, 5314 bp, Homo sapiens
  source 1..5314: mol_type = genomic DNA
tgatttttgtattttttaataggaaaatgaaagaaaaagctcaatgccttctcttgtcctgccaccactacgccccaccacactcccaccccaaccccgggtggcccctgtgtgtacactttttctcttgaacttaaataaaataaaataaaatttaaaaaaccctaatcagcagcagtggtcaggggcgcacccactgcactccaaagaaggtctcatcagtgtttcgggaaggcaaaagtgtcccagtgaggttggtgcagagtgtgtcccctcgggccaggggcgtcaggcgctgggaggcaatggtacaaccttggtggaagctgagacgcagcaggctgatgctacgggaggcgggagagcagattcccacggccagggtggtggggtggtgcctggaggccgtcgtggaggagcagatggccagcgtcacctggatgtgtaccatgtagatgccatcacgatggatacgtagctgccccttgtccagctctggtccatgcaggaaggagcggcccagtgctgggcccccctgccagtatagcctggggtcctgctgaggtcctgggggcacagggttagagggatgagaggatggaggtttagggaaactgaggcacagggggtcatagagaaagtcagatatagagatcgagagttagagatcaaggaataggttggacgtggtggctcatgcctgaaatcctaacagtttaggaggccaaggcgggtggatcacctgaggtcagcagttcaagaccagcctggacaacagggcgagaccccatctctacaaaaaataaaaagtcagccaggtgtggtggtgcacgcctctggtcctggctactcttgggaggctgaggctggaggatcgcttgagcctgggaggctgagactgcagtgagctatgatcacaccactgcactccagccttggtcacagaaaccctgtctcaaaaaaaagggagggggatagaaggttagagatctaaagggaaggagagaggggtaaggggaaaggggtagagacagggagagagagacaccaggagagagagagacaaaaaaaaaaaaaaaaaaaacagaaacagacaagggtaaagatagagggggagggagagatatatagagagagaatgcagagagagagcaagagagagagtgtatgtgtgagagaggacgagagtgcacgagagagtgcgacagagagcatgagagagagagcatgagagagcgagagagtgtgtgagaggacgagagagcttgagggagagtgcacgagagagtgcgagagagcacgagagagcaggagagagtgcaagagacagcatgagagagagagagatcatgagggagagagagcatgagacagcgagagagtgtgagagagaggacgagagagcttgagggagagtgcacgagagagtgagagagagcacgagagagcaggagagagtacgagagacagcatgagagagagagcaagagagagagtgtgtgtgtgagagaggacgagagagcttgagagagagtgcacgagacagagtgtgagagtgagctcgagagagtgcatgggagagtgtgtgtgtgagagaggatgagagctacagagctcgagagtgcacgggagtgagcgagagagtgcctgagagagtgagacagacagcacgagagagacagcgtgcgcacgagacagcgcgcaagagagtgcacgagagaattccccaagggacgcctgctcgggtcacaccctgaacgccaataaaagctttggctcccaggaccctttttttttcttgctttccacccgctggttgagtgtgtgtctcagagagctcccctaccttcccgttggccctcttctctctaggatctttattttctttagagacagggtctggtcctgtcacccaggctggagtgcagtggtgcaatcatagctcactgcagcctcagcctctggggctcaagctatctcccacctcagcctcccgagtcactgggaggtggcatgcgccaccatgaccagctaattttcaaaattttgttctagagatggtggtcttgctatgtttcccaagaaacatagtctagaactcctgggctcaagcgatcctcccacctcagcctcccaaagcgctgggatcacagccgggagccaaggtcctcggctatatttcacgtgtttcatctcagcgtctcctgtctccgcaacttatctgactgacacacctgagcctcactctcctcctcactcaaggctctcctggagactggctatcttgttaggaaggaactgaacggggtcaaacaggagccccaagggtgtttaccaggctttgcaaatttcctgtaagagtgacacctggtcccctgtcacacacttaggcatgatatcatccaccagaagaaagagctgtcctgtgaaagacactgtcaacacctgtggccaccacccctggtgccccatcgatgtggggctggacagccactctccagaaaggggcctcaagaccaaattacaggaaaaatatggcaaaggccggggagggggggaagatatatcaggggtcagagacccaaggagaagagagagcaacaaaggtcccttccattacaaaatggaaggaacaaaacacgcaagcgtgcagtaattttagtctctggggatgaaccgtggaaaaacagaagaggaagaagcgttcgagagaggctgggaggaggtagagacttccacctagagcagaactgttcatttcttctccctcaaggcttcttgccaatgccacccactcagataccacccccccacccgaccgccgcgactccactttaaatgaaaatccccaaccctggcatgcccggattccccacccacctccttgcctgattttttctctaaaacctgctcttggcctgttttactctacgtggcattgctctgtttttcacatgttcgtttttatttttttggtcatctcctcctcggtaggagtgatagtagaagggaagctcaccaggcagggatttctgtctgttttgtgcgcgactgcagtaccggaacagtgcctgcccactgcagatgtataattagtgcttgtagcatgaatggaggaagggtagcctttcctgtgagcgttttcgtttactaacaaaacccctttgattcttccaagggaggagatcgaatgtgaaggactgagagggaaagggagagaaaggtagtggatgcccagaaacacaaacctgctcgctctctctctcctctctctctctctcgttctctcccttttcctttttctcttgggaatgatctctttctcccccgccctgtttttcttcttccccctctctgtctctgtctcttcctctctgttattctccttctcttttcctctctctggctttctttcttttctttctcttatttctttttttctctttcttctttctttttcctttctctctctctcacctccctccctctctccttccttccttcttctctttcttttccttccttcctttctttctttttcttttcctttcttctttttatttatttatttgacagaatctccctctgtcacccaggctggagagcagtgccattatcttggctcactgcaacttctgcctcccaggttcaggcgattctcctgcctcggcctcctgagtagctgggattacaggtgcctgccaccacacccggctaatttttgtaattttagtagagacggggtttcaccatgttggccaggctggtctcaaactcctgggctcaagtgatccacccgccgcgccctccgaaagcgctgggattacaggctccagcaaccacgccaggtcgcctctctcgtttttattctctcttcctctatctgtcttttttctctttctccgtctctctccctctctctcgttctgtctcccccgcctgtctccctccctccctcttccactctccctgcgtctctccctgtttctttctttccccttcttctcctgtcccgtctgtcccctctgtccctctctctgttcttttttctgtctctccctccctttctctgggcctctccctccctctctgtcttctctctgtctccccctctccgtttccctccctatctctccctccctctctccctccgtctctgtctgtgtctctttctctctgtctctccccacttgtctttctacctctccttccttctctctctgtgcctcttcttctccccgtccctccacgtcccccgtgttacctgtgtgattcagctgcagctcagctacgtcccactggaagaaaagaccagaaaacagggcacggacgtaagcagagaggttctatgtgtcccctgtgccaggagctctcttttctctgtccatcctcctttccacctctcatcccacggcgcgcactggtgattttatttcattttatttttttttactcttaagacttcttaaagaggaagcaggtctgaaccagcggggaacgtgaagtcgagaccttcaaaagaacttcttcgtttcccgaatcgttttcctggatgtcactgggcgcgagagcaccgcgcgcagcggactctctacgctgcaaaggcgcccggcgcggtccccaaagggacccctcccccacccggagcgagtggctggggccatcccgtcctaggaggccccaggaagcccccacgcccagccttgtgaagcccccagcagcctctgagtcagcctgccgggggaacaccagagccgagtcatcttccatttccatgtgtgcctacctttcccatcccgggatctccctgtacctcctggcagggctgcctgtctcgtagcccctacaccgggcagcctggtccccgcctcgcctccctgttctggtctctgtctctgccctaccagatcttcctctctggcctctttgtacccatctcattctgtcttttcggtcacgcgcctctctatgttttcttcccaacttttccatctcaactcaccccaagtgactcgagcggcagctgctgctgagcctgtgcgaagcgctggatgcacaccacgaggcagatcaccaagcccgcgaccaatgggaccaaagcagcccgcaggacgcacccatagggcctgcgccgcaccgagcagcccgaaccctcctccggcatcgccgcggcgatcacctccgctagcgcaggaggggcgatgggggcgcggagcgctgccgagaaggaaggaaggaaactgcagccccctcccggggctcctgggcgtctacttgcttcaacctgtcaggggaccagcctgcccctctctgg

SEQ ID NO: 2416 - DNA, 8449 bp, Homo sapiens
  source 1..8449: mol_type = genomic DNA
caattatttaaaaagatttcaataaaactgcctggctggctccgggccgcccctatccgctcagcccgtgcgccctcctcccccaccccattctaccatgggaagttcttggggggaggccaaagtcccttctagaggtggcttcacccttttcccaggaacagtccagtttcaggaagagggagcaggcagcagactggctggaagtgtcaggtgtgggtcagccggtggctgggcactgcccagaatgaaggagatggtctgaggaaccccaggcctcaggttaggaaggaggggcacaggttcttgttggcatgagtgtctggaaaagtaaagtatcagtgagctccatggttgacttaactgaaccctcatcccactcaccccatctcctcctcagctctcgacagccacaccaccagcctcccataagttgtaggccttacctgtccctccctgcccaccccaccctaacaagcagaccaagcaactggaggctgtggaggaactttcatcccaggtacaagttttctctcgggcccctgggcccctgctctgagtccctgctctgagtccctctgcccctggactccccatgcctcagccccatccctcactcttaccaactcagtgcaaaggactgtcctaatctggaaacctgaaagctgtcatctcacagatgtagggaagagaacttctacatgactctgactccagtgtccaccatgaccaagttttatgtaccttgttacattttgagctttgagcataagtcctaaaaagtagtaaggtagagctgggatatgctctggacatatcccaccctcccttctctccccttcccctgtataaaacctaaatcctaactcaccctgcctgcctaaggccacatctgggcatggttcaggacagatgtctggagttcaactaaaacagactttagaaccagcagagggaaaaataactcgagatcttaaagatgggaaggccaggctgggcacggtggctcatgcctgcaatcccagcactttgggaggccaaggcgggtggatcacaaggtcaggacatcgagaccatcctgactaacacggtgaaaccccgtctctactaaaaatacaaaaaattagccgggcatggcggtgtgcgcctgtagtcccagctgctggggaggctgaggcaggagaatggtgtgaacccctgaggcggagcttgcagtgagctgagattgcaccactgcactccagtctgggcgacagagcgagactccatctcaaaaaaaaaaaaaagatgggaaggccaattgaggaacataaggaggttgccaccctgtttcagggtccctagggttgatcctcaatggtaccccactgctgtcttgatcacagtgaagtggagcttcgatggtacccccgctgctcccttgcgtacttcactgaggcagctctagtgccccaagtggccgctactgagaaagtacaacctcagtttgggtggccttctcgaaggatggagaaacgctgctgtcatcagctgtggagccttaactaaatccttaatgtctccccctaaaagatagcgtaggtcccaacctagtagttactgaaacaaaaaagtatgtgccagggacttctaggtggaaatagaatggagaataagattgccctaagaagttattaatcaaatagaggaaacagacaaataggcaattacagtgttgatttatgggagagtcctgaggggaccaggtgggaaggaaatctgattaccatgtctttatggaggggattatggagttgaaaatacccagaagtcctaacaaacttacctagtgcgttgtgtatcatcagtcaacttccaatccttgttagagctgaggccagtccaatatgaattccctgaaccaccatttggcaacagtgaatttaagaagtagtaagagtgctgaggggagattcagagagaccagagatacatggagagtgatgagaaatatggaagaaaatgcacaccctagggaggcctcagctttggcaagggggctgtatatatgacagctctttggtaacttgtccctgaatccatcaagtgccaccctgcagatgcaggctcactgctaaatttgccttccagctgagtaagaatctctgccagcctttggaggggagtcattctgtgtgctgttctggccccaaggaactaatccctacaatccagcccaccaggtgtgggacctctctgcctgagaggccacaagagtccaggaacctgtcaagcagcccagggagctgaccagcaagctgagatgagatacacattaaagtagaggccgggcgcagtggttcacacctataatcccagcactttgggagactgaagcaggtggatcacctgaggccaggagttagagaccagcctgaccaatatggtgaaaccccgactctattaaaaatacaaaaattagctgggcgtggtggcatgtgactgtagtcccagctactcaggaggctgagacgggagaattgcatgaacccaggaggcggaggttgcagtgagctgagattatgcaagtgcactccagcctgggtgacagagtgagactctgtctcaaaaaaaaaaaaatgtagatatggttaagtttccattctcatgccaactctaatcagttactaggggctgcctggaccactgtgctgagaagatgcagaggttgtttccaagctcagaggtcaagagtattatgattctcagtttcttccatggaaaaggaatggccaccccagccatgtgtgcactgccattcctgacttgatgacatatgtccctttacctaatagtacccactgcagtctgtgagtaaggatatgcttactgattgtggataaatttcactgaatgtggccagcttggaagacagagtttcacattgtttttggctctcctgccaattttttgaagtaagtgagatgtaaaagcagcttttctgatgcattatccatcccgacggacagcaggtgtctaaaaagcagaaagagtgtgatagcagcaacagttgggatgaaagtgactactcagcaatcttttgctaacaatattcccccagagctaatctcagcaccttcatggacttctatgatctttgcaatctttcttttgcatcccctggaaacaccatacctgtccttacttagtaaaaagactttaacattcaacaacattacttcttagcaatctgggaggtctgtcttaatagggctgattttattaccccaatttctgaacaattgcagtccaccctgacactttacctaacatctcttgggcccatctcctccactccctaaagcacccctcactgcacatcctccactcctccagcactggccccctccgtccctctccaatttcctacaagcagaaaatgttgtgtactgttttgcagaaactgagctctctccttttccctcctctccacctcaaaatttctcttctctgttcttcttttcctgactatccataagaaataaatatccctctttcttcaacatcctacatcccaatgtgcacttctgatcccaggccacctctctccattgctttgttccatcagtcctaccttcatcactcaaaaatcattccctctccactagctccctctcttctctctacatatgctcatgtccccaccctgctactcccttgagctactgtcctatggcaacttaaaggaataaaaagaaatccctgctgggcacaatggctcacttctgtaatcccagcactttgggaggccgaggcggggtggatcacctgaagtcaggagtttaagaccagcctggtcaacatggtgaaaccccacctctactaaaaataccaaaaaatacccaggcaccatggcgcatgcctataatcccagttactcgggaggctgaggcaaaaggatagcttgaatccaggaggcagaggttgcagtgagcccagatcacaccactgcactccagcctgggagtgcacttcagtctcacagagcgagactccgcctcaaaaaaaaaaaaaaagaaatctgtatggccaaatggaagagggtgaggagataagtggcacactgaaaggtaggcaggagtgatggaagccatgttaaggatttttatttttatattatgaggaagagaaagtcagtgtagggttttacatagaggaattttgttcactagctatatcccaagtgcctgggcacagtgctagaacatattatatgttatgtattccataactgtttatgtaatcaattaactggaatgctgtagattgggtgacacgatcagatttttgtttgtaaaagattaccctggctccaatatgaagaatggactgcagggagaggagtgagtaggaaaaacatttagaaagctgttgcagatatccttgcaaaagatgaggatgggcaaaaatccatatggatatatagacttggtgatggaaagtgaagggaattcctctctgaaagagtggaagatgaggacatctgctgaaagtgagggagaaggagttactatggagagcaagctgaccattgcaaaggttgccaggcagtgctgagagactagagtctcagtggcactgagcagaatgattccacaatttgtcacaccttgatgctgaccatgggcagttgggttcatccagagttcaaattttgcccatcaggtacactagaaggataatggaacaaagaagtgagtgagccaggtgcggtggctcacgactgtaatctcagcactttgggaggctgaggcaggaggatcgcttgagtccaggagttcgataccggccagggaaacatagtgagaccttgtctctatttaaaaaaataagtgagtagttgaagtgatgggctccaaacccatgttaggtagggagagaagtgtggacaggagaagctgatgggaagagagaaaaaggggaatcagttgattggaggcctggactgatgggaagggagaaaaaggggagtcagcagattggaggccttgatgagatcaaaaaagtgtggggaaaacctgcaggagtggtgggcagctgtgatcagagtggaagtctgaaaccatcctttcgccggaagagcaatttgggaggtagaggtctaacatgctgctaagagcagccctggcatggaactgatggtcacagagggtaaggttaaggaaatgagggcaaggggtgtctgcacataatcttgctgtcttatgcctggggagatcacccagatgacccccaagctagacagagcctaaacctgatcatagcccaaaaacaccccagtccccttaggcgtggcaccttgcctagaccctcagcctgttttgatacagccttgcctcttttatgtgtccctttccccatctccacttactggctggggtcctgctttcaaaatgaatggacaccccatcctagttccctacaccacaactcccagctccacctcactgtgagtgctgagcgcctcactgccttgccccaccaccaggttgcactccatgtcagccagtaagtcttaccctttggggagatctcagctataacgaaaattaattaaaaatgaggtccctgtctttagaaagatgtgcaaaccgccaagttcacatccaaatttgggggcgttcccagatccttgtcactgatatcaaccggaagaaaccttggacagtgtgatttggactgctggctgccatcctcctctcccctacaggatgagccttggagctgggtgggtccccctaaatctagtatgcagcttggtccttctctctgttggccaaggctgaacagctcatgtcagccaccactctggttcactgcccctttcctgaacacctcacaggcccctgggtgatagactcctgccactactatctccttgctccaatccatccctcccttctctcctctccccagagcggatacctgctgagccgcatgtgaagaagggcttcagtctgttctccatgttgctcagcttctgctccaaggccctcctctgttgctcctcactttgcaaggtctccttcgtcttctgtctgtctgcctggcaggcctgtagctgcccttcggccgcctgatgagccctctgttccacctgtagtgcttcctgactctgcgccagctctctcctggacccctgcagatcctctgcactctgtcccagctgcgttatcttgaggcggagctgctgcctcaggctgctgttagtgacttccagaaccctgttcgtctgctggagctgctgagacacctgcagatctgtttggccacagagatttggtggatgtcttctccagccctgccctagtgccctgagactgcagcatcagccctttttctgcttcttgcaactttttgcatcacaggctgaaatacaagatttgactgactaaagcgtaaggaggtactggattaggtgaggacaattcaggaagacaacagccctggctggaaaccaaacccaaagctaaggaggtggtggtagtgactatgatccctgctgaggaagatcagctttggggcgagagtcgggacgaaagtcgttcggtgtaagtgggaagtagggacagccttactcacagcgcactcccaggcagatggcggtcactcctaacagcaggcaggtgaggagcaggccgagcaggaggtatcgcaggcaggttgtgcggccttagggggacagtgggatggatgagggcagtcagcccccgtaaagaatgtagagaggaagggacaggtccgtgggggagacccctggggaaggcatccctaagaggagggcggtgcagagctgagggggcaagcatggtggtttctgtcgggtagcggggtgtttcgcaggtaggggagagggtgttccagaatcagtgctggtggggactcgggggcgttacctgggagaaggggaaggaaatatcagacggagagaggggaaggggggcaggtaggtgaattgggaccatccgcaggggggcggtgcacgtcggattcaggcgcaccggatgaaggtgaatgtggcacggcagcccgggcgtcggaaggactgcgcccgggtttatcccggaaggagctgcaccccgcggggcccagcgccatccgcagccgggacaggcgcgagcacttggccccgcggctgccccgcacaggcacactcacaggggagaatccgcccgacagctggtgacgtcacggctctccaggacgcagttggctgctccgacttgaccgctgtcgaggggagcatccagtgtgagaccggaagccccgagtgttgccccttctcctcctgcgcacccgcttcgccctcgccactgggaaactccagtctgccctacgttgcctgctagagctgctctgggacacagtgtcactctcctgagttcctcctctgcccgggactctctcggcttcctcctgggtctcactgtatcttttcccgggaccccctcatctctcctagttctccctttatcgtttcctcagaggccccttatctgtcggctccaaaccctctccccctttgctctcatccatctcccatcacctcttttccctcccatggctccccgtttcccattagaactcatcccccacagggctgccctatccctccgcagcccttatctccccgaaaggggtctccaccttgcgggaggaatctttcttcctcccctggctcccatttatcctgttcctattcttctgtttcctaagaaccgccctcctcctttccccagggtattgtgctctcaagaatactgagggccatggcatgggggcgcacgcctgcaatcccaacactttgggaggccagggcaggaggatcacttgagcccaggaggtcgaggctgcagtgagccatgatcacaccactgcactccagcctgagtgacagaacaagaccctgtctcaagaacaacaacaaaaacattgtggactccccagctcaagacacagccccccaacaaacacacatcccccaggctctccagacctgctttgtcccctagtacagaagaagccaagcttgagggcacccctaggactgcgggcacttgaacattctcgtaggtgatttccccatcatcatcagcccctgggtctagagagaagagaaaagggaccaaggtgggatttgggaatgggatctgtggggcgggaagtggggatgcaggatcaaggggaggcctcatcccccttaccctgtcctaaccggctggagatgctcttcttcaggggagccttcacaaacctcagatctgcataggtgatggcctcagccatggtcctgagcagctctgcccccactcgtcttccctgtcatccactgtcctcccttgcccctctcgtctctgtccgtttacaactaggctctgtgttccctctgtgactgcacggcttagcaatt

SEQ ID NO: 2417 - DNA, 11300 bp, Homo sapiens
  source 1..11300: mol_type = genomic DNA
tgttctaattactaccttttattctaatgtgaaccatggccctgaaagctgataacaagcttggctgagcagagggaactaggggtcggcagaaaggattatgggtggaaaacattggctcttccttggggagtgatgctggggaaagggaagagagtggctcagcctgcaggtaaataggctagaaaagccaaggccaaaggctggaggggagaggacagtcagcatgtccagcctggggtctgggtgtagggttatcccttctccctgtgccttcccatctcgtccatgagcctaggtcttggagccttgtgttggaggctgctgtgatgtcaggaacggggatctgtctagcttttggccacttcctgggacctcacgcccctgttgacagatggagattgggcagcagggccttgctgcattgttatctgctgttccgacttggtttgtcttgtccaagggtgacgaaagagccaggcaccagggtctcatgggatgaggtacagggtgggagatgggggaggggctgggggctgaagggagcaagaaagctgtagctgtgtggggctggcaggatgttgaagaccgcctctgctgctctcacatggggactggagagagaagcagcaggttgaggttggggtcacccatttgttgtccctgcccctttctaacatcctggacctgcagagcagttaaggactgtccaccctcccctgccccctgctcaggtccaataatgaccatcatggatttgtgtaactccccacagccccccaaccctgttccttcgtctgtgaaatggacatcccaggaatgttggagagtggcccagcgtcacactccttcacctgcccacaaaggagctggccctgctggggatgagctgctggtgaccagatgcccctctgcaaggcccttacctgggcccagatcctgcttggtcacacccagcccagaagacgggtcctccagttccagtgactctgcaaaggagcagcaagtccgtttgtcacttgaagtgcagcctacctgacccaagatgcctgagggcagtgcttcccacctagccacaggcttagtgcctgggaaagcaggtacccagggaaggacagctgcaagcagcaacaaagaggtgtaatgggggctcgagtgagaagggggtgatgaaatgagatgggtgggtctgtaggactcctggatgctagaggatggcgcgtggatggatgaaattcacagatgaaaggactgacggataagtgaacaaatatgagtgcatgtaagaggagagatgataaatggacaaataggaatgcacaggtgggtggatggataaagggctggacgcatgactacgtcactgcccccaggagctgccatcctgggtgtcctggtcccatgtgcttcagaggggacctcttgcccctcaaccttcctagtccttcctggtcctctgacactggcacagtgccactgcttaccactgcagttatggtgcccgcggcttctggtgttggggacctccgtgccgttggggaagacacaccagcagtagccgatgctcccatagcactggagtggcagatagttgccgttctcgtcgcacttgggcctgaatgaacccgggtggacagcagggatgtggctgacctcttcctggcacttggtcagtactgaagcgacaggcatgatgaggacacagtgagtgagtgagctctgaaccagggtctgagcagagctaaagacccacacaccactgctgtgggcttaatgccttcttcccaagtggctttactcactccagccatcacacggatgggaaaactgaggcctagaccaacaaggtctgagatcaaaaaggaagtgaatggccatgtgtccaattcacctcagaagttgatggtttcttctgacactcaaagcccattacagttttgggccaggcacagtggctcatgcctgtaatcttagcactttgggaggccgaggtgggcggatcacttgaggtcaggagttcaagaccagcctggccaacatggtgaaaccctgtctctactaaaaatacaaaaattagctgggcgtggtggcacatgcctataatcccagctactcgggaggccgaggcaggagaattgcttgaacccgggaggctgaggttgcagtgagctgagatcgcaccactgcactccagcctgggcgacagagccagactctatctcaaaaacaaacaatcaaacaaaaaaacaccattacagtttggaattgcacttgcgattctgattctagagaaaagcaatgggcaccttggtaagtctaagcttcctgttactgggagttctcaagtagaaatggggtttaccgtttgttggagatgtcttagaggggtttaagcatcagctaggagttggagatagcatgtaaggtgccttctatgaatctgatgcagaaactgaggccccaggcagggtggccctttgaccttctacttcaggaccctgaatcctagagggaaggggacttgtccaaagttacatagcaaattagagacagcaccgggatagaaacagcactctgtctttgggtctaaaaacatcctagtctgcattgtccatgaggtgggaaacgcccaaggctctcttggcagcagctgtgaccttggcgccctcactggattgcgggcagcactggggcaaggtcattacaaggattcctttctgcagtgtttcgggcaggttctaccccaggcaccctgtgctgtaccatcctctatgagagaggtcacctgtaccctgtggtgacaggcctctgtgggcccttaggaacccttagacaagatgggggtgggtcaggggagggggacagccaaaccaagaaggaacagacaggagagagagagaagtgagaaagaagtgagagctgagaggatgggagattccgcggtgctgggaccagggagtgctggaggccccggcctcagcagcttcaggagagccccgagggtccagaagccctggcacgctaaagctcccactccctgtacctttcggtggagcgtcagtgggcttttgctccaaggagtgcctgctcatttcaaacaggagccaatggtgcatccagctctcaaagacctaatacggatagaggtggaggtcaggttcgatggccaccaccaagcccctacactgcctggctttgcccctggggacagaaacatgcagggccaaatagggccccaacacccgggtccagctgcagcctggttccctcttaaagacccctggggctgaaccccacatactctgcagcatccaggttttggaagtgctggtaaaccccttcagcttcctgagaatggcttccccagcccaccctcaccccacctctcctagccctgccctagacaccagaggaaagagagagttcccatgcagggaaacctgctgaccttccagtctatggtctccatggtgttcttaaggtgtctcaggttctccgggaagctccccttcagtggcgggtacaccttcagggggtcagcattctacagggtagcagggcaggaaggatggttcaagaagagctccctggcaggcagtgtgaaatgtgtagcccacgttcccttggtcttccattctgaggaatggaccagagctacaccaagcctaaaccctggacttcagccatgatgggaggggaggggagggtacgggtaagggtagtccagctgttcagctacgagactgcagcgttgcgagtcgagttccagattccaggccagctctaccaacaagccccagtgtcctccctgtggatggctgctcagctttcaggtcttacctgctccagcaggtgaggacccaaccttgactgcccccagctaggttgagtcctctgcctctttcttcacaaagccccctgcacttctgtcatcacctggtcacttgtctgtctcccacactagcctgggatccccatggcttcaggagctgggtccaattgctccccattgtgggcccagagccttgcacagtgctggcataggacagacacgcagtacaaatttggggagaaaaaaagggtgtcttgagcaagtcacttccaaactttgagcctcagtttctttttttatttttattttattttattttttgaaatggagtctcactctgtcacccaggctggagtgcagtggcgtgatgatctcggctcactgcaacctccacttcccgggttaaagcgattctcctgcctcaacctcatgagtagctgggattacaggtgactgccaccacatccggctaatttttgtatttttagtagagactttcactatgttggccaggctggtctcgaactcctggcctcaggtgatctgcctgcctaggcctcccaaagtgctgagattacaggcatgagccactgcacccagccgagcctgtttatctcaaaaatgcagaggccagactacatataacatttaagggtcacccttgtattcagtaatccagagagcacatgttgaaagtctgccatgagccaggtatacaggccttggagcttggcccggccagggtcctgggtgggcaggcaggaccacccagctagctccctgcactcacctggagcaggtgcatcacatggtcctctgtcatgttgccatacttggtggcattctgcatgggctgtgggaggaagtaacagaaggttaccagagctggtccctggagcagggggtatggagcaggagccggttgctgggatctaggtaagagactggaatcgcaggcacttggtcaatggttccatctctgccacctccaaacatgagagctcgagcaagtcactttagcttcctgcctcaatgtcctcattggtcaaactggcataagctttcctgcccagggttttgtccacagcacagtattgtgaatataaatattgtcaatgcatgatagcaaggtctttgagaatgggagaggacagtgagatgctataggaaatgagaagcactttgtaaactgtagagggctgagccttcctcccagggatggcaccaagagactcttcacctgtgccctccacacctggggagcccgattcttcctgaggcaggcactgtccctcccgcagcagtcaggacccctccccaggtgggctctcttccctgcccctccccttggcactgtcctccatccaggcgggataaccttgcccctcccaccaccctggggctgtccttaccccctggggcagggctcccatgggcagcgcctgcatcagcagcggggtggccatgcgcatcttgctcacaggcttgggagctgtggggacaggaacgagggtaagtgtggccccggtgcccagggaggagggtatcagacccagatgaggaagggctggaattccaaaccggagggagaggacagtgggcccagctgggtgcagggatgcgggtctctgagttgagggatggtgggaggtggggggtatcaggatgtaggggtgcacgcacgcttgggaagcttcatgcgcaggttctccagctgcaggttctgggaggtgactgtcagtttgtccagccggccctgctgctggtacaggaagtaggcggtggtggcctggccagcgaggagcagagtcaccaggatggaaaagcctgtgtacagggctccgcggctgcacttgctgtgggaggtggggaggataggtcagaggaggatccacagtggtggctgccccaagggctggctaggaatggggaaatgtatacccccatctccattagacccctaagccacccctaataaacaatgcatttgaagcacaaacagtaagctggctatggaaacacagcttgaagacctcaccccacccctccttccaaccatcgatgtgcctgaagtcttccctggcagagaccctgcagctgccacgggcctgagttgaacagagaagagcaaagaggcatgctctttgtcctctctggaccttagggtcctgcctgtgcgatgaggggttgaggtgggggggtcttcccaggctccctttgccgtgcggatctcctgatgatcagggctgccctcaaggggaacaggtttggtttttgttttgttttgttttgttttgttttttgagacggagtcttgctctgtcgcccaggctggagtgcagtggcgcgatctcggctcactgcaacctccacctcctgggtttatgccattctccttcctcagcctctccgagtagctgggactacaggcacccgccaccacgcctggctaattattttgtatttttgatagagacggggtttcaccgtggtctcgatctcctgatctcgtgatccacccacctcagcctcccaaagtgctgggattacaagcgtgagtcaccgcgcccagccttttgttttgttttttttttctgctggcaggatcaaccaggtatgttattttttttaattgacaaaaccaaaaaaaattgtatgtgcttaccaagtaaggggaagagggttttcacccctctgcccaacctcccaccctcacagtgaaatcagatttaaggagaaaaggtaaggaagtgggaccgggacagcagaaaatgtagcccacctgggaagaagtggggcctggccattttaggagtgggctgggggaggcttggacaatgtcaggctgaagcagggccaggcaccacccactctggggccatcctctgcccaggctctccatgtctttgagcatgtccctgccaatctctgtgcctctgttccctcatttgtcacataggtgcccccacctctgcgattctagaatttggtgggtttcttcttttaagcaagatctcactgcaagcgccaaagtatttcaaatggtaatatccatcctgcagggggtgggcaggagtataggtgcctgagcctgtgtggcctggatgaatttctcatgctccctggactcaccatccagaccctcggacctcagcaagcccttgtatctgtgggacttggatgcgactggggggtgcatgcatatgttacagtacaggggatgtaaggatcctgcccctacaccccaggagtttctgatctgttctttgacgaccccaggggtgggactactaagaccctagtccaggtgttgccaatgtgaaggtgttgggaggtgatcgggccacaaggccttctccctcacgaatgggattaggtgccctgtaagacggcttgatggaaggagttggttctctcttgcccttctgccttccaccatatgaggacacatcaaggaagcccctcaccaggctgggtgtggtgactcacgcctgtaatcccagcactttgggaggccaaggcaggtggatcacttgaggccaggagttcgagaccagtctggccaacatggcgaaaccccgtctctacaaaaaaatacaaaaaacttagccaggcatggtggcgtgcacctctagtcccagctacttgggaggctgaggtgggagaatcacttgaacccgggaggcggaggttgcagtgagccgagatcacgtcactgcactccagcctgggtgacagaaggagactgtctcagaaaaaaaaaagaaagcaagctaggccgggcgcggtggctcacacctgtaatcccagcactttaggaagccaagacaggtagatcacctgaggtcaggagttcgagaccagcctggccaacgtggtgaaaccctgtctctactaaaaatgcaaaaattagccggacgtggtggcgagcacctgtaatcccagctactcgggaggctgaggcaggagaatcccttgaacctggaaggtggaggttgcagtgagctgagatcatgccattgcactccagcctgggcaacagagtgaggctccatctcaaaaaaaaaagaaaaaattagccgggcgtagtggtgggcacctgtagtcccagctactcaggaggctgaggcaggagaatcacttgaacctgggaggcagaggttgctgtgagccaagatcacaccactgcattccatcctgggggatagagtgagactctgtctcaaaaaacataacaaaaaaaaaaaaaaaaaacaagaaagcccctccagaactgtgagaaataaatttctgggtgttttttgtttgtttgtttgtttgtttgtatattacgcagtctgtggtattctgttaaagcggcacaaaacggactaaaacagacccattgggaactgcaaggatgaggctgcaccctgcctactccagcaaccagcaaggatggtttaggacgctccaggagtcccttgtgcctggtaactcatgacatcacagactggctcattctcattggcttgctgcgtgccagtctgtgctttctgggataaggcccagcccaagggagagttattcgggaaggaaacagcaaaaacccgacggtgggcggggggcgggggggaagtggggagaccagacaggaagggaaaacaaattctacttcttggccttctcaaggaacacgggtggcctagcctgtgttcaggctctccagcctcatcctccacctgttcagtgcttctgcaaccccacacccaattctagccccagctctacctcccacacacgacatgggacagtaccttcccctctctgcaccacagttcctcaggaggcctaagaacctagagattcaccctgaagacgagaccacataacctggattggaatcctggctctggagtcggttagttctgggaccatctaagttgattaaccctctgtgtgagtaaaatcgggtaaaacatctgctccaagggctgttacattaaataagatgatgagggtaaagctcttggctccacacctagcacattgttagcactctataaataaattacactcagtgcaattctcaggggagttcgtagttaagtttagcatctgcttttcttcctctttatgcatcttgaacgcctgtcccctggttctggtagagtgccaactcttgtcacccccctctttatttcctcatttacactaccttcttctgcaattaaaaaaaaaaaaaaaaaagccaaagtcaggagccaaccagagctagcaggaatcgtgacacagatgttgccaggcagaagcattcacaaaagcctccaaaacaggctccagtctggaatggcctaagcacacatagccagctttagaagcagtaactgaataaagggaaaactagacaaggattagacaaggggacatgcactctgaacactgagcccacctgggtctgtaaatcactgagtggtctgagctcagaggggtctcacctccccttcccacaaaatgcacctctgaaagggggccaaatggtggagtgagctaacactttgatgtcagactagtcctggttcaaattctgcctccaaccactcactagctatgattacttgggtaagtcacttaccaatatgacctcaatttcctcttctgtaaaaagggacaacaaaagtacctgattcatagggtgactgtaagaattaaaattgagtttagcctttacgtatgtaaataatcacagtactaactaacagtggctgaggcctggtgacaggtacacagtggatgagaactattatggctattatattattactgagactcagggagaggcagtgatttatccaaggtcacgcgtggcctagacctgaatccattcctcacaaaacagtctccctccttgccatgggattccctggggttttcacaggccacagctctaatggtctgcagcaggttaccttgttccccagaacatagcttgtcataacatctctgcagggttctcccaaacccctttctgcctggcaacagctgacatcacacctagctgtaagtccctgtagatcgcaaattactttttggagactgggggtagcaggggcattggggtaatagccttctagccctttttgagggaaacacatgggtgaggctattttggggctgggaagtgggggcctggtgtcccctggatggctgtgctggcctctggctgcaagggagaggggcacaggcaaggacatgacccccgtcaaccctgagccccctccagaaatttaaccagagcctgtccctcctttcttgcctgcccccaacatctcacaatccctcctgtgatggcagatgtctccatctactctacagacacctgcaactatcattcccttgatccgtggtaattaggagggaactcctctgtgaagaactgcttctaccatcctcttttagaaactctttctccactgggatcttgaacattttcaaaatctggtgcaaggtctttatttatttatttattttttttgagacagagtgtcactgtgtcacccagggtggggtacagttgcacaatcttggctcactgcaacctctgcctcccaggttgaagtgattctcatgtctcaacctcccaagtaggtgggattacaggtgtacaccaccacatctggctaatttttgtatttttagtagagatggggtttcaacatgttggccaggctggtctcgaactcctggcctcagctgatctgcccgcctcagcctcccaaagtgctgggattacaggcgggagccaccaggcacagcctgttccaaggcctttaacctagcattcacagcccagctttagtgggatctcaaagcccctgcatagcatgtgaaactctagggagagaacccatgctctcttctgcttttcagaaggaggcggtgtgatgcaaggaaagttacaaactcctgctcttaaaggaaccccctcatttgacaagagagggagccggagcccagagcaggccaaagacttgctcaaaatcacccaaaaagtcaatgttagagtcagagcctgaatccctctttcctgtgactcctggccggtgcttcttcccagcacatgcgcacggctctgcagtccaggatcggtgtgccctttcctggtgctcacacatacctctccggggccccagggcgccggcccagcatgggcagttgctcattgttggagataaggtcgcgctggtcatccatgactggcttctgatcttcccgacagctcctgcttctcctcctgtgcatctgggaccctgaccccccggctcgcctcttaaagtcggtgctggagaggaatctgattcgtccacagaaggccactccgcccacttggtagatgtggaagtgaaagctacaaaggctggaaataccccactttggtgaagctgccttttgcggggcaggatgtggggcgggggggctccccaggcag

SEQ ID NO: 2418 - DNA, 11300 bp, Homo sapiens; identical to SEQ ID NO: 2417
  source 1..11300: mol_type = genomic DNA

SEQ ID NO: 2419 - DNA, 11300 bp, Homo sapiens; identical to SEQ ID NO: 2417
  source 1..11300: mol_type = genomic DNA

SEQ ID NO: 2420 - DNA, 38423 bp, Homo sapiens
  source 1..38423: mol_type = genomic DNA
tagatgcattataaaataatatttattgtgtcctgctgaaatggagcttgtagtctcatttcttaggcacttacaaggtaaaatttatgaaccatactttattaatgggcatttacaaatgcctgaaataaaaggtgacttgtagaagggataatatatcttattgcaaacatgacacctagcttctggaatacggttagtggcatttgccactagtgagcataatttccatgttcaaatgaataatgaactaatcaaaaaacctttttttgaggaactgaggcactcagacacaaaacacaaaattaggcactcagacaaaaagcaacttattagccagttggagagagagctaagaaataccatatctatataattatcagagaatgtgataaaaagctactactctgtacttgtgtgccaaatgctgtaaaagtataaatagagggcaatatatttcgctttggacgggaggttttagaaggccgcacaagagggatattcagtctgatgcttgatgtagacagaagggagagaagggcatcccagacaacatgggcaaaggcatgggaggatttggtgggtgtgtgggcccatgataattctgtgtggctggagccttagggagcaggcaggagacagcctggaaggtctgatgggtcagattgctaaggagtgtggttccccaggaaaaacattttagtgtggaagtgaagtgataagatcctcattttagaaagattgctctttatgtaatagcaacccaggtaacacgtgataaagcaatgatctgagggagtgagcatgtagagggaaggtgtattagagaattaggccaattaagggcacatgcctgagaggagccatatagagaagttggaattgacaggacctattctctgactagatgtagaggggatctggggtgacagggagaatgaaggagccaaggatgaaaaagttttctgccttgggtagctgctgattggtgaagcagtgaagaatagcagttctgcacccagcccctggagttgaatcctggcttttctatttactaggatgagctactgtgattcagccttaaagacttcacctttctgtgacccagtttcctactttgtaaaagagagcatggttgtatcttcttcagaaggcagatgagatttaatgtttcttatggactttaaatgagtaaatgtaaaacaggacagggaatagtacatagtaggcactggataaatgttaattattttgattatggtggatcattagcataggaaaaacacaaggaaagcaagttgggaggtcagaaacagacctgtgagttagattttggacacgctaaacttgaggtgacttctgacatctatgcagagatgacccataaactattggaaatacaagttgtaaatgaaagagttgagattatgagcatttaaaaattctctgatgaataatctatgtaattatttgcctacaataagaacttataagaaaaatatttctcatttgcaaagatttggccattttccagtctcagaattgatccatcccaaacccagagacttgtacagggctgttgagaactgtctgggcaatcagccagcaacagttaataattatcatccattcctttatgaattcccaaagtctgcaagtctctagagaatgtattagtcattactttcctccctcaagtcagaattcaggacttttttaatggtcctttgtcgaaatgtattaacactttcatatgttttgaaaaattactggacccctcacacttggatgggggcttatttaagtctaaacatgcacagttgttttttttaaccactaaattgttcagcacaattccccaaattcttatctcttcttttgtttctgttatttttgtgatttttagtagtggaaatttacagtttctcttattttatattaactcatcagaatgtttatgacctgaaacccctgcctgtccaaaatgcatatagagagctctatccaaccttctttaattaaatgggcattttcagcaggaaagttgagtggttatccagatagcaatggaattaatatattaatatatttactttgagctgcttttagtaccttaaaatattactatatgcaaatattcatttagtagatatttgtggtccacctattatgtgtcaagcaaagtgccaggtgtgtgtacacctaaggccaagtaccaggtagggagaatccacaggaggtaaaaaagggccacatggcagagtacaagtgcatggcccttggtgacaagaagtcttgaattcaaatactgtcttcccagctttccagatttgccaaggtattcatatgtcagccttagtgttaactggaagaattaatttctactttacaaggctgtcatgagtattgacaacaatgtatgaagcatctagtttagcagttggtatacaaaataagccctcaatgattcttacaggctccctatcttcaaggagctctccattattatttattattattattattattattattatttaggtatatcccctgttctctcagtctaactggggaggcagatatagcatcaggtaagtagactgtggtataataacgaggggaacaaacattgcttataacaaaatatatctgaataaggagggatgagagttaaaagtttgatatacaacattaattttgcataatactagcagcatttctgttgtaagaagcttatttcatgaatttagattagcatcttctgaagatttcaggcctagaacagcttataaaaaatttcccgaactttgccatgcacaggcacattcctgtatgagcaacacctcatttaatccccacatcaaccttaaaaggtaggcactattattatccccattttacagatggacaacctgaggtacagcgaggttaaagtaacttgcctaaggtcacatgactaagaaaccaggatgcagacccaggcactctactgtcagagcccacatttatgaccactcattatatttcctcttattgtctttgttcttcaaacttttttttttttttttttttttgagacggagtctcactctctcgcccaggctggagtgcagtggcgtgatctcggctcactgcaacctccacctcccaggttcaagtgattctgttgcctcagcttcctgagtagctgggactacaggcacgtgccaccatgcccggctaatttttttgtatttttagtagagacgcggtttcacaaccttggccaggctggtctcgaactccttgtgatccacccaccttggcctcccaaaattctaggattacaggcatgagccactgcgcctggccttcaagcttcattttacaatcagtagacactgtcactaattattgagaaaatttatacaaatcaagggaaattcagagaaaagtcaaacagaagaaaaataatgagtctggaagaaaatatagcccagccattccttctctccaggcaggacctaagaagtgctctctgtggacacggcccaaaccagacaggccccttcctgcctgtgcccgatttccaagctggcccaaccaggctattccctcatagcctgtgtagtttacagtgttctacagattttttaaatcatattttaaacaagcttcactttcttcttctaagaatcatgagctgcaacattcctcattttctcagttgagtccctcagtaaagcccaaggtgtctgcaggcaggactgtcctaacctactagaactttccaccagagggctctgtctctgagacttccattttgatgcacatttttaaaaactggcacactttggtctgatacaagatcctgttccatgatgctttgattttatagacctcttggtcacagtctagttcatctggaaagttgtggaggggaaaataagatcacatgcattttacagaaggaaaatctaagaactaagacctagagagaagggtgaacagataacgtgttcatgaatcaggagattcatagcagagaaactgagaggagagacaagagtagggtgtcctgagtccaaaggctaccttcagaattcctgggctctggcttcatcccaggtttgctcttctggaagacctaacagatctaacctgcttctgatttttatttttgacaatatgcataggggcattaggacactagtaattttacttgagtgagcatattaggaagaggaagagggcaagttagagaataaagatgtttgggaatgagtcttcaacgcatccacagagtgaggagtggttttattttaggataaacgcagcctgttcagtgtcactttggaattcctccatcctttatgaccaagcctctttcctccttcctgcacgtctcttcttggggtgctgtctttcacctccttacaactggttaggtgcttcagctgacctcttagttggtctgcctaactctgaaagtcttctccctccaaagtgcctttacactaggaacagcctctgatgtatgcatcctgatattattttattttatttttattttttgagacatggtctcactctgttgcccagcctggagtgcagtggcaggatctcagctcactgcaacctccacctcccaggttcaagcaattctcccacctcagcctcccaagtagctgggattacaggtgtgcaccaccacgcccagctaatttttttgtattttaagtacagatggggttttgccatgctggccaggatcctctcaaattcctgacctcaagtgatccgcccaccttggcctcccaaagtgctgggattacaggcgtgagccaccgtgcccagctgcatcctgatatttaatgcttgccagaatttgattgcaccatgcttattggcttctatctttttttttttttcgagatggagtctcactctgtctctcccaggctggagtgcagtggtgtgatctcagctcactgcaacctccacttcctgggttcaagcgattctcctgtctcagcctccagagtagctgggactacagatgtgtgccaccacacctggctaatttcgtatttttagtagagatggggtttcaccatgttggccagactaatctcgaactcctgacctcaggtgatccgcctgccttggcctcccaaagtgttgggattacaggcgtgagccaccaccccagccggcttccgtttatctgtaattcccacatgtacaatgtagtgaggaaaacaaataattagttatgctgtaaggctgaatgagatgagttttagtgatagaaggaccaaagaggaaaaaacagcagtgtgaaaagatccctgattaattttgattcctgataccagggaaagctttacagaagaggtaccttttgaggtgggcattgaaggacatgtaaatggacatggggtgagggcacacatctggctgggacactctgccacacataggcaagggactgtgagcatgcatggtgcatctggagaggtgctctgaatacaccccactgatccaggcccctgctcatttttcatgcttctctcacttggaggccctctgtcttcctcattctctatccaaatttcatccatccttcaaggcccagcttcagccctgccccctcataaggtatttttctgactgttcatgctattacttgcagctgcagttcagcgttaactgtagtgtctgtgctggaattgtctcctgagctacacaagagcagacattatgcacatcttctactttggggccttgcagctcctaacatagtgctaatggtagttggtgctagatgagtctatggattcatttactgggactgatgtctttatctgcctaattgcagcccattgctgtccagcctaggactattcattgggatttaggagttagccgattatacttgctaacacataagggaaacacttccttaaatgatcatatgaatgtcttgctcagttgtgaatgattcttcctcattgaggagagttaatgcctgtgtaagctggctggtgatctgtttgtggggcatgccagggtggcggcactctgcctcagcttaaactctagttctctgagtctttggaactgggatgaacccagtttcatcatctgcaccatcatctcccaagttccttctggagaatgactctgcttcttgcaaggtcttctattttgatggttggattatacccagttccccagaagtgtgagaaatataagctggtcagttccttttggagagtgggaatactgggcatggctgcttcttctgctgaggctgcttggagtgatacagaaggaaatcttggccagaaagaaaatcctataaggcttctgaagtagcactccaagaaaagtgtcccagcagtctctagaccctgcagaaagaacattttccaacactccatttggagagtgtgtctacatggctgagagccacaactctgacagagacccacacagcactgtcatctgtgtttggacttactaagcctgttatgccctgcacaaagattcccagacaaagggatgagtgtgcttatatgcagcccacattctgctctccaagccatgcactcgggggaagggctgcatctgcctcaagcgaagggtacattttcctaatttgctcaagatgcgtggtgaaggccacgcaccagggatcttcacacatactgactgtgagcagagcatcttggctggtgtgccatggcctattacaggtgtgcaaaatattgatccccttctcccacagttactgggcagggttgttacctccagtcacaagaggcctctagtcatatgcagcttccagaagtgagcaatcttgcttgtttatcccagtgtgccataaaaatattattttctacatgtgctatgatgggaagaagtttgggaaaactatactaggtaacctgctttgtcattcattcagaagggagtcatttcaggaagggtatgcatccatttgtccatttaggcacaagctatgcccagcagaaggtttcctgctttgcttacaggctgagatgtggcagtttgcaatctcccagtaagagttgggcagagaagatctggatccagggaacctgccagtattggtggttgtaactcagtttccagagggagaattcagcccagcagcctagatcacaatttcatagcttgaagtcccaggaggtttactgtcctgtgtgctggctttccccatctgtgcaggagagaagcgtgagaaaatgttaactgagaggtgctgctggggaactccagtcctgcaagttcccagaggagttaagcaaatggcacgggggaatgccttagatttgcctcatgctggggaaatctggggtagcagggccttgttctttgctgagtccctcatgtctgctccagctaccccccatttgggaggccctgagcaattaacttcttagcccagaaaagagcaatgggagggaatgggggcgggggcatatttggaatggattttgattatagacttgaggcaacattcaggttcaagctacctgcattccttgttcctagttgacccctagtttttttgtatcccaataactccactttcacctatacatagtggggactcactgccagcatctcctgtgctctaggcatttagagggctgcaaacaatcttcccattggtttgaggagtcttaggttttcaattaaatactgacccaataattgttatctaacttgtctttaaggatttatcttgagatgtcacaatccaggattccatgattaatccctcgaattttatctccttctaagttaagttactcttgttcctccaactctccttgagatcctggcacaaatatgctgggcaccctgaccctcacttcttgcctgtcctccttttcttctcctcttctttcctcattcctccccttctttttctttccctccttccctctcctgatcactaagaaagtaaatgtccctctatctggttgtccagtccatttggcttatcttttcaagcaaactgccctgtgcttcaagtcctccttaaaaggaagtagcactgccctgcttgtcgagctcatagatgtcctccctattgccttataggatcactctcaattcgtactcagtttagcttcctgcttggtaactcagctattaaacaggaatacttagaaaacatgattctttaagcaaccctaaagctgtcctgattgtagcagcagtgaggaccttcagatagtgacaatccctccttagatccccaaaatttaaagtcctgtcagagggctttgcatatgacagagaaggacataaggcacaggcataaggcacaaggcacttggcactacaaatggttgtgcaggctgcgtgtggtaaaagagcagctgagggagcaaatgaactgaaattcagcttctgctccattgcacccatctgggcatctggcatgggcctgtgtttgctcagagggaagcacctgttttctcattttcacactgtgagctagcagtgaccccaggtattatacgggatggagttcccataccgtagttcagaggcatagggacttctgcatttgaagggtgggatcagcatcccaagtaagataactcgtggatggccattgacctagggagtggggctttgtgcatgggtggaagtacatatagaccaaaaacctaggcagtgggtcctgagaactacaaggagtcccaggggaaccagctagcccctggttggatggaccgggtgcaccagaatggctggaagagttaggaaagcaaggataaaaagccagaaaggggttaccttatcagcaaactgcacttcggaataaactgtgttcactggctcttccttggagggaagcacctgtaaaacacacatcttcccctcagtgagggagcccaggcccatctacaagtcccctttcctaattctgcctctacccaccatccttccctggtcccacatttactgggtggcctcccctttggcctcagttctgcctccatccaactctggagaggcttaggatcaggaagggataaggtgggggtgaatgggtagcagttgggcagggtctcgggggtgaaaaacctcaggggccaagaggagggatcccatggttcaggatgagtcctgctcagtcaggattttagctttccatgggctctatggatccagctgccctatcagtccaagcacagcgctagactgaccaggcagacctcagtctcccccttgattccttgcagactttaaggaggcaggctggtggggacacaggagagggcgatccagggtggaggggagggaggggcaggcaggtaaagggcggatgggaggaggggtgtggaacagtgactctgagtctgaggaaagcaagccgctgctgctagaccaggaggggcattcaagggaacttgtctgtcagttctgttgcctcgtagcccccttagcaacctgttcaccacgttggtagtcacatagcagccctcacctcactccagtagctcctctgttgtgtggcccctctagggggcgccttgctcctagtcatggctcatctaacctggagccgggcccactgtgggacactcagtgcctcagcccatggaggctgccatggggtgacaatgggtcacgttcctgtcctcatagaaagatccgtggcatcacttccctgacatggtatttcctggttggaacctctggactcttggccgtggctgctttctagacaacaacaagcagaggcaatggctgcccatgactccctgtcatggagatggtggcacaggggtgtccatgaattgcatcagctcaccttggactgcaggatttcatcatagattctggactctgctggctgggtgttccttgaagccatgatatatgtgtatatggttttctttgaggcagcatctgtctcacaaataaatatagacccacagtctgtgaaaggtggtttttttagcaatgatctattccaatgttctctttttaagatgaagaaaggaagcccccagggattaaatggctgccatcctttgaaatggatgcttggatcctcagaatgtctcaggagtcacttggctgaggcctcacccacaggtcaatgggaattctcttctactctagagtccagattaggccaaagacaatttccccaacccctccctgtgtggccagtcaaatgtagctcttctacccaggatctcccttcatgtttctgacacttaccactgactgtcttgcatggctagttgactttccatgtcacggtcttagttttttaacttgattgattctttctagttatatactattttacattcttttggtgcagaccttgctgtaaccatctcaatgttaagcccatagtagatgtttcatgaacatttattgcttgtttgattgattcacagtctgtttttgtttgtttttgagacaagttctcactctgtcacccacgttggagtgcagtggtgcaccaactcatggctcactgcaacctctatcttctggactcaagtgatcctcccacctcagccttctgagtagctgggaccacaggtatgtgccaccacacccagcaaattttttgtatttttggtagagacagggtttcaccatgttgcccaggttggtcttgaactcctgagctcagctgatccacatgccttgatctcccaaagcgctgggattacaggcatgagccacagcaccctgccagttcacacagttaataaacatttattaagcaccttctatgtgccaggctctgtgtgaggccccagagaagaaaagacagtagacaagtctttccttttaagaatgtataggctagaagagacattcacgtcagtgtactcctttgctttggtactaacacagaacattttagggtcaaggtgaaaaaagaaggccagaattttgggccttcataatccagggcaccaacatacctacaaataacaggtctgagctgagcagtattacagggctccaacattcagagtttagtcctatcacttatttggtgagtatgagacaaactgagtgctctctcttgtctcatttatagatgcaaagaatagccctttctcttcccaagagtcagcgagggattgaagacaatatctctttgagggaccttgcagatcacctgtggttcaagcaggctatgccttctccccattgtgaggccatttgagtatggcacacgtcacaaatcccctcccccctagaatgcctcctccgtaccatgccccaggccaatcagttatcagtatactagctaacatttatcaagtacttactatgtactgggaattgggccaagtattttgtatttctaattccatttaatctacttaataagtatatacagcacaccttattactgtgaatattttacaactgagaaaatggaagcttacaatgataaaaaaactggtagctgataaatggtcaagctgggactttcacgcctagactgactgcaaatcacgtgcttagtcttaaccactctgttgggaactccccatccctcccaattgttattcaaggaactttgtggctgagaacttacaagggttcttagtgaaggtgttcaagcaggaacctgaggaatcagacccaaaggagagtcaggaacatggaagcagaagttccatgttttttattgtgattggtgggaaaaggaagttcttgggtggacatgggatgtgggtgaatcggagggtataatgattccttgagggtctaagatcaggttttctgaatggagaatggcacaactacagaatgatccagagggattcagagggacatagtgacaaccatggagtacaggattagtatatgtttctcaatgactctccaatagtcataatcaaaatacaatgaaattggaagtgaccctggagatcctctagtccaaacatttcacatgtgagggccctgagctggaaaggtgaacacactcgtacagtgaagcacagcttgttcatgtatgtactaagctcgaacccatgttctgggcccaccagctactggtgatctcaggaatggattctgaagaccattcagggtaatgtcataccatcctcagagccatcattctgggaggtggtggggtggagatcggaaaaaggcagattccctggaacaatgggcctttcagctaaaccttggataaatggcttcagtcccaggaggagagaaggtgagtttccacattttaccttctgggaaaatcctaccttgtcttctcttgaacaaacggaacaaaaacactgaagacagaatgagaacaagcagaaagaacatagccagcacgctcagcaacccggtgtggtgagtacggaagcccattgcgatgtctggaaatagaagatgcagtgagtcttgattctcaggaaataggcccaagaggctgggcaggtttgcccacagtcaggggcattatgaaaattgggtgccctccgaaggagtgccaaagctcctagggaaactaaactttctgctattaaaagccaggatgagaaattgaatcagagagttgatcaggggctgccacagaacacccagaaatgtctagcatctctcagaaggctttggcctctttcccagtaggcttcttgggaggtgatgccctcagtgaccaggccaaagataaaggaagcacatctccctagagaatgtggcccacgttcagaccttgcagctcctcagagtgatctctgagactcaccaggagagatgggcagagctggttacctgcacagagctgccgggcagagatggagtcagaattgttgctgacagggttctgggctgtacacgtgtaagtcagctcttggtcctcaggagtctggaagatttgaaggacattaccctcttctcccaggggactccaattgtatgtcacattcttttcttctttctctacagagcatgtcagtgtgacattacaggtgctgttcacagatgccattaaactctgtgtaatttttggtttcccaagccgacctgtgggggcaaacacatgagccaatagtgagctggagctggcttgtactagtttgtgggagccaattgttaaattctcagaaatttgcaagccatcattaaaaattaaattataaaaacataattaaataaattatgttaaaaataaagataataaatcctcaaaactcatcactttctaatcctttttttgacattttcctgctgtctatgctctcgaggttatctacatctattgtatctgtcctttgttaacagagtatctgtctttctaattctgcatgtcttaaaatcagccatggtaggagtattaccccacagaaatttgcaattgctataagctaggactcgatttactgttttgatgattgttgctctagacttaagatagcaatggaggaatgcagatgaaacttaaaattgtataatatctgtagccattacattgtgaatagcacaaaaaataggaagtattcttctggtatttggaaaccattatccaattcagcaaagaagtcgctcgtgtcattgataaacaaatgaagctccaatatatatgtctttgttgaatcacttttttcttattatttaactgaaatgaaaatatcaaccgatgtttgtgttggaactatactcatacatcaattacaactataagctgattagggatataaatgcttagcaaaaatcaatgaaagcattctgtaagaataattggaatttatcctctagtgccctctcagcaaaataaattctatatagaatttacaataaagactattatatatttattatcattaatgaaactgtgtgctacacatccttcaagtcaataaaatttgtactaaacataaattttatatatatatatgaatacacacacccaattaagagctaattaaatatttatcagcacacaactacatgaaataatctttttttttttttttttgagacggagtcttgctctgtcacccaggctggagtgcagtggcatgatctcggctcactgcaagctccgcctcctgggttcaagccattctcctgcctcagcctcccgaggagtagctgggactacaggtgcccaccaccacgcctaattttgtttttgtatttttagtagagatggagtttcaccgtgttagctaggatggtctcaatctcctgacctcgtgatccacccgcctcggcctcccaaagtgctgggatgacaggtgtgagccaccgcacccagccaaaataatctttaaaattttttttcattctgttttctggtgtatgtatattttctttattttttaaaaactatccatggtggaaagctataatttctttaaaagttcattaaaatgtttttacttaagcaatcaaaaagtaaactataaaagttgaaggctagtaaagggttactaaagaacaataataattcaagtgatagctaggactggagctggcatggggaagcgttaaggtcttttcttttaccaggaataagaaaatgaccacatttggagttaataagttcagcgccctctcagcaaagttgctgtggtggggtttgtttcttccactgtagctatgtgaggaagggaatagaggagtcagaaggaactggtgcacaactagaaaggcaataaattcagaagtgtagacacaagatataagaaccattatcttgcgtttgtgaaggaactcaacatgaacagtaagaagctgtaaaaatgtttgattccaagctagccagaaattctggtcctaacaatcttttagagggatctattccatattagaattagtgaagacttggaataaacccaaaacaagtttggggtacagacctggattaactataatagtgactgatacgatatcaattagtagaaagtgaacaaaattttgtgtgtgtgcgtgtgtgtttctttagaaatttgatttacaaaaatgcctagggagtgcttggtgtttaccaattgttgggggtaggtgttgaggtaggggacagtggtaaagaagaggatcccatctcacttttctcagcaggaacagaggtgttgcctgcacaaagatgctgggaagagaaagtcagagtcatggccgacagatcttcatcctcccaagccaagattgtggaagccactggagacctggttcagaatccaggctctactgctctctagctatggaataatggagaaggtatacagattcatggagcttcagctcccttatttataacatgagggtaaaaatttttccctaaatacaattgttgtgaggattaaatgagattttgaagataaagattattctaattacctatttacttatctatcatctatctgtctgtctatgctggtatgcacattaattatctatggaagacacagaagaagctggctacagccactgcctctgagaagagagagttacatctcattgtattatcttttgctctttttgtgcatacagtgcttaaatatgtatagtctatatatttttaaaatagatattagaatgccaaacacataaatgatgttcaataaatgttagtttccttctctttattttcccagctaactacccataaggtacagattttattgtatatacagtacagctttctctaagatattactgtactgtgtcctaattgcacgtggtagaagactttctgaagattgggtaggcaaaattaaacatataaagggttaaaaatcaatatcttaaaattgaataccatctttattttctcagctaaagttctcgaatgagttaaatattttctaaagggttgacatttgggtatggctctttgactacattattcaagcctagttcagagccttcttcatctaggaagtccttcataatgagattttttttaagggataaggattaaaaaattaatgattactagttattgagcatttactttaaggcaggcactatactagggagctcaactaccattatctcatttaataccatcaattacgatctacattctataagtgaggaaactttggaacagagaggttaaacaacttgcccaagatcatacagctggcaaagtatgcctaatcccaacattagcgttctttccgctatgctgtccatcggtatagaaactgattcaatcatcttatattaatcgaacattcacaattgctaagcactgtgaaacctgggaataatactattcattcattctttttcaacaaatacttctggagcatccactatgtacctgatgatgttggtgctgggaatacagtgataaacaatatacaaagtccctgcctttatggaacttgcattttagtgggtgacctatatacctgaattgcatctgtcacaacatggattacccacatttctgtgtttttctgcaatgaggcagatgaacagtgaaatctttgagaaatggccaaggtgttctctatgctagaaactagtgttgcccaaaagaaatgtaatgtgagtcacttatgtaattttaaattttctaataatcacatttcaaaagtcaaaacaagcaggtaatattacttttaaattatgcattatatttaacccaatataacaaaaatttcttttccctaatatgaaaattactgaggagggggcgtctgccatctctgtggttcagtagcttcagccattccagcctaccagctttggagagttcaaatgatctggaggaggaagggtcccctacaacgcggcacagctgctttgccagatcagactgctgctttactctcactgggtgggacctccctgcaggggcttcagccactctagccagggttatacagacagagttttgaattctccctggggcagagctcctatggggaggggcggccaccatttctgccattcagtcaactcagctgttccagcctgctggctttggagagtccagagagtctggacaaggaagggagcctccaatgcagcacacctgctctatcaaaaagcaaccagactgattctttttgtgggtccctgatcctgttcctcctgacaggttgagacctcccaacagaggtccctagccacctcctacaggtgtattcaggctggcaacaggtcagtacacccctgggatggagcttccagaaaaaggagcaggctgccatctttgctgttttgcagacttcactcgtgatacctccaggtataggaaaaactgaggcaattagggtctggagtggaccctcagcaaactgcaacagccccacagaagagtagcctgactattgaaagaaaaaccaacaaacagaaaacaacagcatcaacaaaaaagacctcagaaaaaccccattggaaggtcagtgacctcaaagataaaaagtagataagcccacaaagataataaagaattaatgcaaaaatgctgaaaactcaaaaagccaggatgcctcttcttctccaaatgaccacaatacctctccagcaaaagcaaagaactgggctgaggctgagatggctgcattgacagaagtaggcttcagaaggtgggtaataacaaactttgctgagctaaaggagcatgttctaactcaatgcaaagaagctaagaattatgataagacaatacaggagctgatagccagaatagccagtttagagaggaacaaaaccgacctgatggagctgaaaaccacaacacgagatactgatcacaagtatcaacagcagaacagaccaagtggaggaaagaatcatagaacttgaagactatctttctgaaataagacaggcagacaagaaaaaagaaaaaagaatgaaaaggaatgaatgaaacctccaagacatatggagttatgtatagagaccaaacctatgaccaattggggtagctgaaagagatggggagaatggaactaagttggaaaacatacttcaagatatcatccaggagaacttccccagcctagcaagacaggccaaccttcagattcaggaaatgcagagaacacaagtgagatactccatgagaaaatcaaccccaggacacgtaatcatcagattctccaaggtcgaaatgaaagtaaaaatgttaaggcaaccagagagaaaggccaggtcacctacaaagggaagcacatcagactaaaagtgtacctctcagtagaaactctacaagccagaagagattgggggccaatagtcaacattattgaagaaaaccattttcaacccagaatttcatatctggccaaactaagcttcataagtgaagaagaaataaaatcctttccaaacaagcaaatgctgaaggaatttgcgaccaccaggcctgccttgcaagagctcctgaaggaagcactaaataaggaaagggaaaacaggtaccagccactacaaaaacacactgaagtatgcagaccagtgacactatgaagcaactacataaacaagtctgcaaaataaccagctagcataatgatgacacgatcaaattcacacataacaacactaaccttaagtgtaaatgcgctaaatgcccccaatttaaaaaatcacagaatggcaaactggtatgctgagacccatttgtatgctgtcttcaagagacccatctcacatgcaaagacacacataggctcaaaataaagggatagggaaaaatttaccaagcaaatgggaaacagaaaaaagcagaagttacaatcctagtttctgacaaaatagactttaaagcaacaaagataaaaaaagacaaagaaggacattacatgatggtaatgggtaactaccctttaccaggatagttaggatagtgctaactatcctaaatatatatgcacacaatacaggagcactcaaatccataaagcaagttcttagagatctacaaaaagacttagactctcacacaataataatgggagagttaaacaccctacttaccatattagacagaccattaaggcagaaagtttacaaagatattcagaacctaaactcagctctggatcaagtatacctgtagacctctacagaactctccacccgaattccacagaatatatattcttctcaacaccgtatgcacttactttaaaattgatcacataataggaagtaaaacactcctcagcaaacgcgaaagacctgaaatcattcagggaaacagtctctcagatcatagcacaatcaaattagagctcaaaattaagaaattcactcataaccacacaattacatggaaattcaacaatctgttcctgaatgactcttgggtaaacaatgaaattaaggcagaaatcaagttctttgaaactaatgagaacaaagagacaatgtaccagaatctctgcaaggcaggctaaaggattgttaagagggaaacttacagcactaaatgcccacatcaaaaagctagaaagatctcaagttaacaacctaacatcacaactaaaagaactatagaaccaaaaacaaacaaaccccaaagctagcagaagatgagaaataataaagatcagggctgaactgaaggagacagagacacaaaaaaccattcaaaaaatcaacaaatccagaagttggctttttgaaaaaatgagaaaaatagagagactgctagctagactagtaaagaagaaaagagagaagaatcaaataaacacaataaaaaatgataaaggggatatcatcactgaccccaaagcaatacaaacaaccatcagagaatactataaatatctctatgtacataaactagaaaatatagaagaaatggataaattcctggacacttacacactcccaagactgagccaggaagaagttgaatttttgaacagaccaataacaagttctgaaattgaggcagtactaaatagcctaccaaccaaaaacaaaacaaaacaaaacaaaacaaaagccaggaccagacagattcacagctgagttctacaagaagtacaaagaagagctggcataatttctactaaaattattccaaaaaattgaaaaggaggaactcttccttaactcattctgaggccatcatcatcctgataccaaaacctggtagagataaaaccaaaaaaggaaacttcaggccaatatccttaatgaacattgatgcagaaatcctcagtaaaatgctggcaaaccaaaaccagcagcacatcataaagcttatccaccacgaccaagctggcttcatccctaggatgcaagtttggttcaacatatccaaatcagtaagtgtgattcatcacataaatagtactgaagacaaaacccacagatcatctcaactgaggcagaagggccttcaataaaattcaacatcacttcatgttaaacactctccataacttaggtattgaaggaacacacctcaaaataataagagccacatatgacaaactcacgccaatatcatactgaatgggcaaaagcaggaagcattccctgtgaaaaccagcacaggacaagaatgccctctttcatcactcctattcaacatagtattgaaagttctggcaagagcaatcaggcaagagaaagaaataaagggtattcgaatagggagagaggaagtcaaactgtctccgtttgcagatgacatgatcctatatctagaaaaccccataatctcaggccaatattttcttaagctgttaaacaacttcagcaatcctcaaggatacaaaatcaatgggcaaaaatcactaatgttcctatacaccaacagcaggcaagcagagagccaaataattaatgaactcccattcacaattgctacaaaaagattaatatgcctaggaatacagctaacaaggaaagtgaaggacattcacaattgctacaaaaagattaatatgcctaggaatacagctaacaaggaaagtgaaggacctcttcaaggggaactacaaaccactgctcaaagaaatcagagaggacacaaataagtggaaaaacattccatgctcatggataggaagaatcaatatcatgaaaatggccatactgcccaaagtaatttatagattctaagctattcacattagactactattgacattcttcatagaattagaaaaaactactttaaaattcatatggatgaaaaagagcctgaatagccaagacagtcctaagcaaaaagaacaaaactggaggcatcacactacccaacttcaaactatactacaaggccaaggtaaccaaaacagcacggcactggtacaaaaacagacacatagaccaatggaacagaataaagaactcaaaaataagaccacacaccagcaattatcagattttcgacaaacctgacaaaaacaatgggaaaaggattccctatttaaaaatggtgcagggagaactggctagccacatgcagaaaattgaaactggaccactcccttataccttaaacaaaaattaattcaaggtgaattaaagacttaaatgtaaagccccaaagtataaaaaccctataagaaaatctgggcaataccattcaggacataggcacgggcacagatttcatgatgaaaatgtcaaaagcaattgcaacaaaagcaaaaattgacaaatgggatctgattaaactaaagagcttctgcacagcaaaagaaactatcatcagagtgaacaaacaacctacagaatgggagaaaatttttccagtctatccatctgacaaaggtctaatatccagagtccacaaggaacttaaacaaacgtttaaggaaaaaacaaacagaaaaaaaaccacacacagccccattaaaaactgggcaaaaaccatgaacagacacttctcaaaagaagacattcatgcagccaacaaacatgtgaaaaaaagctaaacatcactgatcattagaaaaatgcaaatcaaaaccacaatgagataccatctcctgcccgtcagaatggcaattattaataaagtcaagaaacaacagatgctggcaagattgcagggaaaaagaaatgcttttacaatgttggtgggagtgtaaattagttaattccaaccattgtggaagacagtgtggccattcctcagaaacctagaggcagaaataccatttgttccagcaaacccattattgggtgtataccccaaagaatataaatcattctattataaagatacttgcacatgtatgttcattgcagcactattcacaatagctaagatatggaatcaacccaaatgcccatcaatgatagattggataaagaaaatgtggtacatatatgccatggaatactatgcagccataaaaaggaacaagatcatgtccttttcagggacatggatggagttggaagccattaccctcagcaaactaatgcaggaacagaaaaccgaacaccacatgttctcacttataagtgggagatgaatgatgagaacacatggaggggaacaacacacactgggacctgttggagaggggttgggggagagagaggatcaggaaggttagctaatggatgttggtcttaatacctagatgatggaatgatctgtgcagcaaaccaccatggcacacatttacctatgtaacaaactttgacatcctgcacatgtacccctgaacttaaaataaacattgaagaaaaaaaagaaaattattgagatattttatatatttttttggtgctaagatttcaagatctggtatgaattttacacttacagcacatctcaatttggactcaccacatttcagatgctcaagagctgcatgtgtctagaggctaccatagtgaatagggcagcactaggtccgtactttctcaaactttggcacaggtgggaataatccagagataacattaaacacagattcctggacttcattcattcacaaaggtcagggggaggacctgaacattcgcatttccaaaaagctcccagttgatgctgatactgccagtctacagaccacacttggggtagcttgcaaaacaaagcacgcacatctcccagtgaattgtggcaattataatgatgataacaaatagttataatattttacctttcaaaagcactttgcattaactactagaaattcaaattaaaactaaattgagttatcactgcacacccatcagaatggccaaaatgaaaaataataacaccaaatgctagtgaggatgtagagaaactggatcactcatacattcctggtgagaatggaaagttgaaaatagtttatcagtttcttttaaagctgtaaatgcccttatcataaaattacattcttgagcatttatcccagagaaataaaaacttatttcatgcagaaatgtgtacacatatattcacagcagctttatttgtaatagccccaaactggaaagaactaaaatgttcctcaagaggtgaatggttaaacaacctagtgcatccataccgtggaatactatctagcaataaaaaggtataaactattagtacacacaagagtttggatgaatctcagtgacattacgctaagtgaaaaatacccaacctcaaaaagatacgtccttcattattccatctacataacatgtgtgaaatgacatagttgtagatgtgaacaaactggttgtttttcagggactggggaagggaaagatggagatgtggctataaagggagagtatgagggaatcttgtgatggttaatcttgattatggtagtggttacacaaaactacccatgtgattaaattgtacagagctacacacatactcacacataaatgaatgcatgcatacgtggtgaaacctaaataagctctatagattgtgctaatgtcaatttcctgtttttgatattgtgctatagttatgcaaggtgttaacacagggtgaagggtacatagaacctccctgtatatttatttgtaccttctttgcatctatcatgatctcaaaatgaaaagtttttttaaagcactttgcatacactatctcatttgatcctcatgataaccctgggaagtgagtagtatgatcattgacattatgtaaaaaagaaaaccaaggcccaggggaccaactactgatggaagaattacatagctaaaaacaggcaaagtcaggactgaaataagactacatcctcttataagtattgatgtatcaatatgtaagtatttatagatataaaaagatttaggggacccaattatcagaaatgtagatgtgtttcagatagcaaacttgcaaagtaaaaataaaacacaagctctccgtcttcccatgacttacgatagatttgcaggttgtagcgcttggtggtggtgtagggatcagcctgtgtatttatgtctgctttgtagtctcctgcgtcttccatcctcagatcgctaatgaccagattgtagttcggacctaaggcatgtatccgttcataataatttctgtgggtcacagtaactacgggtgctgtttctgagtctcctggtgttacataagcaacagatgttttagaagtccaagcaatgattttaacttgccgtggttcttggatatttacagggaaagtgactgactctcccagaatcccattcactgtgaagatttctgagtcttttccagctgcttccggccctgagaacataaaaagaaaactgtagccatctgactgttgcagctttttcacttcctaatctttttggccttggagctccctgaggagctgccacaaatgcagttcacccagtttcttgaggatgcctttttttttttttggcattctactctaggtgtatttaatatgttatgacaactaaattttctaacgcattctcattcaaaaactaagtttctcactagagatccattttgttaaaaatatttttacctagacttacagactctgaaagctagaaggcatttgagaggtgaaggccataagcctccacgtagtctaagatattaggtgcacttctttcccaagatcatattgccaagtggtggaagagctagaacaagaacctggaatatcttggctgatggactcttgggtcattgctttttattttcctgtgatctctgtaaaaagcaagtaacacttttgtctcttttcttggaagatagaagcagagagtgctttggagtctctggagaaaatattccctaagttggtgatttttagggatatttttctgtttacttccatattcctagtctctagaagagtgcctaacacagagaaggggcttaataaatatttgtggaattaattgatagaatttactcatgagtttcctagactctcttggaacaacttctgaagtaagcaagtttcgtttattcattcatacatttgtgaatggttgcatgtatttattcaggatcagttttgctccagatactatggtgggtatttgttaatttaatttataatgtaagtgtttgttggacatctactcttttaaacaagatacgaggagctgaggatacaacggcgagaagaaacagatataattcttgctctttgagacttacaatcagaggaagataccaatgttgatcagataaccatagaaacaaatggataggcacaaaatatgtaagcattatggtgatttgagagagaccagcaaggggacttgatctgttctgggaatcgagggaacatttcctagtgaaaacttaaggatgaatacttttaaaatgtaacatgggaagatgaaaagcttattttctcctcccttttctctcctctatcacttttgaagataaactgatttaatatatagtttgtaaaatgagagacaatgtaacttcaagacattatttttctgctctttctcctcctcttcttcattatcctataattctcaatgagggctctttagtgagaaacactgtttggggcaagcatagatgatatccaaagtatttaataaccaatatgacgtgggccttgaccaatcagaaagggtgttagccataaacaaactagttgagcggttctggtgtgtactggttgcatgtaggctctgatgaccagacatcagttttccacataagtgggttcaggttgaccctaaagtttatccaaggcttggtatacggaagaataaggatcataaagtatacacgtcccttgaaagtggcacaaaaaaagcgatttcttaacctgatggtgttgtctcactatggctacccttgctcttcagctcagcaaccactgaaagagccccaggaacagctgatgtaaagctctttcctttctgaccaacagagattttcccgtaggagcagtatccgggacaaggcctgaggatttagttgggggttggctaagtacagaagatacaacagggtggggagtatgtggagtgggagtaggaagggggaaattgggaacccttatctgcaaacatttattaactgctaattatgtgtcagatgctgtgttagggacacagggataaacaggacatcgttgcagccctgaggagctcacagcctagaaaataagacagatgtggtcacaagtgaaagacaatacaacacgatgagtgctaaatggtaaaagcaatagaaataagccattggggtagcgggtcagaaagaggctaatgctgcctttggtggtaagagtcatagtttgccaaaatttaagaacattaattcttcccagataaactgtttttctgggctgacgggttctaggagaggggtatttggagtgtcccagcgtgaatccctggatggtccaggcatgggcatgtgatctatgcagttgcacagaaccctgaattcaaaaggaccctgaactggacttaaggctgcgttgccacctttaaattctacatactatttaaacaaggggccctccattttcgttttgcactgggcctcgcaaattatctagccagtcctggtctcagatctcccacgtctcaagtcttttttgaagtcaggccctagtgcttaattgccacaccactctgtggattgagattaggtgtgaggagagagacagaacatagattccacagactcgtaattttgctgggttctctcactaaaccccaggaagtatgtaggtagattgttaaggctgagaccttcttaatattagggccgttgagcagccacagtggttggtgtgtggtgcagttttaaaagtatgtctcatctcctgtagcaagtcattcaggaagtgttggtggggtatcaaagagcaatcaggcagtgggggtggtgggtaggcaaagctgggggaagctgttatttgtgctgctggtgttgttggcaagaatactttgcttgctggaaaaggcaaaggggttgcacatgtttaagatgaagattctgccaccttcaaacactccaactgtgctctgagagaagcagctgcaaaaccattgcatgcagtggaaagatagggaggcagaaggtgtaggtgcaagtacttctacttatgaactggacaaccttaacgaggtcacaaaacctttcttatttatttatttatttttagacaaagtctcactctctcactgtcacccacgctggagtgcagtggagtgatcttggctcactgcaacctccacctcccgggttcaggcagttctcctgcctcagccacccaagtagctgggattacaggtgcatgccatcacggctagctagtttttgtatttttagtagagacggggtttcaccatgttggccaggctgatcttgaactcctgacctcaaatgctctgcccgcctcagcctcccaaaatgctgggattacaggtcacaaaacctttctgaacctcagtttcttcatccatagaatgaaaataataattatgctatttgtcctgtttggtgagcagcaaatgatgtaatatgagtagaaatgctttgctgatcatcaaggtaaaataaatgttagttatttctggagttgatactgatatattaacattcatcgtatgttctttatcatcacttcaacaattggtacatgccctttgggcctgccctaggccacccttatgatggcgttggtgatgccggggccatactggagcatatatcaaaagccatttttaagggctaattcaagtaaagcctggagggacagtttcaggtaccctggatagactttattctgctcttaaaagattttaagatttaaaagaaagagtgtccatatcaatcaatcccaatatttatttttctgggtgctaaagggactctaacattatgttatcactggaagtgaccttagtaaaatctaatttcagagataacttgtggcacaaaaacatcttgaggacttaccatgaaatgcactatgctagtctatggcaaagacagattctctgcctttcggggggaatttgatacccggttagggaaataagatacacacacacacacacacacacacgcacgcacgcacgcacgcacacacacaattctcctttgcaatatgagatagtgaataataaattcaagtgaatggtagaaacagtgattacggtaggaattctaagaagggagggattgctgagctgtagtggttagaaaaaacatctcaaagaaagtagaatttgaggaggattttgaaggctgaatagaattctacttgatggaaagggaaaggaggggtgtctcaagtcctcggatcctgaacaaaagtttagaagcagaacctgtgatgttaattggatgaatatagatttgcatatcagagtggggagaggtacagctggagatacaaattaggtttagatttgagacagccttgagtttgaggtctccatcagaggcagaggggaactattaaggtttttgcgagtgaagattaaaataatgttttagtcattgtaatgtagtaatgatgtgtggggaggaaaacaggaaggagaggctgcatcagagaggccatttagggatactgtagtcttctgggcatgaaccaggggacgataatgggaatggaaaggaagggctggatttgatgataacacaaagaaaggcaagaaataaagaggcatctgctagaattcaattgttcatcaatatattttgagtttctactttatgtcattgaaaaactcataaagtttatgatggaaagaagtcaaagggggaagaaagtttagtgttagaaatattaaacttcagatgatggtggaccatgtaagtaagctcttggaatgatggaagataaggagagagaatggacttgaagtattatttggggcactgtggcagaatctgctagctgttttccaatatttgttccctccttcattcttattaatagaatcactaatttttagcagggcatagagccacccagagtaaagactatattgtcctgctttcttctagctaacgttggtcatatgactaagttcagcccaacagaataaaaatggaagtgttgtatatgacttctgtgtctttaagaagagtgggaacctggcatggtggctcacatctgtaatcccaacactttgggaggccaaggcaggtggatcgcttgagtccaggagtgcgagaccagcctgggtaacatggcaaaaccctgtctctacaaaaaagtacaaaatatacctgggcatgatggtgcacacctgtagtcccagctgcccaggaggctgagatgagaggatcacctgagcccaagggggtcaaggttgcagtaagccaagaccacaccactgcactccagcctgggtgacagagtgagaccctgtctcagaagaaaaccaataaataaataaatacataaaaagagggaaatttgctgttttcatctcttccttgcttttgcaggccagaaggtcatgacagctggatcttagacagacattctgagtcatgaggaggaagccaagttctgaggatggtggagcaggaagatagaagttggaaccccaatgaccttgtgaactattctactgactgtgaactgccaactccgcacttttttacatgagcaagaaataaacctctttcttgtttaagccattcttattttagtgtctctggtacttactgtaacactgaaatccagcgggtttagagatcatccacagaaatggcgtgggtgaaggagaggagggtcattcaggaagagtaagcctgaagtccacgactgagccctgcgagagtgctcacatttatagaagagacaccatcaaaagaaacagaagagaccaagcagtaagagtgcaagagaggcaccaatagtgggccatatcacagagaggagaaagagtctcaaggaggagattgccactgatgtctaatgattcagcgttcaacgggataaagactgaaaatggccctgggtttgcccgttacgaggttattgatggcctttgagaatgtagtacaagtaagacaactcgatggaaggccagagtctaggggactgacagagtaggtggtaaagcatggaggaaaaacttgacagtgaaagaagggtgatgagataggacagtagctagaaggtcaggtgaaactaatttatttttgttttaaaatagaagagactgggggctgggggggaggagctagggagggtaagcagagagagatgtccccagtgggcctgctctaggttagatgctcctgctcatggcctctctggaactccaggtttccctctcatagcacttgccacattgtgtggtggtcatcaatctgcgtgtctgtgttctggacactgtgaatgactgagtccaggggccttgccttaaacctctggtatgcagaacagcacaagatacacaggctactaatgcttgtcatggaacaaaagatggaaaggaaagggcaggcagtggaagctgtagatttaaggagggtcacaccctcacctgaagtggaaaggggaaaggaaaggataagtgaaagagcaaaggtattttgagatgttattaaagacggtgataggaagaggctgcttggtgaagtagagtgagcatagatttgagccaggtgggcttgtgctcatgttcaatccctgacatttgctgaggccctgatcttacttgactacaagatgggctataataatgcctgccttatagaattgttttgaggacacatagaaggtgcttaatacacagtggacattttggaatagataggataaaatggaagatagtcattcttggtggccttcatctcttcagtaatgtaggaggggagactaactggcaacagtgaggaggcaagagtgggaccagctaggaggtatacagactaaaggtgcagattttgaatctaggaatatttgaacgtagctgtgttatcttgagaaaattattgaaattcactgttcctcaggtgcctcatctgtaaagtgtggataattattaaatgcaattgcgaagataaagcacttagcacaatgcctggcacatataaatggtagttgctattattttggtgaatgtaaaaattgggggggggaatgttactataaggaacaccatagggagtcaacaagagattgatgaaggggatcaagtgtttgctaactacccttgagagcccagtgaagaagtggtaacccacatttacaaccttttccaaagagtgtgatttcgtgaccttcttatgccagaacacaaatgggaaaggtaggagaaaggccatacctctagaggagaagcaaaggcaagaaaaggctgaaaccctggggtgcaggcttagatggaaaaacctgttcactgtgactcttaggtagctatggcaaagagggagcccaggactcagggagcaggatgaccagtgttgaaagagatcactgaggactggttgctcactggaggttgccttcccctcctggattgggctggggcacccttcccaatgcaatacacctttctgtgtctaagatgataaccctgtttccctggatgatcctagggatatggatggattttacaaatgtacatttcatggttaggcagctcaaagccactgactagaagaagacaatagggatcgtgagaaaaagaagaatatttgaaaaaacaaaaaacaaatagaaaagaatcagaaacccatatatatagattgtataaagattgttgaggtatgaggcttttaactcatgagaggaaaattcttcaaggctgggcaagcaaaacttactgatgttttgggtggaatccaaagtcaaatatggatgacaatggagaggttatatagacctaaaaccccataattctccttagattctattaaaaatgaacacagtgtacccttggagtctggggagctctctattctcctttcataatcttaaccatcactactaggctctgcctgatcttcccctacttccctactccaaccacatcagctccctctgttctgtaaacaggccaagggcactttgccttagagcttttgcacctgttgttctcctcttttcctaccacactcttttcagcagtcccccactttgttcagggttttctcccaacatcatctcattagaaagagctttcctggtcactgtgcctaaaacagcaatccccaccccatccttctctcttgccttgccttactatccttctcttcactgcagttatcaccactaaagcattgcctgtgcttatttattgattgtctcccaacccatcccctcaatacactgctactataatgcaattatcaagaatgtgagtctttgtctgtttcaatcactactgttcctccaagaactagtggatgattattaaatgtttgttgaaaaaatgaacaccagcctgggaaacacaatgagatcccatctctatgaaaaagaaaataaaaaaaaattagtcaggcatggtaatgcatgcctgtagtctcagctacttgggaggctgagacaggaggatcacttgagcctgggaagtcaaggctgccatgaaccacgattgtgctactgccctccagcctgggtgacagggcaagactctgtctcaaaacaaaaaacaaaaacaaacaaaaaaaaacaaagctttttttttttttgcaactgactcaattaatcttttccaacaatagaaaaacaaggcagaaaatctcagcaagagaaagagtgaaggcaagagaggactctttactgatctctgggtcttgatgtgaaaggtcaagtatttaaactgattattaacaagaatcagatggctaactgcaatttctttctatattctatactgtttgtgaagaaaattttttagatccacaaaatggggacccacagcatagttagtaaaagtgtcctgaatcagggattaggaaacatgtttgagtctagggtctgttgttgactagctaaatgaccatgaatgtcacttacttgctaagtcagagggttctagttggtaaaagaaataaaacagagctgtcctgccactttgaggaattattaggattaaatgacatgagggtgctctcaagtgtgtgtactaatggaggagagtctagtggtcctaaggagagccttgccttgtggaatcacctgtatgtcaccatgggttagtcactgaggcctagcctgcctgggctagaatcctggctctgtcagggactggccatgaaccccagggaaagtcagtaacctctctgtgcctcagtttcctcagctttaaaatgaaggtaatattagcacattggtgaaggtaatagtagcacaatatttgacctcataaaaatattatgagggttaaatgaattgatatttgtagacctcttagaatagtgcctggcatatactaggcactatatatgtttgctatgtaaaacaaataaacatcttcaaagagactaaaataacacctcagacaactacgaagggaaaaattagagttggggtattggggagatgttaaagtcagcaagtagctattaataagagtggaaatggggaagactgcacagttgcttaacagacacctccacccccttactttcttaggatcctccagacaaacatttcttgttctttttttgtggcactagctaaacttcctctcctcttctccacccactgcctcctagagtcaaaaagtgggggtggaacatcgctgagtattgtaggtctgggagagtgaccagaggtagctttagcatgtggtgcccaaaagagagtccattataactgctcacactgagtgaagggacatagaggggaagaggaagcacagggctgggcaggcagaaattttgtgtcattctccaaagcgacggaaagtccttgatcatgaggttttaagaaaaaggaacctactacccccatgcaatagtacattgttttcccctgggagttttactttatatcacctttattgggatttaggtttacttgaatcagttccttcaaaacacacacacacacacacacacacacacacaaaatctcaaaacagacatgagatcatagccatccgttttaacattgctgccctctattagcgtgtacttgaacactgagtataacaaaggaaacaagagtacctagtcagttccacctatatcagcccccagctgattgctcatacctctttccaagtttcacatagatgagcccagtgatctccaaacttacaggtccatccctttcctaaggtccaagacaagaaaggtttgatttaggaatactccagtagcctgaatggcttggcaccgaccatcaggctcctgttgcgaaggtgctctggctgccttgttggcctccatattgatctccaggactgcttcaagcacttggagctgacaaggtaggcctccgctgccttccactgaaggcctgagttatcacagggggaacagctttccaccctctgtttggaagctgggtttttgataagcagttttacccatatgtaatatatttccatttctataactggatttctgcttttgagcccttttctgaatgtctgtggtagtcatctgcttaaatctcattctaatacagaggccttgtccttatcttgaagacccctcaatgcaaggacttcagatcagtggcaggttgttttgtcagcatacttccacaggtatgcttcctgtctctgagccccaggatgatggttggggtccagttacccatagtgagcccactcatttcttagaattttaggtctcaactgctgaaatgcccatgaccatgtttaacatccaacaagacatcaacatcatgctgatattggacttttatttgtttaaagaaactaattcaaatcacatttgaataatattaaagtgaacggtatttgaaatatgtctggagatggttgtttgcttgggtattctgcctcactgccctgcctaaacttccgttattggcaaggacctgccaacagctccttcctcctctgtgggtgggtatagagaaaggcacagattctatccgaataatcctgtcttgacagaaataaataaatcatcactctttactgacatattcccaaacattaatagtagggagagtaatttactccacttcagcatcaatgtgggtggaggcagcatgactcagaggtgaagtctaaggactctgaagcttaaattctacttctttcactttttggttaagtggcctttgactctctgtgtatcaatgctttcatctgtatatgtgcacataaaccgtatctatctcatagtgtattgtaaggattaaacaaaataataactgtagactacttagagtaatgctgaatatgcagtgattgctccataaatggttacttattactattattgatgggagataagacagggagttgaagaaatagaaatacgaatggggcagagaaaaggaagaattaagagtatgagacagtatatgtagagggggtgggcaaggattaaaactggtggactccttcatctcctaccctcagagtgggagtgtctcccagggtatgtggagagacagtcagagtcatggtgtttccaaagtcatgatcagaaagttggcatcagagcataagactgtgaattttgactcagagaaaacttttccaacatggaacagtcataagtttgcacactcagactttccttatgtcggtgatttctgaggggaaatggggatttctccctgcatctctccactgcttctcagcctcttcaactgctctgaattccagggaaatgtgtaaagtgtagactcctaagcccaatactgaatgtaagggactacctctaccaggaacagcagcaggaggaattcatggtatatttttgtgctcagaaaaggtttgcagaataatccttaagaggcaaacagataattcagtaaaggtggacagtatgtaaaaagtactcctggcttcacttttataaaaacaagctcccattcccctttcatggatccttgatgaaatgaatatctcactcctagtttccttttccagaacccagacaaccaacacctaagctcaaactcccaccaccttttctcctgtttatgttccttggacaattccctgacagaggagtcctgcccaggatctctgtgtggtaaagccatggctcttcctaataatgaatgaaaagcgagtgtgaaaaatagtagcattagctgatatctgttaaacacttactatattcaggtaccatggcaagtgttgtacatgcattatcatcattttgattctcaaaacaattctactgtattaatacctccccattttgaagctgaaacaagagtcagaggaggaatgtaacttcgtctaggtcacaaaacttgtaaacaattcactactagctgatttgacaactttatttcagtttcagtagatgaaagaagtgtatcctagagctaccttttatcttagcaggtattaaccttttgaagagcatcaaaaatttgaaagcaatgagtgaagaggtcaggtggagcagaaagaagaaccaatgggattgggattaaccttggaattagaaaaaccaatgtctatttccagctctaccaatttaggtagtgaaatttcaggtgaatttttaaacccctaaatcttaatttattatttttcttgcataatgggattaataacgtctatcttgctcatctcaatggttttcatatggatgacataagaatgtaggcataaacattgtagaatgttttgcaaattaagtggtatcaaatgctaccttgtctggtctctctctggaagattagggacatccctagtaccattcctcatctacttgcattttctgtctgccattctagagcgaccagcagaggctccaaaaatttggtctgactagtggttacaatctccatgaagttcaaattaaaggagccatagcttgaaatggccaaagaaaccagagagatcacagtgcattgattctacctttacagaaaatccaaacgtactaggttcccagggttctaactcatgccagaattctgctagtgcattttcagaactggcaagagatactagaagtagatctagaagttccaaacatagtaaatttctgttagagcaattgtttgtatttaaggagataacatgtacaatgacacagcactcccagatctatgttaatgttacaattttctttgtacaaataacaatcaatattcatgtcgttcttttagtttactgttatgccataagtaagaaaaatagggtttttaattcaagttctccaactcttttttgagactatttgtaaaaaatgggatagtaatctcttcctcatttattttagagtttgttgaggataaaagcagagtaatagctctgtgttttgaaaataaagggagtttatagagatgaggctcaacaatgataacgatgagtcatccatcactctaacctgatagaacaatcaactataattaggaaagacatttttctctctcaaacgccatcacaattgaatgccaagaagaaattgcttgtaagtcattcaagcttttagaagatctttcttttgccaggctttttgggtgggtttaccaagtgctgattcctctgagaaggatttgcctcagacctttggaaactgagatctccagatctcagaaatataactcagtaatataaactttaaagctgaacctaaacacttaggtttgaattttaagtctctccccagccagttggatcctgttgagtacagtagatactgagacccagggtgttctgctaaacacagatcaaaaagacagttcaatgtcttccttaagggcaatttttaaaactttatggaaaactaggaggcgatcagcaagggtcagaactcacaggtttgcaggcaaaggagcaagatccataggtggtgctgagccatctctttcagggtctaaccttctgtggaaaagcacggcactgttctagcagagtcagtttcacttgagttttcttcctcc

SEQ ID NO: 2421 - DNA, 38423 bp, Homo sapiens; identical to SEQ ID NO: 2420
  source 1..38423: mol_type = genomic DNA

SEQ ID NO: 2422 - DNA, 38423 bp, Homo sapiens; identical to SEQ ID NO: 2420
  source 1..38423: mol_type = genomic DNA

SEQ ID NO: 2423 - DNA, 38423 bp, Homo sapiens; identical to SEQ ID NO: 2420
  source 1..38423: mol_type = genomic DNA

SEQ ID NO: 2424 - DNA, 6985 bp, Homo sapiens
  source 1..6985: mol_type = genomic DNA
tcaatgtgtttaagagtttattaggataggcacataacagaaagctcaaaggacaacaaagctgcaccttcctaaaggctgaccctcaaagcaccattttgttagaactcagaggagaagctcgatctctgagccttccctcctcacagtttgggaaacatgcacaggatgaaggtaaatcctgcatagaaatcttgtaattccagaattagtcaaacaaatttgaaatacacacatttaaaaatacttacattctcatttagcattcatgaagtgattactgacatttacaattacatctgacatcacagagcaagcctttgcagggatctaattcaagcttaagccaaatctatgcaaagaacttcagctcagaggaatagtgggcaaaatctgctgaaaagaactgcttgccaccttgcagataagagcaacagcacaataaagggattccagagcttctacctaaaatagaagggcattatctacaagaacagaccaaaacacaatttatttttaaacaagcccttcagtgagtatttgtctcaggaatctagtatgaaaatagtgtctttgattagtgaatatatggagaattcggattatcatctctatttttagttgagaaaatgcacaaaccatatagatttaaaccatgggttttgcagccgaagtagagacagatgttttctgggatcatatctcagattcccaagctaaagctattgttcaaggtgatggaaatatgtagggggcattaaaccattttgcagctgctagaaagctgtgttttcctgttttcctgatttagacaatggagaagctaagaagagaaataataggaaaggctttcctatgttagttttaaaaagactgtgttatttttaattcaatttttttttgtcaaatctcatctctgttctcctagttttcacagaaatatttacaggaataaaggttgaaacaaaagtacctaatgatcatctccatccatcgaaagattgctcagggataagacactcaaacaagggcttgtgatgaggatggaaaagacaaagcaacttgaagagaaaaaaaaattcttttaaactcagttcatcctgcaaaatggacataacacatgcatataaaggtttgactttttaattccacttttttgcctgatcgcagggaagatggcatgtggctggcccttcctgaagccttgctcctccaccactggctaacagacaggcctccaggtggccttgcaaggccgacagtgaccgcagcccacttccccacatccttaatcagagcctcatgcagttcatccccacattacccaaacataacgtcgtagtgctacacgtagatgtgttgcatcatgatgctatggcaatgacgatgacgcttaggtgtgtgggccaccgaaggcagagaccagatgtggttggtcttgcctggaagccaagctgttgagcaggggtggagtccctctacagaggatgctcaccaagttctaatgcattgtcgataactgtcctgccctggtttttctgcattcctcagattatctgtgggaattgtcctcctgcatcctttctcaaatgacaaagaagaaagaaagagcagtgatggcacctgaaattcaggaatgagtaggcatggcgagctgggtgtgtgagatgttctctctttacattgtctgctttgagatgtgggatgaggggagggagagagttggtcctgaatatattcagttttttccaagagtctcccagaattattgacctatttggacaacaaatcttcattgtcttggtgtccatctccaagtgaaaacttcccccgtccccatggccctggcttgttctgctgctgaacaggtcacctgggcagaaacactgtgtctagcgagaagttagcaggtggcagggtgcacctctccccatactgtgacccttggattccccactgtgccacgcccgagcaagctggggcccctcaggacaaggacgatttgttaatggcctcttggccggtgggcatttgtttacccactactgtagccccaagatcccccaaacaagaatttccatgcttcaaagtaacagcaaaaataaacaggagaataaagcacgtgtttgagcccagtggtttccatcagatgcacaacctgagctgtctggttgggttgctggctctccccccgtggtgggagtggtgtgcaagagaaagcaccacccagcaggagagggacccagcctgccagggaaggttttgaggaactggattctttatcacccatttctccccttgtgggttccacagaggggttccatgacctccctgttgttgagaacagggctgcattcagagaacagacgatgggcctgggctgtgagagcaatcagaacactgtgaaaataggagggctcgttggatcccaggaatcatacacagactgcgttggggctgtgggaagccaaggacagaaatgtctccttcaccccaaatgataagggcaaggattttcaaggcccagagggagaaatgttgcatttgcatttatttaagtgctgatgttggtcagcagcgcatccagccatgtctttagaatcctctgaatggccagacagatggctgctctccacaccacagactgcccagcttcacacatcacctagagtctcgtggccaaggaagttttgccaaatggacacagcctttgtctcccttaagtgttaaacaccagagttccaactgaaaactggagaccatgagatgactttaaaaagaagttccaaatgccccatcgagccgcacaaaacctccatctttcctttcacttcccctgcccctttagttttctattaaaaacaatctgaaccatagcatctatatttcaaaactggcaagagtattaaccctgcaccttgtggcccttcaaccactccagagtgtcacctcagagaccgatgcattgctaaggcaaaaccagaaacaccctttctctgaggctttggggccttggagggagacacatttcctctgtctgttctcctgcacagtggtggtaaaaagcccacaggagacatgaggcctcccagagatactcaggtaacttctagtgactctgaccatcggtgacccccaggaatgtgttccagtgccccaggcagaatggtgccgtgtctctgtgtgtgtgtgtgtgtgtgtgtgtgtgtgtgtgagagagagagagagagagaaagagtgcacactatcgactacattatcatagggagaaatatttgcaaatgtaacttttaaaatgaggatataatttaaatggctttgagcagtttttgctgtaaaaatgattttagttagtcatctctttccctcttccttccctccttacccccaattttaaggaaaagagacagagaacaaaagttccttaagcaaactgcctgactagctccctacttggtgtgtgcgccacccacacttcaggatttaaaatctcaggatgctgcatcaactgtggactatgaactgtgctaaaatgctttaaaatgacaactttcaaaacacagtgcatcatctcccgttcacacatcctttaggaaacagcctgatggaactttctgcagggcttcctctgtctgagctcggagcactggcattccgggcaggatgaagtggaggcggggccacaggcagggtgtctgaggcctgccctggctcaaagacaggttgtccttgaatttgtttccttgttagtgttgatcacatccgtagtcaagtgtgtggtaacctcagtacatttggatgaattaattcaagtatctgtgaacaaatccctggcctctctcgccctagccccgtagattatgtgacttcacaaacacctgtaatgcacttcaagcaacttttctcatatttttcaagcttcctttgcaaataaacccaaggctattagaaatgtaagaactaaagaggcacttcctgcctccttgccacctaagaggttaattgcacttctggccattctggaggatgtcaacagtatcacatttagcaagacttgtgctggcgaaatggaggaatgcaaatgtaaagaaatgtttccagtccgaacatgttccctttgaccaaaaaaccagatcttcttacctaattgaataattaattgatttagttttcatcctaggaagagaaacaaatcatttcaatcctaatcagcatgagcaactcaccttttcctcttagatggtggaagtgagcagagaagatattcaggggagccccttagccccggcctcctcacaccctgatccggaattggtcacattggaatttgaaaagggagggggagtaacaatcattatagagtcacgaaatccccaccgtggcacgccaacacacagcttccacttcaggaacatcaaacacccgtagaaaatacctgcatgttccaaggggcctttaaggaggagacttacaattgtttgctaagattccagtccagtctttcaaaaaaatgtgggtgcccctttggaatggggagttcaaagctctgaggatggtggctggtgactctagtgtctctagggccacctcactttcagcagtctgtcccaggtgtcggactatgggaaacaaaacagacagcgttggaagccatggcgcctctgtgcctgcacgtccccaccttgggagagagccccacgtgcggccgtgctgcagatgggcagtatgctctaagggggcccgagtgcctggcgtggggggaggttgaggggtcagctgcaaggaccagggtgtgtctgcccacaggaaacctgggcctgctcttgctgccacctctttgtactgtagtcagtgcccccatgcctgcccatcccctcccccggtcactcagggccccctttacctgtactggttctccatggccctgctctcagctcgctctggaacccaggagtaactgtctgccgcattctggggcttcttctccttcttctcctccctcttcgctctccgcttgcgatagaccagtagccccagagccagggccagcaggagtaggatggccaccacggtgcctaggatgtagaataaaagcagcttttgcccgtcagtgccatcgttgttttgtgtggccacggaggagtccccacctgcaggctcctgggggccagaggcagctgtggcgtgatggatgctgggctccctccagacgcctggggacccactgggggccagcatcttgagtggggcagatgtgatgggggcgtcagatgacagcgaaggtctacttgtggtgggtgtagccttgggggtgccctcggggccccttgtgggactggctgttgcagcacggggcacggtgctcccttctttctctcctttgtcctcctcatcggggggcccagatggtggtcccagagacacaggccccatggtgcaagagaccccatttggggccagcacccagcctggcaggcagccacagtggaaggacccttgtgtgttgaagcacaagctgtcgcagagggggccccccgggcccacacactcatccacgtcctggcactgagtcccgtcctccccggccaggacgtagccctcctcacaggagcagtgaaatgagccatctgtgttggtgcagccctgggcgcaaggcgagcgacccagagcacactcatccacatcctgacaggccccctctccaggaccgcccggctcatagccaacccagcattcgcagcggaagcccccaggggtgttgacacactcctgggcacagggggagtcctggcattcatccacgtccacacagtccagctgactcgagtccagctggtacccttgggggcagcggcacgtgtagtttttcccatggggtcccaggacgcacgtggcccccccacgacatgggctggagctgcaagggtttcgagaggcacaggtcaccaggtcatccagcagccggaatcctggtcggcagccgcagaggaaggagccatcccccccttcaaagcagtcctggtggcagcccccattgttgaagttgcagccatacttggggctgacacagagggggcccgagctgccccagtcgaacacatcgggggccttctccttgcacaggaaataatgactctgagtctcgtccttgtcaccttccccacaggctacattggccgcagaggcaaagggcacagcctccaaggaggaactggtggtctggaagggggtggtgtaggtcacctgacctgggccccccagggccagaggccggcacatgcctttgaagctgaacttgcacacgaagccctcaatgttacttccgggggagcctgggctcccacaggggccctcagaccacttggggaggcggctgggaaggagcggctgggacaggtccagcagcagagacacacagcgcttggagatgcacgagttccggagctccttgtgccagttagagtaaggcgtgtcctcccccccgcccacccagctgaagcccttcagcggcagactagggtccaggcacttgcccttctctcgctggagcccaatccagaacttgctcatcctcgccgtcagggctgcctcccgcctcaggagctgggccagtactcgctggacgtgctgggcctcctccttgctcttcacagtggccaggttgcccccgttctggttgcagtggttctgggcctcggcagcgctcagcttgcccgagtgggccgtgtagcaggcggtccccacgcagaccaccgcctccgtgtcagctcccgtccccgccccgggctgggtcaggagcagcagcagcagcagcagcaggcccatggaggtggccatcccggtctctgtgtggccctctgcgggaggcgagaagcccagcggcgacaggagcttctatctcggctcccagctgggccccaaggggagctgaggggtgagctgcagccactccggcgcagagaaggacacaaaggctgagggcttt

SEQ ID NO: 2425 - DNA, 2306 bp, Homo sapiens
  source 1..2306: mol_type = genomic DNA
cccagtcacagtgcaactttattcagccatataatcattatgctgggtcctgccctctttgccaccccggttgccatttatccatggtctatgtctcagggttctaggcccccagcaggatgggggtccgcagagttaggccgtgccagggagcctggtgcccacaatccaccagccagcctcagctgcaaccccccacgcccttgatgaggttggccgcctcaggaatctggcggaagaggttgcggagggtgtctagctcctgggtgagctgctccacgcggctgcggaggcgctcgttctctgccatgtactccagcaccttctgctgcgtctccagaatgcgcctcttggccttgtctcggctcttgcgcacggcgatgttgttgcgctcccgcctcagccggtactcaaggctatctttgttcactgccttcttgcccttgtgtaaggggccagccggggagggcgccttcaggaggggactgcaggggggtgcggcagtggccaaaggggcctggaggggaaggcacggagagacggagaggtgagggctggccaggaggcagagcggaggcggggcgggaatctcggcagccagggcacacttgatgcgtcaaaggaatacaggactcagagccagctcctgtctctcaggtcaaaactatcatcgctctgcttctgggagatggtgacccagatgcacagggtcctctgcttgagaccaaaactccctttcatgttctcacactttctttctttctttttttgtaaagatggagccttgctatgttgtccaggctggtctccaacccctggccttaagcgaacctcctgctttggcctcccaaagcgctgggattacaggcatgagccacgacacccagccaatgctctcacactttctgagtacactttccctcaatctgccttgagtctcccgttctatgaccagtagacatttctcacagaagcaggcggcagagaaacaagaggagggggcatggtgagcagcagagaggctggcggtgggggcctgagatcaagtaggtcagcttgccacaggggctttgggtggggattcagggtgggaatgaattcacagagaaggaaagggaggtcatggtggggtgtgaacacagaggactgtgggttgggtccatttcacagagcgacaccaagcacaggctcagcagcatgagccggggcacagggtcctgtccacaccagcctctccagccccgggcaggagggaggagggctggcctgctcttaccttgagaacgcgcagaggctggccgggtgctgccagagttgggggcaggtgcatggctgtctgcccacagtgtgccacttggtactgcaggggattgtagctgcctcggctggcagctcggctgccctctggcccccggggctcctccttcaccgccacagccctggggtcgtagctccctgggctgctgtagatgccaggccccagcgccttcctgtctgggccgaaggtatgtggagggtaggcaaagggccgagggtcaggcggcaagtagtgggggaaggcaggggttccggggcccttgaggcctctggcctcaggcgctggcttcacggcaaagagatcggagagaagctgctcttccccagactcgatgtaggcggagaggtcaatggaggcctcatgctcacacatgtcccctagctccccgggcccagctcggccccctgagaactcgagtggctgctggccaccccggggctcacactcgtagtaggtcccgtgggacatggccggcccgccccctcggctccccgcccccacctgctcttgaggcaccccttggggtgctccggctgccctctctctacctcctcctgacctgggcctgccctctctcgatcttctgccctagacctgccctctgcagtctcctctgtcacccactcctgtgtggcctctctcccccctctgctctgcttccttttccttcctctgtagtcaatgcctctcttctcttcccttttttcccctctctccccttggggtgactcagggaggggcaggacacaccccagagggagagatgtaagccttagagaaaggcgactcctggcctattcagcagttggggacactccttggtcagggaccaagccagggttctggagatgcccgaagctgatgcttctgggaatgcctctccactccctgctgggaggccaggggactccaaatcctcgcagagggcaacaccccactctgagcaacctcctccctccgactttgaaaaagttctatgcagaatgag

SEQ ID NO: 2426 - DNA, 6141 bp, Homo sapiens
  source 1..6141: mol_type = genomic DNA
gacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaaggtgacctttgacctgtacccccaggtcagatcctggtcttccatcctactgtcttctctccccacctcaaccctgctctttcctcactttgtttaaacctccctgtacaactatctcacttctgagccttttataccctggaaacccatgatcccccgtctctttggtcactgtatccctgacactcccagacatttgacctcatttctgactctcccagactccttcatgtacgacacccctcaagaggtggccgaagctttcctgtcttccctgacagagaccatagaaggagtcgatgctgaggatgggcacggcccaggtttgaagacagagaagggaggcagggcagggaactgggggaaaatggagaagggacagaactgttaatgctggagcctgagccactctcctggcacccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggaatcctcctatccctgaactcgggggaatggaatctcgctgatcttccaggactagctccctgatcattccagcccctctgaacaacagggccccaggaaaatctccaggtcctattctgtcctccttcccttttacttgaagcagtttcttgactggtaattcctccatgaacctcagcccttgagcctcttactgagagcctccctgtcccagcaaagtcgctgaaatctcccaatcacagtattctattttcaatgccatggcgccttgttctcctcacccacaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaaggtcagaggttagggaatggtgggaggttcactttggggtcaggaggttcagggtggagggggtcatgagactaccttgagggcgacagggaggaccactttgtagtcaaaagttgaacagcaggatcgttgggcaatggaggttagtgggaacctgttgggggctggaagggccactttgtggtcaaagggaagtccgtgtaatgatgattaacttaaaaagttgaaagatgtgggatttcagttgcagattggtctctggggttaaaagatggcttggaagaccaggtgaggtgatggtctcttccctctccacagaccacaagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctatagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtctctgagtctctgtggcatggtttgggaacacaggaagggtaccgattaccacaagcaaccatggcaggccaagatctcagtcattgtaagcacagaatcccagtagtggggacttgggggaggtgaggtcaaggtgaaatgggagtaggggaaggaaaaaatggccataagagatggtggtttgtgaaagttgagctttccctctctactgttgtgtccccagcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgagagaatgctctttggttgtgctacaagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacacaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 2427 - DNA, 3946 bp, Homo sapiens
  source 1..3946: mol_type = genomic DNA
gtgtctcagccacagcggcttcaccatgcacagctgggagcgcctggcagttctggtcctcctaggagcggccgcctgcggtgaggaggcctgggcctggggtgagggacagggctgtgtaggggcgtggtgctcccttccgtcacacggacggtcctccagcccctccaggtgggcaggaagggggtgtctctcctcactaatggaaggctctgaacgctgaaaaattctagaaaattcagattggaaatcggaactttctggagtcagcttttcttgcagacagagtctgaacgtctgcgtggaaaacttcatctgcgtggctgactgggctggcccaggcactggctgggtcagccccatttctcttatgtccaactggaaggcactgcgcccagggtagggcgctgggatctgcccccggtccccagcccactgtgggttctgtactctggggcattcccgcccgagggtatctgagtttgcaacgctgaggggccccaagacggaaacgggattcttttttttctttctttttttttttgatagggagtctcgctctgtcgtccaggctggagtgcagtggtgcgatctcggctcactgcaaactccgactcccgggttcaagcgattctcctgcctcagccttccgaatagctgagattataggccacgccgactaaattttgtatttttttttaaagtagagacggggtttcaccatattggccaggctggtcttgaactcctgacctcatgatctgcacccccccctccccccccgcccccgcgcggcttcacaaagtgctgggattacaggcgtgagccaccgcgcccagagatgggattcttgcggggagcggcctggggggtgagagctgggatcccgtcaggcagcctcgcccgggggaggagtccaccccgcggccctcacgcgcccgcccacccacagcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcgtgagtgcccgcgccgcgcgggggaagagcccgggtgcggtggggggagtcggctggcaccgaccgcggactccgtccggtccccagggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacaggtcggccccgtgtagcgcagtccctcctgcggcgctgggatccccggcccaccctcactccaccccgcctacaccgcgccccgggtccagcctcgacctctcctgctgcatggggaccccgccccacaacccccacaccctcaccccgggtctagcctcgacctctcttgctgcgctcggagcccccccaccctctgcaccctcaccccgggtccagcctcgaactctcctgctgcatggggaccccgccccacaacccccacaccctcaccccgggtctagcctcgacctctcttgctgcgctcggagcccccccaccccctgcaccctcaccccgggtccagcctcgacctctcctgctgcatggggaccccgccctacaacccccgcaccctcaccccgggtctagcctcgacctctgcggctgcactgggagccccccaccccccgctccccctgcatccccatcccggttccagcctcgacctttgcagctgcactggtgagcctcgcacccaccccatccccacctgcacccccacccagggtctagcctaaatctctcctgctgcactgagacccacgcccctgccctgatgcccacctcccccgtcccgtctccccgagcctagcggcattctccccagcctcgcacccccgcaccccaaccctgacgtccgcctccaccctcagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaaggtgagccttcaggcctgggaggagacgcggggcctgcaggccccgggaagggcctgcagagggagcgcgaagcggggggcaagtaggaacagggcccagggaaggggcggggcgcgtagggggcgggaactggaagatgggcggagcatgagggtggcccgtgggcggggcctgtatgagggggcggggcatgtgggtagggtggggccttgggggcgaggcctggagaaggtacggggcctctggagagggtggggctgaagaagggtcagggcgggcagaaagggcaggaacgggtgggatgtggaaggacctgtgggttagggtgggaatagggggcggggctcgaggagggggcggagtccagtaatagcgggactgcaagggggcgaggccaggaagagggttggggcatgaggggcagggcatggaggaaggggcggtacctgtggggagggtggggctggagaagggtcagggcgggcaaaagggcaggtggcagagaaagggtgggaggtatagggggcgggcacgtggaggaaggggcggggcatggggacggggcggggcaggtggaaggggcgggaacctctgaaggggcagggctggtgcggagcgggatccctgctgtggcagggaagagaaggggtcctgagcagggcagaggtttaagaccagccgaggcttgcatggtagccggggccaagattgggtggggcttaagggaggggcgtggcctgaggtgagtggggactgagcagagcaggtggccactgagacgcgttagggcagaagtgggatccacggcaagtcaaagcttggaagagcaggaatgaggtgtgggacccccatactggaaagggcttggagcggggtggggtcgggggaacacgtggtgaggttgaggccagagggggtgtggccaggagctgggggcgggcctagaggggcgtggcttgtggttgtggcctaggcgataggcgtggcgcggggctattgactagtgaagaccaaattaacacgggagggatgagcgagcattgtggggcgggagcggcagccaggtgagggggtctaacacgtgaggccggggtgggcgcgggccgcccctcacggccccgtcctgttccggcagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaa

SEQ ID NO: 2428 - DNA, 95627 bp, Homo sapiens
  source 1..95627: mol_type = genomic DNA
acagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaaggtaagattaaaagagactcttttctgaaaactgtattatgaaacatttgctaatgatgcttttcacaggagtaataaaaatttgatttagaaaatgtgcttaagtattctgtaacttgacaattgagtggcttttgacattgttgagtttaaaaaatgtaagaaccttatttgaatggtatatctaaatattcatcataattatatttaatataaaatagaataaaatgttttaataaacatttctgaaaaactatgatctggaataatcatttcccttgtaattatcataaaatgtaatttacttttttgcttaggagtataaccaaaatgtattatgtgaaagcattaagaaggatgtgaatatacatagtcaataaaagccatcaaatcataatgattagatttatttcaaatatgattttaactcttcctaaataaaaattcatttatcatttacaactgatattgtcatgaccttagaattcttgtagacaagtattacttgtattatcagaataaaaatattatataaatttgaaacccaattgaatatacaatatttgtaacagttaagttgttcaatagagatttttttcctgtagttgtatataacatatattcttgaagagcagtcttttggagtagtgaatatgaatgtaggagtttttttctgacctcagtaagacaatttctggattcataataaaatttaattatatcactgcttcttgatagattaaaaagcttattcttggaggaggtttgctttcctagtttttgataggtaaccagttatgtgatagatatttggtaaacatttttaaactgaatgaattacatattattcataatttctaaaatcttttcacttagtaaagaaattttgattgagtgaccattacatagcctctaggaactgaagaatattagcaaataatacaaatctctgtttcagtcttccaatctagaaaataaaagcagatatattcttatagttatacactttggtaatttaaaaaatattcaaatatgtttaataccttttgaaaggttgaattattttcagttatattttctaatgttattgcttgttctttggcttgtaaactttatatgtagccactttttaaatgaagaaaacaattatttccttgtacatataaatattataattagtattttaaaatgaaacctttttgtatttacaaacagttccagaacaatgtcaatattacctattgtaaaagacatctttttctgtttctttgtgtaaatatttctgtcttttcttactaaatttatgggaatgtttctaacgtttcatacctacatactgtttgctccagttttacatagataccatttgtcatataagggagatttgttttatttctaatctttaaaatcaagaatcaatggcaagtttaataaacagtttaagttattaaaaagttgaatttgaaatattattaaaatagagtacatcaaagtatatgtgataattaaacaatagtgatttaaacatcttatttacataattgattattgctgacttgtttcacttttattttatttttcatcaatgtgtgtttaaatgtggtatcagtttctactggtgaattgaacatcggcactatatatgttatggtgaaaatgatataaatctgattatttcctaaaagataaagcacaactttgtatttaaagcaatgcttaggccagcctcataattttcataaaagcacatgtaatgcaaaagccaatggagaaaaactacatgaattttcagtggatatcagactcctaatttattccttgtttcccaaatactctctgaaactaaactagttcgagatgtccatcagttctattaatctaccatatctaaaaaatttttacttaacagagtagctttgatcatgaaaaatactcacatatatttcaatatttgcttctgtttatattttccacattgaatactgaataccaaattgagaagatagtttgaatactatcacaatctgctttattcaacagcataacattttagcattacttctgctctgttaagagtgaactttcttcaaaaaaaacactattcattactaagaaagaattatagccagcaggaataatttgtaatttcagctttctatttgttttctttttttaatatattgggtactacatagaacctttctaatgcaatatattgtctacaataacatttccaattgtgtaggaacgttaattgcctccttgttttaacagtctggctcagggggtcactgcaggctactaagaattgggtcagatttacaggacaaagtttaaaataacagtttctcaatcgtaccacctaatttcacctttttgaaatatagtatgaccaaggttttgaatatattatgaccaagcagattttttagatttagggtctaacaattgtgtactatatgaaattaggccacagcccagaaattccaagatgattaaagtgaataaattaaaactctactgaaacatgttcaagtaaatactggctgtgttgtttgggagacatgttttttaatcctggagatttagagtgcagaaacgttatttcaggtcccagaagactttatagatcagagattgatggattccattacagtcagagaaaggagaatagtggtctaaaatcctaaattgtatgtttgaatttcagtgtgataaataagaattcccctttgctcccccaaacccccatattttcagagatagtagtatgtgtatttatctatatggtgtgatttaaattgtgcgatggcccaattggcttcaatatctcatctcctcctaaaatactttacgtgttgatattaatattactataatttcaaccaatctgtcatttacatggaatgacaaatacactgaatacatattttaggatagttaaatttagtattattcataatttactttgaattattatcatctgacaacttccctgaaacaatttcagtgggcgggggagggtagaaatggatgttgatgaggataagaatagaacaaagtgattctggaagatggggttttcccaggtaggacagatctgctggttgaagtgctatagtgagtgctataagagaaggggtagagaaaatgcccacagaaatggcacgagcctgagacgtctgccaaggcaagctttgcttattttaaatttaggcatatcctgggaatgcatatgctactcttttgcctacatataatttaaactaaaaatgaaatatctaagtattgctaactaaaattattcttaggtagaagtaagttcccaaatataagttcaaaagcagattggtaaatgttcttcatgtgtggcctttggtttctaagatctgagccagtctacattgacccacttttatttgcttaatcctcgattgtttattctgcagtcttttgccacttttcattcttcccagttatgccttctcctcctccccacacacaccatcccccacctgcctaggcctttgagattctgccacccaatctatcccgtgctcagttaactaacgtgtactttacccatttcttcacaaaaccatagtacatggaaaggggatgatgtaattgacaaaaaagtattgcattttagcttaaaattataaggagtcataaaaagatagctcagaggaaataaagtaactgaacatcaaaaaatgaaacaataaaaaggaaagaaaaaacatttgacagaacacttttatttcttctgacattttaacttagccaagtttttcataaaccttgttaactggaaatgtaatagatagaaaagtgattattcttccaggccgggcatggtggctcacacctgtaatcccaacactttgggaggcccaggtgggtggatcaccatgtcaggagttcgagaccagcctgaccaaaatggtgaaaccccatctctactaaaaatacaaaaattagccaggcgtggtggcgcgtgcctgtaatctcagctactcaggaggctgaggcaggagaattgcttgaatcagggaggcggaggttgcagtgagctgagatcatgccattgcccttcagcttgggcgacagagggagattccatctcaaaaagaaaaaaaaaaaaaagaaagaaagaaagaaagaaaaggaaaaagcaatattctttcagaaactcctgaactgtaacataaatttaagcttaggacacataggtcagatgtacaatggaattacaaatgttagagtttcctgggttcttgcaacagagttttaagtgcactaaacagttatcaccttgtcttctcttatattttctagtcactactgtctactacgctttttccacaggctgtccataatctacagatataatggaaaggcttccagatagtttcattgttactcatctgttctttcgctcattcatttttccatcactttaacttccacaagtactacttagtaatacttggtacaatgtgtgttgcgtttttttttttttttctctattttcagggtcctaattgtactgtctctttgtggctgagttcgttttttgtgactggaacaataactggcattagaaattagctattcaaatacacatttcaagaaagttgtggaatttcaacccatgttctgatagtatcttgttttatctctaattatgacatacttgttattctatccaacttcatgtgactatcgtctattctcctatctgctttttatggttctggaattttcttcttgctcttttcactgttaagttgtttgtttgtttgtttgtttgttttgagacaggatctcgctttgttgcctgaggctggagtgcccacgctggagtgcagtggtgcgatcatagttcactgcagcttccaacacctgggctcaagcaatcctcctgcctcagcctcccacacctagctaaatttttttcttttcttttttctttttctttctcaaatgcctattaagtgtgacataatctctattctgctttgtctctagagtttgtttctttaaacaattctttactctgtttacaaaggtatatatgttacttctgaaatgatctttattctcatgttatttataaaataatttgaatatttcttattttgaaaagctaattagatcatatcgtatatatgcatatagaattgacccttgaccaatatgtgcttgaacttcaggggtctgcttactatgtgaatttgtttcaactaaacctgggtcaaaaatacagtattggtgggttgcaaaacttaagcataggaaaaactgacttttcgtacatgcggtttccagagagccaaatgtagaatttaagtatgtgcagattttggcctgtgtgggagtcctggaatatatatcccctgtgtataccaaagccaaaggattattgaataaatagtattactatagatcagtgagaagataagaaagaaatttaatgcaaaatacctatttttgctatttctgttttgttcatttgctttatttttttccaaattgattttgtaactttgctttataatatattctgatacctactaagtttagaagtaggctatttaaaaaataatatctactgttttttatgcacaaaataattttagaaaaatagaataattgaacaaagagaccaactttagtctaccaaaacaatctagcacaaatttgattaaggatttcccaaatatataattttatcatgatttatttcatttgaataaaaacacttttcaactaacagttaaaagatatattgacattgaaaataagtaattagttctatgtttgtatgtcaataataagtaattagcttggtgtttgtatgtcaataatgcccccttaaaatttgaaagtgaaaaaattaggtaaattaagattattaaaatattaagtaatattgatttttagctttgaccaaaattatataactattttcctcaaattatagtaaaaacattcctactctttaccagtagttaaacgtattcacactcttaattcatgggctaaaaaaaaacttgattttgtttagtattattcttacttttttgagacagggaatcactttgtcacccaggctgcagcgtactggtgcaatcatggctcactgcagcctcgacctcctgggctcaagcagtcctcccacctaagcatcccaagtagcagggattacagccaccttgctcaggtaattttttttttttttttttttttgagatggagtcttgctctgtcgcccaggctggagtgcagtgtcgctatctcggctcactgcaagctccgcctcccgggttcacgccattctcctgcctcagcctcccgagtagctgggactacaggcacccaccaccaagcccggctatttttttgtatttgtagtagagacggagtttcaccgtgttagtgttagtcaggatggtctggatctcctgacctcgtgatctggtgatctgccggccttggcctcccaaagtgctgggattacaggcatgagccaccgcgcccggcctgctcaggtaatttttaaaattttttgtagagacagggtttcaccacgttgcccaggctggtcttgaactcctggggtctattgatcctcttgacttggcatgtcaaagtgctgggattataagcatgacccactgcatccagactaaaactaattttaaattgtaaaataaagccaaatgaattaaagcttcaccaatgtagtgttttgtaaacaaaattaactggcaattaaatgacttgtaaacgtaagatgaagtattcattgtttaaactcaaatacttagatatgatggcttagtctactcattaatctagaatgagaaaaatgagatggctatttcttttagttttaagataaatcacatctcaaaaaaatgtttctgtgcctttcaatttgtatgcatcctatttaataagcccgttgtacatacatgctgagagtttgactacttgggccaaaataaccgtttgttgtctacttgaaggtggttcaactgagcttgaacattcgattgttagtcaattcaggcaaataaaagttatgtcacaagatatacctaattattattagaactcagtgcagtgaatcattaccttaaatacttttgctatggcatgagttgataatgatgtaggacagcaagcccccaaattgggtcttagcctgggaaggttcttggttttgtccagtaaagaattcaagggtgagcctgtggtgttaaacagcaatttttgttgaagtggcagtgtatagcagcctcagaggcacctctccttgctaagcagggctacccataggcagtgtgcccacagtagcagctcagaggcagttctgcactcatatttatatgcacttttaattatatggaaattaagaggtagttaatgctgaaattgccaggaggaggatggtaacttccggttgttgggtcattgctgtggaaagggcctgtaacttctgggtgttgccatggtaatggtaaactgtcatagcacactggtctgtgtgtcttacagggaggggcttccactcagacctgttttggataatcctcaatttggtccagtgtccaagtcccatctcctatctcaataatactcaatacaataatggttagaacaaaagcagacaggaaagtgtatctgaagtgagaagacctagacattaatgaaaattcttccacgaactatgaaaaacattgttcttcaattgtggggagcttacattttgatgtggggagatagatagaaaacctaatgaacaaaaatagttatagcattgtgaaaaattttgtgaaggaggtaaagtagggcctaagagaaaatagagatggggatggtagtatgtagagacattaggtgggcttggtcttggggactagaatgagtggatcactttgaggacagaacatttgagtagaggcctgaaagatgagacaaagccagtcatcagaaatctgtcgtaaaattattctaagaggaggaaataacccgtgtaaaggatctaaggaaaaaataagtttgaaatgctcaacaaaatataaacaaataaatcagcgtgactttgcacagtaaatacatgggagatttaacatgatgagatccgagaaagtggcaagagccagataaggggttcccaaaccaaggaaaggagttagcaatgctggataagtaaaaagtgaagtcatagaagaattttaatcacaggaatgacatgaccagatttgcaagaatcacttgtcactctgtgaatagactgaagtaacaggagagtagaggactggaggctagttagcaggcaagtttcatgaccaaagtgacagatgatgatctgaactaagattttgaagatggtagtaggagcaagggaaaatagaacaggggcggtcatatctttttcttacaagcagaatcaaaagatgccatttaacactgatggaaaaagcaccagaattttaagtactatttgaagagaaaaggtaatcaatatgataattctttatatatagtaaacatattcacagagtaaatattgtgagaagttggtaggaagattttgtggaagagatgtatccttgttttctacatctggttgttaaaagcaatgaactatatttggaaatcaagaattaggggcacaaacgtatcacctggaaatataataataaccagaagggaaagcatttacttctcactaggaagtgagcgggctaaactttttttgtgttaatggattactttacttatttattttttccaataacctgaacatcatcaaatggatctaaattttgaaagtgaaaaacaaacatatcagcttgtaattaatcagttttccttttgtgcggaaggggccggggattgtgttgttatgatagagtattagcaccatctagtggagtagaatatgtttacttaaattataaacatcgaaatagtgcaatgtggaatcacatattatatgagttcactaatacaaatttgcaaaaaggtcaagggaaaattagtgcccataaaaactttcacattattttgtaaaatataattttatatggtgttttctttcttatgaaatattgcaaaatgttttcatatggatttgttccaccatgttaatgggcacttctaaaacttttttctttgggctgctacaacaaaatattattaactgcctagcttataaacaacaggaatgtatttcttacacttctgaatgctagaaagtctaacagcaagatagtaccagcagattcagtgtttggtgaggtctgctctctggttcatagacagtgccttttggctgtgtcctccaatgatgaaagggacaaggcagctctgtggtgcctcttctataaaggcacacatcccaaatcatgacagctccaccttcacgacctaatcacttcccagtgtccccacctcctaatactatcacattggtaattaggtttaaacatataaattgggggttgtggggaggttgcatgtattcagagcatagcatatgccttcttaacttactaaagtctaataataatttatcactcaggattcaatgcgggaagcttaagtagaagtagaagattacctatctatcagtcaattaattgattgacataccaatctcctatctacctacttaaaaagaggttttgttttgtttgttttgttttgttttgttttttaaataaattgcctcaaggaattgtgagcatgagataagcaagtctgaaatccacagggcaggtagtcagaaaaggaagattacagacaggatggaactcacaggaaaggaagctgctttccacagaattccctctctttttcagaggagcctcagccctatgtttcagacctttcaaatgatttgatctggcctatctagattacctagaatgatcagcttgtttaaagtcaactgattgggagtgtatctggcaacatattttctcaccaacatttagattagtttgactcaataactgggaatgctgacttaagcaagatgacttattaagaaaactgtcacagctcattaatacctttctgtttttctggacactgtgaagaacttaaaagacattaattttattaatccttctcacagtttacctactattgtcatgtgttttatgtatatgggtgtatacacatacatgtttgtatttaaaaccatgtaaggtaatatttttattattttatagtcagtattcatttatatttacttgaacatttaccattttctttgtttttcatttcttctttcatcctaagaccttatatttaggatcagtttcagttttctgaaatatatcttttttctctccttaatgtgtatttatagtggcaaattctctcaaattttattaatcagcccgggcacggtggctcactcctgcaatcccagcattttgggaggctaaggtgagtggattgcttgagcccaggagtttgagaccagcctgggcaaaacggcaaaacctcgtctctacaaaaaatacaaaaattagctgagagaggtagtttgtgactgtagtcacagctacttggggggctgaggcaggggaccacttgagcccagggggtcagggtcgcagcgagctaaaatcacaccactgcactccagcctgggcaatagagatcttgtcaaaaaataaaataaaataaattttatgaatcaaaactttattctcaaaaaattatttctgtatatagaattctatatagatagttatttcttcctgaaaatggaagtgattaatacctggtggcgtctgctattgctattgagaagtctttgtaaatctaaccattactgcttttaaattaatatttttctctaacaaggttaagatattttctctttggttttctgcatattccttatgatgcatataggtgtgtttttttactgcttggaattttttaattcttggatatattaattggtatgttccattcattttttaaaattctcttccaacattgctctggcttttctatcctcattgactcttagctcatcttgtgtattttccacacatgtgtgtctccatgttgcatcctgtattatttcttttgacctgccctcctgtccacgaattctttttacaactgtgttatctgctattaagctgtccattgatgattaaaatgggttttttcatttttagaaattatatttggttctttttaaaatctgctactactttgttataatttctttcctcagatatcattagtcaaacttttctcttacatttaaacaacagaattagtattgttgattatagtctgtatatatttattccaatatcaaatatctattttgttccttatgaagtttatggtaactaggtgctttttctcccgtataatgtctttgacatttgtaataataatttggtgcttaagaaaaaaatcttcctcatattaaagttacaacttatcttttctgggtggctagaagaactttcagtgtgagactaccttaagccaaatttgtgctttaaaattccttggtgctctaagcaattcaaagctgggttcctgtaagaagagtgtggtttacttccagttctcccttatcctgtgggtgaattcatttaggtttccaactttgaattttgttgctttagcctaataaggctatcaaaaagcaagcttgtgtcttccccaaatggtgaatgcccacagtgcagaaaaaaattggctgcctgttttcctttctgggttctgattataccaagatatgttatggtaattctttactgtctcgtcagctttctaaatgcctctatgaaagtatttatttcaaaacatatgttttcctgtttttttccccttttgtgacagggtctcaccctgtctctcggctggagtgcggtgacatgatcatagctcactgcatccttaaactcctgggctcaagagaccctcctgtcccagcctctcacatagctgggacaacaagtgtgtgccaccatgggtaactaatttgtttctttaattttttgtagagatgggatcttgctatattgcccagggtggtctcagactcctgggctcaaggggattctcccacctcagcctcccaaaatgttgggattacaggtgtgagccaccatggctggccacctggttttattgtgaaggtgtcctaagtgataagattaatctgaaataatgaatcccaaggcactcaaattttttgtgaaatagccagacaataaatattttagacttcgtgagccataatgtctcgctactcagctcttctattgtaacataaaaggagtcatagacaatatataactatatgagcatagctgtgttctactaaaattttatttacaaaacaagcagcgattggatttggcccacaggttagttttctggcccctgacctaatgtatctcactataacagaaaatatatactgactttccttcttactattataaattttatgcacataattaaatattacccaaaccacaatttttaattcagatgggtgtagcataatttgacaattttcataaatattctaattatatccattattaaaaatgctggaataaacactctgtacctaaatatttcacaaaatctttaattattatttgttacttttaaaaaattgaaattatttgtcaacttacgtatgagtacttttaagattctttattgctaagttgctttttagtgaagtaatagtcatttatatttcagttttatttaataataatatttatattacctaattttccagcaaaattgattatcatctcctttacatttttgtgttaaaattggtcaaaaaataattttcttttaatttttatctcttttaattattggtaatggtcacgttaatgcctgttcttaagtaaatgatctatcctactctaacatttttctttagatagtgtttagtgcttttgttactgcaagaagtgtttgtgttaagaataatttttcagttaaattttctccacattttgtatatatgattttttcacaaatataatttttaattaacaaagttttaatgtgtatatgttctgtttgcaaattgctttatgcattaagccttccttttttgatatttattcatactttttaataaatatatttataaaataaatataattatagatagatggcactaagataatagtaagttaaaatgacatatcatcatatatagcagataattaaaaaattataaaagaatgaaacatatatgtatttattttaaatttgtttaaacctaactctttagtctacctggcatttgtgtgcatgtgtctgtgcaaataaagtaaggattcaaatttatcccatttcatttccagtgggttttattttttatttattattattatatttttttgagacagagctttgctcttgttgcccaggctggagtgcaatggcgtgatcttgggttactgcaatctccgcctctcaggttcaagagattctcctgcctcacgcccccacgtagctgggattacaggcatgtgccacaacagttggctaattttgtatttttagtagagacggggtttcgacatgtttgtcgggctagtctcgaactcctgacctcaggtgatccacccatctcagcctcccaaagtgctgggaatataggcgtgagccaccgcacccggccccagtggattttaattgcaagcctgccagagtgagtttcaatttgaggtagtccaagtttacacagtacgatagacttacccattgccaaggttacttggcttgaaggaaaatacagaataaggataaaggcagtatgcacaagaacagcttgatggagatttcaggcactgaaactcagcttctaatatcttaacccccaccaggataattttgctgatgaaggatgaaagttgatgccagtataggtcacatccatgcccggtaacaacagaattgggtatccttagtttaaatactttagttgtcaccttgaacttggagggtgatttatgtgatcatcactattatttgctgttttctattttctttagatttcatttaatgttttactagtttcttgaattagaaatttggataattgatttccaacagttttttatttctaattcattcgagttatatttttttctctctaatcagtgcttcagcatcagcccacaaattttaacatatatttccattattgtttatttcaaatcatattctcatttatattatatttttctttaactcatgagttatttataagtgttgcttgccaagtgcggtggctcacgcctgtaatctcagcactttgggaggccgaggtgggcggatcacttttgggaggccgaggtcaggagattgagaccatcctggctaacacggtgaaacaccgtttctactaaaaatacaagaaaaaaaaacccaaaaaatagccgggcatggtggcgggcacctgtagttccagctactcagatggctgaggcaggagaatggcgtgaacccaggagtggaggttgtggtgagctgagattgggcactccagcatgggggacagagcgagactccgtctcaaaaaaaaaaaaaaaaaaaaagggttgcttaacttcaaaaattttgtgaattttccacttattttctgttagcaatgtctagtggtcagggagtatacttagagtggctttaattttttgagattggtagagatttgcttggaatgaatatgcatcttgcaattgttgaagacagtgttttattaatataaaaaacttaatttggttaataatgttgcttatatcttgtatatccttatttttctatttcttttctattggatattggaaacagtgtgcttaaatctcaaactatgatggtggattgcttacttcttttatttctgttatattttgaagatgtattaatagttttatgcaaagaggcatgctggtaaatgtaaaacaaccaactattttttaaaaggaaagggaacaaccatgatttgtaaaatttgctgagtttcatggtgtaaattctcacaatatggtcaatttcaagttaccaacgtgtcatcaggagacattgtattagcaaaagatgtgtataattggctcctatgagtcagtatgagccagctccagcaaacattgttcagacacatttgcaattattacatctttctgttaaagtagcctttttattaatatgaaatgactctctttttatctaataatactttctaactaaaattatcatttgcttgatattaatacattaatatcattcttactttggttgatacttttctagcatattggtttttatcatttactctcaatttatatgtacaattttattaaaagtaatcatcatatatttgagttttcttttatgcttttatccagtcagacaatctttgtatgtttagtatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaacatgcttaaattattacaatttattctaaattaatatttttaccacatcaagactatggggaaaacatcacaacacttttattttctttaccttttcctgacacttttgctactattgtttcatattatactcttgaatttattaaaaacactattaaacatggtctattgatttaaacagtcaaggctcttttttatttgagtaaaatatacatagcatagggtttatcatgtttcaatagcttttttatttactcttctatttattttcttcagttctgcttattcctttttgtacttctttgcttatattttagatcagtttccttcagcccagagaacttttttagtatttttctatagttgagtctgctcttgttgaattctttctgcttttgtttgcttaagaatgtgtttctatttgctttcatttttgaagtatattttcaccatttatagagttctctgctgacttttaattttcagcactttagtaatgctaagacatatatattcagacttcagtatttacttccacagacttggctgttatttttactattctcctggaaaaaaaatgtttcctctgtctgtgatatggtttggctctgtgtccccacccaaatctcatcttaaattataatctccataatcatcacatgtcaagggaggaactcagtgggaggtgactggatcatgggggttgtttgtcccatgctgttctcatgatagtgagtgagttcttatgagatttaatggtttaagcatctggcatttccccaacttgcacttctctctcctgctaccatatgaagaagatcctctcttcttcttcaccttccactatgattgtaagtttcctgaagcctccccaaccatgtgaaagtatgaatcagtttaaacttctttttttatgaactacccagtctcaggtaattctttatagcagtgcaaaatggactaatacagtaaattggtaccaaggtagtagggcactattataaagatacctcaaaatgtggaagtgactttggaactgggtaatgggcagaggttggaacagtttggaggtctcaaaagaagacaggaagatgtgggaaagcttggaacttcctagagacttgttgaatgctttagaccaaaatgctgatagtgatctggaatatgaagtccaggctgaggtggtctcagatggggacaaggaacttattgggagctggatcaaagatcactctaactgtgttttagcaaagagattggcaacattttgccccttccctagagatctgtggaactttgaactttgagaaagttggtctgaaattggaacttatgtttaaaagggaagcagagcataaaagtttggaaaatttgcagcctgatgatgcaatagaaataaaacccgaattttcttgggaaaaatgcaagcccactggagaaatctgtgtaaggaatgaggagccaaatgttaatcaccatgacaagggaaaaatgtctccagggaatgttagtgatctttaaggcagcctctcccatcacaggcctggttgcctcggaaggaaaaatggttttgcaggcctgggccccactgctgtatgcagtctcaggagttggtggcttgcatcctagctgcaccagctgcagccatgtctaaaaggggccaacatacagcttgggccattgcttcagataatgaaagccctaagccttggcagcttccacatggtgttggtcctgtgggtacacagaatacaaaacctccacctagattcagaaaatgtatataagtgcttagatgtccaggcagaggtgtgctgcaagggaggaaccctcatggagaacctctactagggcaatgagcaagggaaatgtaggattggagcccccacacagaggtcccagtggggcactacctaatggagctgtgagaagagggccacagatcctccagatcccagaatggtagattcactgacaggttgcaccttgtgcctggaaaagccacagagactcaatgccagcagtgaaagtagccagggcagggggccataccttgcaaaaccattggggcaggtctgcccaaggctgtgggagctcacctcttgcatcagtgtgacctgaatgtgagacatggaatcaaaggggactgttttggaactttgagttttaatgacttccctattggatttctgactttcatggagcctttggtccctttgttttagccaattcatcccatttgggatgggagcatttacccaatgcctgtattcccattgtatcttgaaaatgactaattttcttttgattttacaagctcatatgtggaagggacttgccttgtctcagatgagactttggacatggactttagggttaatgctgtagtgagttaagacttggggggactgttgggaaggcatgattatgttttgaaatgtgaggacatgagatttgggaaaggcaaggggcagaataatatggttaggctctgtgtccctacccaaatctcatcttaaattgtaatcaccataatccctgtgtgttgagggaaggacccagtgggacgtgcttggatcatggggcagtttctcctatgctattctcgtgatagtgaatgagttctcatgaggtttgatggttttataagcatctggcatttcccctgtttgcacttctctcttgccatcatgtgaagaggtctttccttccccttccaccatgactgtaactttcctgaggcctccccaaccatgtggaattgtgagtcaattatatctcttttctttataaattacccagtcttgagtatttcttcatagctgtgcaaaaatggactaatacaatctgcttttaagattttgcctttatctttggttttcagcagagtatcagtataggttttcttggtatacagcattttgggggtttttagaaattttgattttgtgagctgatttctttcatcaattttggaaacctttgagctattgtttcttcaaatattgcctatgttcattttcttctctattgttagaattccaattaaacatgttttataacttgactctacaccacacatttttttatactctgttttgtttgttgttgtttatacacttttgtctttctatatttccttttggttatttttacattaaacttcctctaagtttaataagtttgtattgtgctgtgtccatttgattcttaaaaccatctgacaagttgttatttctgatttttgatccaattttaagatagcacatgatttatgagtcaattttattttgaatatcttttttaaattttcatttctatattttctatagttcctttaatgttcctaaaatagctgttataaagacctaacactaattctaacatctgaatctgagtgtctagttctactgaatatttattttctctttttgttcacagttgtttttgcttttttgtgtatcttttaatttttattcaaaatcgtatttttaaacaaaaacatgtaatgacaaaagtttatataacttactctcatcaacaagattgtttgctctttcttgagccactcaaaaatttaactcagagggacctgggtaacacttttagtttgagtcagtcccatttctggtttctagtctcaaagattaaaccctcttgggtttttaaagtcaagaatctggttggtttcttctatctcaaaagactaatacacacacacacacacacacacacacacacacacacacagagtatatacatatacacatatatatacataaatataaatatgtgtatatatatatactatatatgtgtgtacatatattagacttttgagatagaagaagccaacacatatatattatgtatgtgagcatatgatatatatataataaaagccatttatatatatgtttgcttttctgctgttttgactctgttcttatatatatataatcttaaatgctcatatataaatgaaacagcagaaaagtgaacatatatataagagcttttattatatataaataatatatatatgtatacagcttttctgctgttttgacatctgctcttaaatatcatccagagtgactttcaaatatggcatgttttgatgagaatactagttgtgtatttgagtcagatccattttcttattgagactttttttctatgagacaacgggaaagtcagtcttcccgtatgaagctacctagactctagcaaagcaacctgatttggcaaagtttcagaattcttcatgctagatatagcctccttatgtttggttctttcttacctcattaccattcttccattcagactaaatagaggcctgatcttcaatccatatccagagctgacaaacataaccaggtaaaaaatggccagagaccctatatttacttgaaacaggtccttcctacttgtgttttgttcatttaatcctctttgctcccacaacttacctttgaacatacacatgcacacacaatttgttgttgttccaatttggagtagaaacattgttcttttccatcctattctatcttatttggagtgcctgtataattctgtattaacttatcatgctaatttttgtaaatataatttttctacctgtaatgcatattatacatctctttgattacttaataactggcttccctaatagaatggaaatgctttgagaacagatagtttgtttcttcattgttttttctttataacttagaatagtgctcaataaatatttcccaaattaatggaagaatagtagaatgctctccagcaattaagagtaatataacaaaatatatctattgctttgcaaagttttttaggtgtttttccacagtgaacattcttataaaattatgtagatacaaattttataaggtgaaatgtatagttacactacatgcatgaaatgtatgtttactccatagatatggggttaggagagagagagagagagagagaaatttagatagacctgtgactgtctaggcatttttaaaagcaacaattacctaaatatactgtacatttaaatagacactttatgcacttattttgtttttattgtttgtagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagagtaagtacttaatacatttgtgaaatttatgaaaactaggtgtaaaaatacttaagatttaatattgtagcaattatgcctgaattatatcactattgccagtcaaatacaaaataatacataatcttttttttttgttttgagatggagtctggctctgtcacctaggctgcagtgcagtggcgcaattttgagatggagtctccctctatcgcctggctggagtgcagtggcgctatttcggctcactgcaacctctgcctccctggttcaagcaattctcctgcctcaacttcccgagtagctgggactataggcacgtgccaccacgcccggctaatttttgtatttttagtagagatggggtttcaccaatgctgggcaggctggtctcgaactcctggcctcgtgatccacccacctcagcctcccaaagtgctgggattacaggcgtgagccaccgtgcccagccaatacatcatcattttcaaaaaggggtggtcatcctccaaaattaaaaaagcaagcatatagtttaagttcaattatgaaataatggctttgctatgtttaattttccttacattcaatctgtcttcttatataatatcaaatatacttgttcccccactcctacataaaatatattccttgctattacatactaattcataactttttttttcgttttagaaaggccctgtggacatcctggagatactccttttggtacttttacccttacaggaggaaatgtgtttgaatatggtgtaaaagctgtgtatacatgtaatgaggggtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcaggtatcaattgctaggtgagattaattaccgtgaatgtgacacagatggatggaccaatgatattcctatatgtgaaggtagacataaaatgtatttacaagtatattgaaataaatatctaagatttaaaaaaagtcttacattaaaatatcttaaagtctctattaaatatttttatttaatgtttttttttctcatacaatgtagagtgggaatctagtctttttattactacattcttggtgtttcaaaagccaaaaacgaatgcagcctgatctgatataataattgaagtattagacattaaggaatctaaaactgatttttatttccttttggattctaatgactagaaacgcatataagcatcattagctaaataaagaccagaattttgcctttattaatgaagaagaactcacccagtaaccacccaaatgcagggatctatggtaacagctgaagtggagaacgtgattgagacctcccactaagggaggttgcctgtggacttacctttactgaaaagaggaataaactaagggcgagctctgttatttctcactggtctgtaaagcaaacagtgaaaatgagaaaatgtagattctgttttcatgttttgagctaataatccaaatctctagtcattatggaaataaaagaaatcaaccagagtagtatttcctaattccacagtgagtggcaagtggagagagatacagaagaaacgtgataatcattcaaaaactgtcaactacagaaaataatggaagattttttcatctatgaaaattggaggaagaagattaatggtctagggaacatctacattgaaatcacctgggatgcttgttaaaaactaaaatctttggttactaaaaaatgacctactgaatcagtatctttggggtgagcatgcaggaagatagccctaaaatttttattttaacaagcatcctgagtcattctatagtacaataaagtttgaccacaactttagagaaattggaaaatattaagtagaatcaaaagaactactcaaattattttaaacacttaggtcgaagaggatggaaaattaacgatgatttctctattgaagttaatgtcataaagtttgcttttacatcttttaggaacacagtgttatattattctagggcataaatgaaaatgtatttaattatctcaagctttatatttcttaattatttaaaaatactagtttgttactacaaaaatacaagctagcattgaaagtagtaattttcattgtccactcccatagaaaagaatcaggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacatttaaaacatcgttcattctaaggaatatcagcaatattaacaatagctaatgtttattgagcacttactatctgcctgtaattgagctaagttctttgcatgcatcatttcattttaactttcaaaaaactccatgatttacttactcatcactttcattttataatggaagagactggtgcaaagaagttaaatcacatgccctggattatcatggcataaagagtcaagttaggatttaaatgtaggttatctgacaccagagtccatgctttaaccataactccattgtagttgtctcttaggttgaaagagaatgctaagtatttctgctgcaagctgtaagacctctggaatagacatttgtttttattttgaaagccaaagattcattatgtatttccagagatacattagaatgacattcgtttttgaataacacttttaggaagcagacctattttatatttgtactgcaagtttactataaatgttgctgaattgaacagaatccactaaataaattgttgcctcttaaaaaaagttttatagtaaactgtaagccaggatttttttagtcataatactgccaacctgtgcatcatgaccaatcaaagattttggcttctgtgataaacatcgtggttgatttgtttagtagtaccatagttcaagttcattttaccaataattgtttggcagaagtttctggcatatttatattttaatattatctaaaatatctaaattatttttactattaaagtctgttatatcttagatacagataaaagaatttctcttcttaagaacactttgtaacaacaatagttctttatgttaaatctaatatttttattcagcatagcaaatattatgtactttagaagtacatggatggaatttacatccttacaactagattcctgtggttagtgaaaacttcctggaatggctgatgcctacgattaagtcttaaagaaaaaaaacgagattttgtagatgaaaatgagagcaaaagcataccagagttcagggaaagggaagtggaagggcagtgaggctttaaggagcatgaagcaccactgattcttgtccattgttcctaggcaccttagtctaggatgcaagtagggaacgagtcagtgataaatagaaggtgggccaatacatagtgctgaggtgctgcatgcaccatgctgaagaacgcgtcttttattcagattgatttgggaatcaatgaaggatttcaagtggagttacgatgtgtctacctgagaggtcattaagctatacacaaggaaaatggattagaaagtgggagaacagagtttgggaaactacttatgattggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatcaaaagtagagtgctaatttatgtaaataaactattataaaaaacatatagcattttctgtgttcaaggttcattttgagtacacttcgtacgatacacacactctgaaaacagacataaacagggccagaaaagttcagtagcttattaagtcattggtctatcatcaaaaaccatgtctggatcagagtgaggactataatagacttcctaattctcagtaacatacaattctcaaacaagtagattgctccactaatgcccagaatttatttaaattatatgaatattttaaaatactttaaaagtaacttgtattaataccaggtgaggaaactctcaactgacaatggaattaagttgaaggaagtgaatatttttgttaacaacaggcccagtatgactcaacggtgatgatggtcctggaaaattaccaaaaaaaaaaaaaaaaacctctcaactttcattatggagggatgttacacagagccaaagagttcatctcaactgtgctctttgcccaccaaaaaatatatctggaatagagtgttctacttaacctacttcattttaaacgggaaagtttcaaactatcatggccaagaagagagaatatggacagttgtggacttttaagaaattatgccataagacgtacagtaagaagctacagctatagtgtggtgataacagttttgagatattttcaaacatttataaaataagtgggtttgcttttgatgaggtctgctgcaattagtgaaacaaggaacagtgttaccacatatggtccagaaatctaaaagggtgatactgccatactgtgagagaaagaagagttgaactcttaagagccctctgaactttaaatcccatgattcataaatacatgtttaaactgtgctttagtaatcctcttttacaaaagaatagttaattttgggttaattttatacactaaaaaaattttggtttgagcccacaagtgtctccttggaaaacatatttttcttcacaattgcgtgatctctacttttaggcactgttaagagaatattttagaaagaaattaatgaacatgagacagtaataacccacatcagatccatgtttggctaatggtgtgtggggtccaactatttgtcttcatggcattcgtagttcctaagcaaaggaagtgcatgcacaagtcctttggcattaacttctacctgaagtatattatttccagagcccctctcaaatctatagtgaatttatccatgcagtaatcaaaatgtaacttataaaccacttattttacatcaggaccttgctgtgtattgaagataaacattgcaataaaccatcattccagctttcaatgaattcaaaataagactctgggaatttagttttatttgaatatgtgactctgtagcattactacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttttcagaagacagttcactaataatcgatataaataaaggaggatttatcccaaattagttaagcatacactctctcaccacgttttattttattgaaatatactttacgctgattagatatagagaagtctttcttaataaaagaattccactctttgtatgccaactaatatagcataaatatgactattttcttggtacaaagcaaggatctacttgctgatataagatgaattcaaaatctatacacatcattttctctgaaatcaggtaacttcaaactctctttgttgcttctaaatctataagaagtttggaattaaataataagataatattaaagtgaaataatctacttaaattttaaatactttaattttcttcaatctggtctatggcacacacatgtcagaggactgatttaaaggtgaattgtcaaaactttggtctctgtgtccaatagggacaatctgtaacagaaagttatttatagaaacaatcaaaggtacgaagaactgctaaaggaaagctatctttgatccgaatctatctcttccctgtacagattggattttctattggttcaaagcatagagtgctaaccttgaattagtattctaacttcaaatgaccaatggttgtttccaatagtaggaaaatatggatagtctcaagtattgttttggataaaggtacaggttcgggcaatgttttaataacatgatgtatttttaaaaagattatgagtgtaggaaattaaggtttatcacaggatttatgtctactgcttgagcataatcaccagaagtctttctattcttaattaacaaaattgttccatattattttattgatttcttagttaaactcttgttttttgcatctcatagcttttgacttcaaaaattggtattaaattgagctatatcataaggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgactaatatacaacttatgagaaaggaatggtggtagtatagagaagaagtagaaaaatggcaggagatgagatgtgacaagtatgcagggcccaaaaattaaaaaattaagtaaagtacaagaggagaagcaaaaaatataaagtaaaggaaaataataagatataaaagaaaagcatcacttagacaaagacaaggagaagcaggagaacataaatatataaggtaatggagaacaccaaaaagtatgtaatcaacagagtcaaatattacagagttttatctgttcagttcaataaataattaagaagtccataatatgtaccagtgactggaatatgtgaaatgcaaagcatttctgaatttggacattgggctcattggtagcttttatcagagcaatggcaacaaaatagaggtcagaaactaggtagtagtgagttaaagaataaatgtgagacgggaaagtggagacagcaattataaaatggtattttaaggattttggttttgaaggggaggagaaatgtagtacattagctaaacttgaacaaagggttgagtgaagggactgaaaattggaaaagcttccatatcaatttaagagtgtggttgataaggtaagaaagagggaaggaataaacaatggtttaaaatacaggggaaaatgaaagaattaaagctaacctgaatttgaaagcaacactttaccactgaagactaaactaaagacttaaatcagtatagatacagataatgttgaggagtgctggaaagaagtataggaaactcactactgctggtctcaattgttttgtgtgaatggagacttattatctgttgatgaagaggcaattgtttcaggtggcttgagaaaagagaggagactatggatcatttaccatgggaaatcaaatagtaaataaattgggggtatataaatggatttcaagcaatgctgaatgtttgccacagctttttagtccaaaataaaatatgactccaatagaagtggtcatatagtttttctacaatacttaaaatgcatagtattttatcttaaaacgaattttgcaaatggatccaatattgagatatagcagagttaatggaaaggagtgagaaggtgccttatagattaagatacactgggccaaaggatggcaaactataggctgcaggtaaaatacaacttgccccctttgtgtaaacaaagttttattgaaacacagccaagttcatttgtttatgtattgtttttcattacttttgtactataatggcagagttgagttgttgcagcagagacattttatctggccctttacggaaaaggttttccaaaccctctgctattttatcctattatagtaagaaaaatgtaatgcagtatctcaatgtttaagatattaagactgaagtttattttcattcatgttcactgtcaatgtagatcagaagggactttactcattgtattaattgtaagaatcaagtgacagaaacatcattttttttcatgtccttctttaatcgcggtatctttgggaaagagaacataaaaattcacacaatggcttttaaaacttctctctaaagtggaagatattacttccacttttattatagtctcctacgcaatcacatggccacagttacttcaaagaggaagggttgcgcagtcctatcaattgtccagaagaaagaaacactgaatatttgtaaacaatccttatgagaaccacagaaaccaaagaatagaaggaaagtgaaagtaagaattgaagttatatgtgatgagaacattgccagttatggaaaatcatgaagtatgggatgactttggagaagaagggattaagagcccaggaggtacaaatatgtcagatgagaatatagtgaagggaaaaataagtgatataccagaaaggatactatgatatgttcattttaatgccattttgtattatgctaaggacaaataaataacacccacttttaaatgtttatataaatgattaattttaacggatacttatttctgcattatccatatatcctttttcttttcagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctgtaagttccattcatatcttgacccatttcttaattctgaaatttcttttaaacacataaaaaatagggactcaataaaaccaaatatttgtcttattgtatatacaaagtaaggctgttggaagcattctttagttttcgaagttgccgaaactcatattttttgctactcaaaattaaatgtgtatgtgtgtttatgaatgtatgtttccctaattaataaattattccaatatctgaattaaaacactagataaaaataatgtcatctaacacatactatattagttatttattgcattgtaacaaaataccccaaaaacatatttacttaaaacaactaacctttattatcttacagtttctatcggtcagtaatctcaaaatggcttatataagtagttgtgaatcagactgtcttcttgtgttgcaatcaggatcatggcccaggctacagtgatcagaaggcttggctgggaaggaggatctgcttctaacattactgacacacatggctgttgtcaggaggcctcaggtccttaccacataggcctttccatgagttgataaatggcagctttctccagcactgctaatctgagaatagaggaagccacaataccatgtattagtgtgttctcacactactagaaagaactacctgagactggataatttatgaagaaaagaggttaaattgactcacagttccacagcctgtacaggaagcatggctgggaggccttaggaaacttacaatcatggtggaaggtgaaggggaggcaagcacatcttaccatggcagagcaggagagacagagagcaaaggggaaagtgctacacacttttaaacaaccaggtctcatgagaactcactcactatcatgaaaacagcaagggggagatccacctctatgatccaatcacctccctcaacattgggaattacaattcaacatgagatgtgtgtggggacacagagccaaaccatatcaattatctactcacacactgttaacttcagccatatctattctttcgaagtgagacactaagtccagcatatatccaaggggagagaaattaggcaccactatttggagggaggagtgttgaaggactccaagtcttagtcatttcctagtgttggaggtaatttccaaaaatcatcacatgtagcaaaataccactcaagtcaatagagtattttatttctgggatgctcctttacccctttttaatgttttttctatctctacaatcaaatttcttttctttctatctataagtacatagacaagaagtactacacttaaactatatattccatgaaagaaaaatatgatacaaatgattgattaatgacttcaactttaattcctggcataattccaatccctaagagaggaagctattatcagtatgaaacatttcagtgtgcataagaattatgaggaaaatatttaatgattttatggttggcttatgacaatgtagttcagcccaaatgtatctaaaccaactgagacccaactatatttggatttcaattattaatgtttgacaatgaaccatctggagttctcatggacaagatagaggagttgatgagttatatggtttatcagtttttaatttcattaaataaccatatctaattatcagacgcatgactttattctcaggcctgcttcattactcacttgtgtcattgaacagtttaatgatttaggggaagtgcagtacaaattcacaattggaatgatacagaggatgataataaggaatctgcattagggcagttcagcattcaaagagactcttatgtgctaagctgaatctaataagatgaaatttaacaatgttgactctaagatcctggacttgggtcaaataaattacagtatgaatatattagcagcagttataaaaattagtgaatatttttatcaattttaagatctgtttgagccaactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatatacaattattcagtttataatccacataataaatgtagaaactacatgaaaatttctctaatcaaatacaaaagaaaataaatcacagaatttaagaaagatggagatgtaaaagaatatttatatgtgtgtgtgtgtatgtgtgtattgaaattctttttaacctattgcataaggtttattgaaatagaaacatatttcatggaaaacattaataccattttgttattgaaagtactagataatctacaaataatcccatgaaaagagcaaattttctgaaaaatatataaacctgttaatataataaacaagatagcactcaaatgtatttgtcaaaattaatatataataactcagtaaaatgtaattatattgtaccttacttaaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaaaaaaaagaaagaaagaaagaaagaaatacatgagctaagcggtaaaattggcatatttctcaaccgaaaagcttatttaattaaccagggatagggtatgtgtatttaagggaaatatattaaataggtctgtgcatttttctttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgagtgtttattacagtaaaatttctttatactttttttaaaatttttattgcaagtgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagtaagtaaacctctgaactgctatatatatgtataaaactttcaaagatcgaagaaaggagagcacataagtgattacacctgtcttatgtaacagaaatagggccaagaaaagagttgttcaagcaaagtgaccaaaatagatcttttctattatgagggtttcttcttgaaaatcacaggagaaataaatatagggactttatgagaatatctatataatttatacatctattaattataaaaactaaagataagtaatattgaatattgatatttctttttgtgcaaacctttgttagtaactttagttcgtcttcagttatacattatttttggatgtttatgcaatcttatttaaatattgtaaaaataattgtaatatactattttgagcaaatttatgtttctcatttactttatttatttatcattgttatggtccttaggaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaagagaaaggagaacagcttcctctcttgtgagagagagcggcacctgaaagtgaatccctgcccctggtggagtgcactggattttataaacggtcttgaggaagcagtgtctgatttacatagggcccaaagattggttaaactaggtgtgacatttacataatatgccaggaagctggccgccccaccctaatcttattaatcaaatgggatctttgcctggccagcgccatgttgctttctccttactgtacacgtggctggcaaagagaaaggaagatgcacctgccatatgaacatgcctagtcccaggtagccttttcctattggcacaactgctggcattcaccttgcaagcttccagcttgcttgtctatgtttgcagttcgattttacaggctcctcttgttagaaaagaaaatgatttgggggctgcctttcattaaaaggaaaaaccttatcaaggactgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacattatagtgtaaatttgcatttcttttaccactaactgggtttagaatatatattcacagtttaattggtatttaatgcttctaatctttggaaatgcagtttgattttctttatttacctttttgagagttttggtattattagttggaatcatcttaacaattctgaatataaaatctcttttaattatacgtaatgcaaatgtattctctttgtggctagtatttttctttccttttttctgcattatgaacataagttgctcattctactacataatagtcaatcttttttcatgatgaatgtttcttgtttctatttaaaggaatacttcaaaaacatagagccactatactattctttattctaaaaagttataagttaccttttcttttcatattttaaaaatattttgtgttgattttattcatgataatggctgtatttcatgtttaaatgaaatatggtaaactcaacatttccctaacaatttttatagtacctttctcaaacagtatattttttattgtatattttgtacattgtgtgtgtatacacacacacaataactattactctgagtattctgcactattagtaaacaattttttaaccagcattgcagtaaccctctattgaattttatttatttattttattttgagatagaatctcactctgtcacccaggctggagtgcaatgtcgcgatctcgcctcgctgcaacctccactccctgaattttaattaatataggtttttaataagtatggatatgacttttcaccctaatcatgacctttcacccaaatctttttgcttcatcagtctcttttttgtctcatcattcagtgtcagatgatcccattacttttatttttttcttcacagattaattgaggctaataatatgccttgattagatatgcaatttctcctgatatcaaacaactcaatcaacgtttatgcctcttggtttgattttggagctgattgtagaatcaactacttattttttctctttctttccttccttccttcctttttctttctttctttttctttttctttctttcttctttctttctttttctttctttctttccttctcttccttctttctttttctttctttcattcttttttctttcttcctttctttgtctacgtttctccttctttttcttttttctctttctttctttctctttcccttcctttctttttctttctttctttctttctctttcccttcctttctttttctttctttctttctttctttctttctttctttctttctttctttctttctttctttctttctttctttctttctctttccttctttctttcttccttccctccctcccttccctccctccctctgtcacctccctccctccctccctccctcccttccttccttccttccttccttccttccttctttccttttgtcccaagtttgtctggctcaagttattcttaagaatgttactattttactcttcatgctagaccctgtactttagtcaggttatttagctactttacggttgtcatataattaacaagtcttagcttcatcttcagattgagatatcaacgttatattttcatgtacagtcaattgtcagtgaatcacattgtttttcaatttaataaaatctaaattcctcataaccatgttgtgagaatatgcagaaaaaattaaacatacttgagtgagtacagtagatatatattggagtgtatcctttatgaatgcaaactggctgtagtttcctttaaaatagtcatttaaataaaaaatttgccagataaatcacagaatatcaatttctcttgacttgtaaaacttgaattactagtgccatctgaatgattcttctgaagatagacagagtagtctctacttacctgtgagagaaaaaagctgcactagtccctcttattcatgtgggatatgttccaggctccccagtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgcatgaattagctctttgtcctgatgctctctctcccctttccccgcacaccccaacaagccccggtgtgtgatgttcccctccctatgtccatgtgttctcattgatcaactctcacttatgagtgagaatatgtggtgttttgttttctgttcctgtgttagtttgctgaagatgatggtttccagcttcgtccatgtccctgcaaaggacacgaactcattcaatttatggctgcatagtattccatggtgtatatgtgccacattttctttatccagtctatcattgatgggcatttgggttggttccaaatctttgctactgcaaatggtgctgtgataaacatatgtgtgcatgtgcctttatagtagaatgatttatattcctttgggtatatacccagtaatgggattgctgggtcaaatggtatctctggttcttgatctttgaggagttgccacactgtcttccactatggttgaactaatttacactcccaccaacagagtaaaactttcctatttctccgcatcctcgccagcacctgtggtttccagatgttttaatgatcggcattctaactggcgtgaattggtttctcattgtggttttgatttgcatttctctaatgaccagtgacaataagcttgttttcatgtatttgctgactgcataaatgtcttcttttgagaagtgtctgttcatatccttcacctactttttgatggggttgtttgtttctttcttataaatttgtttaagttccttgtagattcttgatattagacctctgtcagatggatagattgcaaaaattttctcccattctgtagattgcctattcactctgatgatagtttcttttgctgtgcagaagctctttagtttaattagatcccatttgtcaattttggcctttgttgccattgcttttggtgttttagtcatgaagtctttgcccatgcctatgtcctgaataacctactgcctaggtttttttctatggtttttatggttttaggtcttacatttaagcctttaatacatcatgagttaatttttatattaggtgtaagggaagggtccagtttcagttttctgcatatggctagccaattttccctgcaccatttattcaatagggaatcttttccctattgcttgtttttgtcaggtttgttgaagatcaaatggttgtagatgtgtggtgttatttctgaggcctctgttctgctccattggcctatatatctgttctggtacaagtaccatgttgttttggttactgtagtcttgtagtatagtttgaaatcaggtagcgtgatgcatcagctttgtgctttttgattaggattgtcttggctagatgggacctttttttggtttcatatgaaatttaaagcagttttcttagttctgtgaagaaagataatgatagctagatgggaatagcattgtatgtatcaactactttgggcaatatggccattttcatgatattgattcttcctatccatgaggatggaatatttttctatttattttggccctctcttatttccctgagcagtggtttgtagttctccttgaagagttccttcgcatcccttgtaagttgtatttctacgtattttattttctttgtggcaattgtgaatgggagttcactcatgatttggctttctgtctattactgatgtataggaatgcttgtgatttttgcatattgattttgcatcctgagactttcctgaagttacttatcagcttaaggagtttctgggttgagacagtggggttttctaaatataccatcatgtcatctgcaaaaagagacaatttgacttcctctcttcctatttgaatactccttatttctttctcttgcctgattgtctggtccaaaactcccaatactatgtccatcctagacagatcaacgagacagaaaattaacaaagatattcccaatttgaactcaactctggaccaactggacctaatagacatctacagaactctccaccagaagtcaagtgttcttcttggcactacatagcacttattctaagatcgaccatataattggaagtaaaacactccccagcaaacgcaaaagaacaaaaaccacaacaaacagtctctcagaccacagtgaaatcaaattagaaatcaggattaagaaactcattcaaaactacacaactacatggaaactgaacaacctgctactgaatgactactgagtaaatattgaaagtaaggcagaagtaaataagttccttgaaaccaatgagaagacagacacaatgtaccagaatatctgggacacagttaaagcagtctttagaggaaaatttatcgcactaaatgcccacatcagaaagtgggaaagatctaaacttgacaccctaacacctcaattaaaagaaatagagcttgatggggatggcattgaatctataaattacctttggcagcatgccatccccatcaagctaccaatgactttctttacagaattggaaaaaactactttaaagtttatatggaaccaagaaagagcccgcattgccaagtcaatcctaagacaaaagaacaaagctggaggcatcatgctacctgacttcaaactatactacaagcccacagtaaccaaaatagcatggtactggtaccaaaacagagatgcagaccaatggaacagaacagagccttcagaaataatgctacatatccacaaccatctgatctttgacaaacctgagaaaaacaagaaatgggaaaaggattccttatttaataaatggtgctgggaaaacaggctagccatatgtagaaagctgaaactggatcccttcgttacaccttatactaaaattaattcaagatggattaaagacttaaatgttagatctaaaaccataaaaaccctagaagaaaacctaggcaataccattcaggacataggcatgggcaaggacttcatgtctaaaataccaaaagcaatggcaacacaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcagcatcactggtcattagagaaatgcaaatcaaaaccacaatgagataccatctcacaccagttagaatggcgatcattaaaaagtcaggaaacaacaggtgccggagaggatgtggagaaataggaacacttttacactgttggtggaactgtaaactagttcaaccattgtggaagtcattgtctagatcctcagggatctataactagaaataccatttgacctagccatcccattactgggtatatacacaaaggattataaatcatgctgctataaagacacatgtacacgtatgtttattgcggcactattcacaatagcaaagacttggaaccaacccaaatgtccaacaatgatagactggattaagaaaatgtggcacatatacaccatagaatactatgcagccataaaaaagaagagttcatgtcctttgtagggacatggatgaagctggaaaccatcattctcagcaaactatggcaatgacaaaaaaccaagcatcgcatgctctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaccatggcacatgtatacatatgtaactaacctgcacgtagtgcacatgtaccctaaaacttaaagtataataataataaaaaaagaattagagaagcaagagcaaacaaattcaaaagctagcagaagacaagaaataactaagatcagagcagacctggagatagagacatgaaaacccttcaaaaaatcaatgcacccaggagctggtttttagaaaagattaacaaagtacactactagccatactaataaagaagaaaggacagaagaatcaaatagacacaataaaaatgataaagagggtatcaccactgatcccagagaaatacaaactaccatcagagaatactataaacacctctacacaaataaagtagaaaatctggaagaaatggataaattcctggacacatacacgctcccaacactaaagcagaagaaagaagtcaaaaccctgaataggccaaacacaagttctgaaattgtggtagtaattaatagcctgccaaccaaaaatagcccaggaccagatggatttacagccaaattctaccagaggtactaagaggagttggtaccattcctttggaaactatttcaaacaatagaaaaagaaggtctcctccttaactcattttatggagccagcatcatcctgataccaaaacctggcagagacacaacagaaaaagaaaatttcagtctaatatccctgatgaacatcaatgcgaaaatcctcaataaaatactggcaaagcaaatccagcagcatatctaaaagcttattcaccatgagcaagtcgccattatctctgtgatgcaaggctgtttcaacatatacaaatcaataaatgtaatgacaaaaaacacataattaactcaatagatgcagaaaaggccttcaataaaattcaacaccccttcatggtaaaaacactcaataaactaggtattgatggaacatatctcaaaattataagagctattttttaaaaacccatagcaaatatcatactaaatatgtgttcatttttataagaaatagacaaactgttttcctgagcgatcatacattgtaccttcacatactcagtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttccttgcctaaaccaaggccatatacagttctagaagttaacattttacacttagttatatgagttaatttttgtatgaggtatgaggaatatgtagagggttattattttgcatttggatgcgttactgttccagtatcacttgtttaaaagactatgttttctttattgaattgcctttgctccttttttaaattgaaaacatcctcaaaaaatttttaaaaacagttaaggaggaaaaagtaaaattcaactaggcttgtaggacaatcaatggtaatcattaggctagctttccattgacccacttccttatagctggtcactgattactagtccaggataacataatctttgtcactagaatctttgttctttttctgttctttagttaaaatttaagacaatatgagatgacaaactttccatttgagtttctcctttaggttctgcatactaacaaaactactgatgccagccattctgaaaggcttgacaagaaactcaacttagggaagaatgtactttccatatcctgatgatttcagcccccttacccgaatcaattgatgacctcaattttccagccactcccccttcaaagattcttgcccagaaagcttcagtgaaatgggtttgagtcttgagaattcttctcatgtccttgtttggtgaccttgcaattggtaaactctctgttgcaaactccactgtcttggtatattctgttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaaaaaaaaaaaaagaaaagaaaaaaaaattcatggcaagccactctccttgcagtcatttacctacagtccagtgcccccatgccactggggctgacccagagagaagctcaagaagctgcttagttatgatgaactaagggccttagctggggccttctgtgttggcagggcagtgctgactttcagcacacaaccttgtctgcagcagagaaaccatttctggtctcagaagaagtctcaggtgagttttctcagagcagctggcaccccatttccttctgtgtgtgtgtgcctgttttcgtcttagaggtcttgtggcctctttgaggtcttgttgacactccctaagtctaggtaggaacttatttgaggagatctcccttcagatggaaaaagactagagggcattgcttgggagaaatggtcttggattttggaatctgaaactttatatggaaaggtcttttgtttgtctttgtcttgttatatgtatttatgtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaaccccactgtctcagtgtattgttctgttgctgtgcagcaggcatacaaatctgacaatctcgtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaggaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaaacatccaaagcatatgaagaatctattctcctctgtatttgccacacagaaccctacctgagcaggcacccccaatttgctcaatattttgttgacttcagagaaacaaagaatggttttagaaaaagctaaggaaaaggctgatcttattcacactgactctcccagtaatccagtaagggcagctgctcagattgcagttcccacctctgacctgggatggaatataaacactggagatagatctaaccttgaacactatcaaaactgcattttgatcagcctctgcaagggagtgcccaagcaaaggagtctcagtaaggtccaggatggtcaagcagaagcctaatgagggttgctttggaattcttagaacaagtctttgaagctttcagagaataaatggatattgacccagaagccccagaaaatttgatgatagctaacatgatgtttatccaacaaagtgccccagatattcagagaaagttacaaaacgtagctgaggcattggacatgtttttgtctcaattagtgaagattgtttttaatgtatttactgatcacaagtttaaagagtggaaaataaaacacaaggaataatgaaaatggcaagctgacttgttatctgtggctctgaccctagtagtccctggaccacaacaagggccgtcatcagacactccatctatggtagaaccacctgggcccccaaaggccaataaaaacggacatcccattgcaggtcccaaccagtgtgcttactgcaacaggggggacactgagtggaaaatttctcatgccctacaaagcctgatgttaaacagtcagccttctgcccaccaaatgcctgggatagctggggagcttgagagagatactaaagaaaaagaccagaaatggtagcacccaggggcttctcctgacccagacaacaccctccatatttcccacatggggcttgagatcctgatgatggtgagaaatcagcttctggactttctagtagacatggtgccatctatttggtgttaaatatctggtggtctaaactttcctcagaaataatgaaggtgactgaaatctcagaaaaaatgctgatgagatcattcctccaaattttggattgtcagctagagtaagatcatttaaagcacagttttttgctgggcgcggtggctcactcctgtaatgccagcaccttgggaggctgagatgggcagatcacaaggtcaggagatcgagaccatcctggctaacacagtgaaaccccgtctctgctaaaaatacaaaaaattagtcgggcatggtggtgggcacctgtagtcccagctactcgggaggctgaggcagaagaacggcgtgaatcggggaggcagagcttgcaagtgagccaagatcatgccactgcactccagcctgggggacagagcaagactctgtcaaaaaaaaaaaaaaaaaaaaaaagacagagtttttctatacatccttgaatgtcctatccctttgttggggaaagtcttccttttttgttgttgttttgttttgttttgttttgagacagagtcttgccctatcgcccaggctggactgtggtggcacgattgtggctcactgcaacctctggctcactgaaacctccacctcacgagctaaagcaattttcctgtctcagcctcccgagtagctgggattacaggcgtgtgccaccacagccagctaatttttatatttttagtagagacagggtttcaccatgtttgcctggctcgtcttaaactcctgacatgaggtaatctgccctccttggcctcccaaagtgctgggagctgggattacaggtgtgagccactgctcccgtcctgttagggcagtactcttaaccaaactaaatgctaagattactttttctctgagatgattggacatccaggtgccttcagaccaagcatgtgctctgcaggccatattattacaactggagatccttgaaagtgcctgcacccctgaagagatactccaaaaggttagtccggaaacatgggcagatgggaggccagggaaaacaaaaactgcatctccagtacaagtcaagttttgtgcaggagtggcgctgccaaatctaaagcagcgccctttgagagaaaaggcacagcaatgcatttagcctctgctaatggccttcctgcaatacaggaagaattccttgtttctcatgtaacatacctgtcttgccaggacaaaaacatggaactgaggattattggtttgtacaggatttgagggctactaggcaaattttcaaagccatttatctggtgataactgatgcttatacattattcatgactttaaccagtgagttgtactggtgttcagtcttgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgacggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgagccactggcaccacttgtgatcttctccaggaggcagaagagttcactttgggttaacctagcactgtacacaccccatactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatataaattactgagcaagtgtgttctattcaaccagacatgaccaaaattccctttaaaaacctggacttaaaaatattcactgaggaaagcagctttatgcaccacggacaacagaaggctgagtatgctattgtaaccctgtgacagatcctagatgcagagacactccctctgggttcatcggcacagaaggcagaacttagagtcctaatcagggcatcccaactaggtaaagactcctgagtcaccgattactctgattccaggtatgtttttattgttgtccatgctcatggggccgtttggaaagaaagcgggctcttaacctttgatgattaaaaaagaaaaacaattaagcatgctaaagaaatcttagcctgactaaaggcagtcttggtacccaagaaagtagctataatacactaccatggacatcagtggatggacaatttggtagcaagaaaaaaaaaatcactaggcagagcaggccactaaagaggtgaacagagaaaaaaatgcccaaagccttcctaatgccattaatccctgaaataaacttcagcctaaaatccctacctaatggaagaagatgtaaagagagaattcgattgagactttgactccaatcaaagaactcaaaatgagtggatatgtgacacggaagaaaaggttctggtgcccaagtatcttgtgacagatatcatcaaacacatacatgataccacacagtatggcaggcatgccacccttcaattgatccaggactatgtctttgggacacacttaaagaagactatccaaaaaataatttaaaaatacctacttggtgcccagaacaatcttaagactggtcctccacccccagtaccaaggattcaagcaagaggtgcagggctattagaggactggcaaattgattttaccgtgatgccaagggtagcaggaaattttaaatacttgcttgtatttttagatacattttcaagataaacaaaatcattccgctgcaagaccaagagaatgtctgagctaatgagagccttggtagagaagattaccctcaggtttaggtggcctgtctccatccagtgtgaccatagtgcaatttctgtagcctaggacaccatatattccaggccctcagcataatctggaatcttcatacagcctgcagactgaagtctactgaaaaaactcaaaagataaatcatactatataaaacaaaacaaattttagctaagatttgccaagaaactaacaacctggaataacattctgtccattgccctgctcagagtaagggtggtccctaaaagtgggcttaaattaagccctttaaaaattttacatgggagatcattcttccgttaccttctcagactaaggaatgccaataacatacacataaataaattagatattatcaaacatacacaatctttaggttgtactttaactactattcacgagtttgtggttccagcagattgtggtatccaactgacattctctttcatcccatccaacccagagactgggttctgctcaagaccaggaaaagtcgacatcctggggaccacttaaaacacagtgaaagaggccatgcaaagcatgactggtgacccattcctctgttcagcttgaaggacttagaccctggattcaccacagccatataaaacccgccccgccagattcttgtcctatcaagaaatgtagagaggccacttcaacttcagagactgtctcaaccctatctgaatggataagtaaatctttgatgggcctcaaatatcttttgaggaaaaatatcagataagtaactttaatgaaattagacaaaacatatgtcttcttgacaactacaatagttactttgagcataacaggaatgtttgttattataattattttatataaaaaggtgagataccttcctgtctattccctgccttactgaatgcttaagccatatatttacttggtcattataattgcctagataattacaattgctacccttatagacattacttcataattgccttggtcaatacaattgttagacttatagattttctagacattctatgccatgctaacatagtctcatgccactcattatgtggacattctaaaatttagaaatggtcactcttgttttaaaacttctaattatacctctcctgttactacagtgcctagacaggcatagcaacactgtagttcaactgtttcaaggtattgccactggaagaaacttaccagaatgatggatctgtcagtaactcccccaaactattcaaaataagcattttctgttagtcatacttgtcactgactttctggatgttccaaatatgactacctatctgcaccagcttctttccatggctactttccaggtccaagtaatagtacaccaagaaatcaccaccccatgtgtcaatctctctctgcctatcataaatggaaagtcattccattacataggccctccatggcccatggcatactgggcagacaaacgcagctaggagaagggaaataaaactaaaagtttctccttactatgccaaaaatatttacagtggggaatatcacacaaattctggggagcctgtaaaaaaagatccctagttcaattccatttgtctatattccccatgaaaaaatccatcaataaatgcacccttgagggctttacctgtgtgcccccttggtacatgtttatttgtggcataggatcagaccctcctctgttagggcaagcccactggtgtctcaataacctgtatattaagggctctcacttactgagatacttctcagtccatcctaatgacaaaatattctgcccattttcccaccgactccaaaagggactgccaggcatatatcaatatatctggtggcagagccttctaggcatcacgagtcctagctatggagtatacactcactgggacatgatcagaaacttattggcaaccacagaaataattgcaaaagaggctgctaagaacattgaggctgagaaaactcttcaaatttacttgcccagatagttcttgacaacggaactacacttgattttctcttggctttacagagaggagtctgtacagtgatcaataccacctgttgtacttatatcaatgcttctggtaaaataaaaaccaaactaaagaaaatatttcagcagtctcgctggagaccatatgtctctaccacagaccctatgtctgaatagttttttgagctttccgcctgcatactccatgttttccagtccatttttcaaggactcttgaagttcaagctcacaattctgtttatagggattataatttacatgattcaattaaatattacaataaaaccatagactgaagtactaacatgttcatccagcaccctaagctgggtataacagcttgcaggttgttacaagacggtttcattcctctaatcctgactctctctctgtgccccgtgtcagcaaaaagaagctagaatggccattgcccgattcataccatattagcttttacacctcagaattgagaagggatcaagcccggaaggaactgaaactgtccctaggaaagttatataaaattgattaagggggaaaaattcaactatgatttcaggaaaatcagcagtaatcactaaatcagctttccatttgtccaacttctctgtagctggtcattgattactaccctaggataaagaagcccttgtcacaagacattttggtccttttcctttctatagataaaatctaagacattgtgagatgataatctttctgcatgagtttctcctttaggttctgcatatgaaaaaaaaacctagcaacatactggtcaacaaggcaaaacctcattttcacaaaaaattaaaaaattagccgggcattatggcacaggtctgtagtaccagctgctcaggagatctgaggtgggaggaccacttgagcctgggaggcagaagttgcagtgagctgtgatcacgctactgaaatccagatgggcaacagagcaagatcatcttgctcaaaaacaaaacacacacacacacacaaacatacacacacagacacacagacacacacatcagctggtctaaagagcccagcaaaaagctgactcaggaaataatgcaggttccacatcctggtgacttcatcccccttaccctgaccaattgacaacccaaattttctagcccgtcaccctccatgatccccttaaggtctcttgcacatagccccttctcagaacagatctggggcttgagaatcctcccaattccttgtttggtgcccttgtgttgattaaagcctttctttgctgcaaaccctactgtctcagcgtattggtctattgctaaacagtgggcatgtgaacctgatagtcttataacaaaatagaatagaagctatttataggatcgatccatgcatgtgagtctatttctggacaccgttttctcttctattcttccacgtgtttgtcctttaaccagtatcatgagatcctttactcactgtagctttttttaagtcttaaaatttggtaatgtgagtttttcaacttctcttatcttttgaagaattgtttagctgttttagcccctttacctttccatatgactttagaatcagcatgttcgtatgtgcaaaacattgtgcttggttattcactagaactgggacacattcacagatgaatctggggagaactgatatgtaatagtattaaatttttcaatccatgaatattatatatcctttgatttagtaagatcatacagtcttaccctagttttttttattttaagcatacagatcctgtattttactagatttataactaaatattttgtatttcatccatcaacgaaaaattcaatttgtttaatagacagaatttattaatgctacctaatccttcttgagagagccatgatagtttgtggcttcagtaattttttaattcattcaagttcttgaatttattgacatggcattattcagaatattttttatttttcttttaatatatgtaaaaaccataatgatgtcatttctgtcattgctgttataagcaatttgtgttattttttctgatttagtctgtctaaaggtttctcaattatagagatctaaaataacaagcttttggtttccttgtttatatacatatttacttctttattatttcatctctgatctttattgtagtatttcttctgcttactttgagattaattttttctacttttactaatatctaatggtagaggctaaggttattgaagtggaacaccgtcattttctatcccaggtatttagtgacaccaatttatttcatactgctctagtgccattccacaacttttgatatatagtatatcaatcagtgtttggctggagtagggtgagtattccataaaagatttactgtgatttttggagggaggtgtgaagagggtattattaccaaaatgtggatttttttttaactccattctgtattttggctaagagaagcagctttggaacttctcaagtctgtacatctgtgagaccccaaggattacttgttttaatttttttttaagtttaggtttgttttgggtcaacttagttctttcaaggcttatttttaagcttttaaaaagcttaaaaaaccccagagatagtttgttcagaatattaagctgcttctgatgtctctactacgtgacctagatgttcaaacgagtctttctactctgattgattccatttaaatgtctccctgtgttgtgtgtgtgctctgggaatcctttacctttttgttctctggtagtgttcttcatctgataggtatcctttgtccattcttggggagttttgctctactctccagagtgtcaatattcagccaaataatctagggagttgctgtggaaatttgtagagccctttcactccatagtttcttcttttctcactctgtttcctgcagattctagtgaactcatcttctttgggaacactgagttttgtttcttctactcagcaagtgtggcactttctgctgaattctccttctccatgctgctgtttggaaaatttctcccagcataaagtcactttgatgatggaactcatctcattgtcactttttctctggaattaggtgcttcctgctttccaatgtctgaaaatgttattttcatctattttgttccatttccttatttgtggcaagaactctgttttacttgattattcttgcctggtcttttacctttttaaattgtctgtactgattgttttctatttggtttcttctcatatttggatttgtttcaaaatttatactcatgctggattttgtctggtttctttgttataatttattataaataataatttattttcagtttttattcttttcttttatagctatataatgataaatttccctctgaggattgttcgagtgtcatctcaccaagtttaatttaatatgtttttattatcattcaattcaaaatatttaatgtttcctcttctgattttctccttatccatgagttatttaaaaatgaagctgagttctgggaagcaacctagtaaacgacagtaatttctttttttgggttattattattattattattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacagcagtccccacagtgtgatgttccccttcctgtgtccacgtgttctcattgttcagttcccatctatgagtgagaacatgtggtgtttggttttttgtccttgcgatagtttactgagaatgatgatttccaatttcatccatgtccctacaaaggacatgaactcctcattttttatggctgcatagtattccatggtgtatatgtgccacattttcttaatccagtctatcattgttgaacatttgggttggttccaagtctttgctattgtgaataatgccgcaataaacatacatgtgcatgtaaccgacagtaatttctatcatcagttaacagaaacagtaacttccactctttcaagttaagttctacataatttgaggaatcatcattttggcctttcaagataaataaatctgttactgttcctcgtcttctttgaactccacatgtccatttactttgaagcacacaataagaatgacatttcaaattcttggagccaaaggctatgaaaattattttggcagattttctaagatcatcacaggatctcagatactccaattggctaaatgagatttggaattgccagaagatctacaataggcaagattaaaaagtcctaagaaataatactcattgtctattgagttctgacatgctgtagaattccaaatccattagacaaacagatttccaataatttcttagaaataattgtaagtgtcttaaatagagccttgttttaaaaagtgatgaagagtcttgatgtaatgtctttggcaactctgagcttattttccttgacttaagtatttgaatgcttatggttatccaggttttcagttacaaatgactcattattttttatatttacatattacttaaattcttataaaatgttattgatcatatgcttgtctttttcttattctcttcccttttagaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattagtaagtaatttattatgtttgtattgattatccagatgatacacaaaagtttactaactttagtctttttgtgggggctgatataatttcatttgaaaagataagaaaaaaaaacctgcaggaacaaagcagacatcaattttttttccttttcacattaattactcagatattagtctgtctttccattcaggcttttcctactctaaagcattctgtgttacagaaacaagttagggagctttatgtgtattctggtttaaactgattttgctttagctgagacctttatgactgttaatatatatctgttttataagattagacttttacatcaaattctttactcctagatacaaaagcaatgtttttattgaagatatggatgcctagtgcataacatcaaaataatttaaactctataatttgtagatttgacactgtaggatatgtctaatactgaatatcttccctcttagaaatttttcataaatatttaggtagtagagagacaaaatattcctagatggtaccaatttctgctctgttgtatgatttccctaccacactatctagatatttatgaagatttccctaccacactatctagatatttatgaaaattttctgggaacaattggttcaatttgtcttattttttgcaaaaccactcagtaatatgtgtgtgtgtgtgtgtgtgtgtgtatacgtatatatgtatatatatatatatatatatatatatatatatagagagagagagagagagagagagagagagagagagagagagagagagagatggagtcttgctctgtcgtcggccaggctggagtgcagtggcatgatcttggctcactgcaacctccattttccgttttcaagcaattctcctacctcagcctcctgaatagctgggattacaggcaccctccatcatgcctgcctaattttcgtatttttaatagagacagggttttgccatgttagccaggctggtctcgaactcttaatctcaaatgatcctcctgcctctcagtaatatatttgaagtaatatttaatatactcatgttaagtgaagtgaataaggtattcatgtatactgttttcattttttaatgtctgtgcttaatatgaggtctagtttacaaaaaatgttagtcctcataaaaaagctaattttatactaaatttttattaattattcttttaagattttcttattattaaagagaaaatgtcttgtataacataggaatttatattttcagtctttttctcctttttacatatgtctcaactacgaattagtttggactcttaatttacaaaattctgttatgattttctttaaaaaataatgtatacctgtaatggcctgttttattactagcattgtcataaatgctttagtataaatgaattaagaaaaatgtttttaaaatatattttggggcttaagcaatgaaaaaaaatgttgtgtagaaagatatactttcacttttgacaactattttacgacaacaaattctcaccagtcatagattatttttgtacggtacctatttattagtagatctaatcaataaagctttttcttcttagaatgggaaatactcagattgtttattagatgacattagaaatgacattctaaattttttatgcactagaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatggtaagtactggtttttcagaaattcattttcaaaatgaaaataaatctgttttccaattttaaaaatttgaattatatagaggaattgttaaggaatgttgattaaaatcaagatatctcctgatttgacataaactgggaaaagaagggagttttgaaaatatctctaaagtagtgcattaaattaatacttcctatgggccacctaccttccagatttgtgattataatataattgcttttgttaccctaaataaaagctttcaaattatttagaacctagcacttattaccaaaattatagttggttacaacttcctcagctaatttgtttttttaatttctactttacatcttctatcttgtgtgttaatttctgtactttctgagtgtagttctttattttctaaatttgaaaagttctgaagaccattacatgaatctcatttacgtttctcaatcagccatctatttttcagggttagaagaaggattggctctgtgggaaaacaagtatatgcagagtgttccaaggcaaagaaaaatatgtgcaaagctgtaaaaacaaaacaatatatttcaaggtggtaaagcagagtctatcctgctgaggctagatgggaggcaaggaaacaattatccagatcagctcaaggcatcatatcatttggattcattttatgactaatgaaaacccataaaagagttttaagaaaaggaatggtataatttgatttctagttttgttggattgttttcctggatgctgtactttttgtaggcaagaggcgacaccatgagtccaggtagggtgagaaagtgtggggactgagagagagtgatgataggggaggtgcagagcagaaggctgatttggaaaacatttaggtgatgaaaagtacaggtgatgttactaaatgttgggtgtgaaaaagagtgagattaagggactcacatgtttgttttcaattgttttctcacaagtatgtaggtaaatggcaataaccattttgtaaaatggtactgactggatagaatgcattttgagagggctttgcaacttttgacttggacacattatgattgagtcgccaatggaaaatcaaaactggatatgtgaagtgtggagttggatatgcatctagagaggagatatgcatttcggaatatcatcatataaatgatgacgctaaattggataagaatacagaatgaaaagagcaaagagctcaagatgaagccctgaaacattaccacatttatatataagacagaagagcaatagatagtaaagaaaatggggaaaaaaggaggacccagagaaacaggagaaaaaatctagaatgttgccatagacataaaaataaggaaattattaatgaaaaggtagtgtaacagattgcttaataagtcatcctgtctgaattctaattccactgcttgctgggcatgtatctttggccaacacagcaagtctatttgaagctttgttgactctttcttgttggtaaaatgtcacatatttacaaacagttctaatatttcaaaggattgtgttagttagcagactaaaatatttataaatatttattgccatagtgccttatataataaagtcaaagaagttgtaatttaattaccttaatatcattatcaaagtgataaatatttctaatttagttattatattctgttcagaaattgtgatggattaggtaaggtacaggccaatgacaagtgtaacaaaaatggattttaatagagtagaagagacagaccctacatagaatctgccaataaaaataatgagctagacattcaatacagactgtagacataactctttcaagattctggctttgaatctaataggaagatcagaatattgcttgaggaaagttgtgcactgaagggataattaaaagaaaaaagatggaagacaccagagcagatacagcaaaaggggagctgcaaaggctgaacacatgacttacatagttgccctgagaaaatgcgaggggaaaggactcacagctactgtggaggtattgtgctttggtggcaacaggactgcttacaaccttgtgacaggtggcaacaggactgcttacaactttgtgacaggagatgggaaggaaaatgagcagtaacgttggaaaatggtagaagctgatggattctgttttgaagtatgagacatggtcatctgagattgaatagtgtgtgggcgaaggaggaggaagagtactaggtagaatagaaaagttttgaaatagtcacagctgagaaagagaatgagtacattgtagatgaaaggcagtgtcaaaggtccagttaaatttgactcattcctgctgttgtaaacacctatcataggacaggagaaaatggtgaaaacacaagcacaggtctacttatccagagattttattctaatataagacagtggaaaactaaaaagagataagccaaatatccaagtaataaaaatatttaaaatatattttatgtatcactgtgtacagagaaatagaaaatccaataattgagatagaaaataggagggaaggaactggagatctgttttacataggaagtcatcgatgcaaagaatggttgaaagccatttgttatagtgagaagggtatgtgcaacagctgaggcagcgaagaacttgacctttttaataaaattcaaagatcataaaatctgaatcctggatttagtggaggagagagacatttgataacattggaagagtaggcatggatcataaagaggttgagttttgctctaattgagagggggaggcttaatttaagagactcataaatttcttttctgtgatgataggtaaatttaggttttatgaagccagaagcttttacaattttgaggggtcttcttcaaaaaagaacacaaaattgtgaatatattgcttcagtagtctttccaatcaccagacatgaaatgaaaacctaaaggagagaaagttggagtggcggacatagcagtagaagctgatgtagaaaatgtctttctattgcaaattgtacaaagacttaggatcatttgaacacataactaggaatttgctagtatagtacaggcctccaaacattaaacgaagaaataccagcttagtattcttttcaaatattcttctctcagccatgtaacagaaaactgcatgtggattgacagacatctgagtatatttcaagtgtcctaggaggtctcttctttgtggaaaggtttccacagaattgttattatggagcacttaagctaaataaggagtatgtatctcagagttaaaaattcatattaacatttcacatatctagtactaggacttagggttttgagttttagatgaagaaaaatatttctaattcatggagtgtccattcacattcttctctaaatcacgttttgtaagttattacctctatataaatacagcatttgaataatacccaataatcaagatcttaactttcctttttaagataatgcttttcacaatattacaacagacagaatttatataaaattagcacaaaatacgtgaacaaacacacatacaaaaaaaagaattgctatgtagaagattggtatagacttttaggagagaaatcccagtgattctcattcaagtgtgattttctcaaataatctgcaaaactcattaaaacaaacacaaaagcaaatttttgtagttattattttgtgacattacttttaagaatagttttaaatctaattttgtaattgtattttaataattgaggttatgatgtaattaattttctttttagtatgattctaatttatgaattctagcttgtacttttctaagttagcaagaaaggaggattctgaataagaaaaataatattttggataatatttagtaatgttgctgatttttaaaaattataaacatgtaagagataattttacacatttcttatctgaatcagaataattatcaaatttattaaacattgatataaatagtacatataacaaaaattgttatatgttaacataaatattcaggatacctagaatttgcctttccatgtgaacttgaaaatttatcttggtttgttttctttatttgtaatatattaattatgtgttttttatattttttttaacttaaaatatattagaaatgctattttgggttctttttccttgattacattaaacaaaaataccaattttaattaatttcttagtgcatatatcttcactaataaatctttgatgagaatttacctttttgtgatgtatatgtcagtcatcaagaattataaacatgatgagaccagaaatcatttgaggttgtttagtttcagttaaataaagttatcattgactctgcaatgacagatattataccatcattattctcgggatcctccccagttctattataaatttaacttcttaagatatttccatggtgttttatgatgtgttcttttatttttaaaattttaatttctatgttttatatgtttagatggtccaaatgcagttttgttgcatggatatattgcatagtggtgaagtctgtacttttagtgtattcatcacccaaatactgaacattgcacccattaggtaatttcttattcctcaccctcctgctatcctgccacatttctgagtctccaatgtctgttactcagcactctctgtccatatgtacgcattatttagctctcacttataagtgacaatatgtgggattttactttctgaatctgaattattttacctaaaataatggcctttagttttatacatgttgcttctgaaggcatgattttattctttttttttctttttattttttgttttggctgagtagtattctatggcatatatctataccacatattctttatccaatcatctgttggtggacaattagtttgattccatattattgctactgtgagtagtgaggctataaacatatgagtctgggtatcattttgatatgataattgatttcctttgggtagatacacagtagtgggattgctgggtgaaatggtagttctgtttttagttctttgggaaatgtccattctgttttccatagaggttgtactaatttacattcccaccaacagcgtataagcattcttctttctcctcactgtcaccaacatttattattttttgactatttgacagtggccactgtgtctaatgtaagatgataactcatttttttaattcgcatttctctgatgattactgatattgagtttttatttcatatttcttggtcattttcatgtcttcttttgcaaaatatctcttcatatcctttgtccactttttcatgggattattatttttttttcttgttgtgttgtttcagttctttgcagattctggatattagccctttttcagattcatagtttgcaaatattttcttccattctgaggttgtctgtttactctgtttattatttcctttgctgtgaagaaaatttttagtttaattcacaatcacccagaagcaggtcatttaattttcatgtatatggatagttttgaaaattctttatgatattgatttatagttatatttcaccaagttctgataagatacttgatattatttctaacctttaaaattttgggaacttgctttgtagctgtagcctagcatatggtctattttggagaatgttccatgcacaggtgagaaaaacatatattctgaggttgttgggtggaatgtcgttaaaatgtctgttaggtccatttgttctacagtccaatttaagtatgaggtttctttgtttatttttttgtccctgcaatctgtctagtatagtcattgggggtgtggaggttgcttgccctcattatattgctgtttatctttctacttagctctagtagcatttcatttatgaatctgagtgctgaggttttgagtgcatatatatttagaattgttatatcttcttgcttcctttatcattgtgtaatgaacttcttgtcttttttttcttgttgatttgaaatctttttttatatataaatataactataccaaatgctttttgtttctgttgttcaaaatatctgtctccatacctttaccatgagtttgtataggtttctctaagttaggtgggtttcttttgagcagcatgtggttggtttctgttttccatatttggtccacaaatctatatcttttaagtggaacatttaatctatttatgttaaaagttaatattgtcatgtgaggttttgttcttgtcattatgttagttgttacctagctggtttgtagtcccaactgtgtaattttttaataagacctgtgagttttgtacttttgcatgtctttatgatagtgagtattgaccatctatttccatgttcaggactccctggatcatttcttgtggggtgaattcctaaagtggatttctagtggtgatgaacttccttagtattagcttgtttgggaaagactttatatattcttcatttatgaagtttagtttagcaaaatacaaaatatatctctaatatatgttttttcaataaatatgaactaatctttctttaagaaccctgaaaataggacaccaatatcttctggcttgtacagtttctgctgagaagtccactgttagtcttacgagatttccgttatagttgattagatgcttttctcttgctgattttataatttttcccgttcacattgactttagatagcctgatgactatatgtttgtagaagttcatctcgcaatgcatcttcctggtgttatctgagcctcttgtataaggatttctatgtctctagcaagagggcaagaggagataaattttcctcaaaaaggtttttttagctttttcttctccctcaagaatatctataactcttaagttttctcattttttagaacgtcatttttctcaaaacctttgctcattaaaaaatgttatttgctctttatttttgtctgacagggttaattggaaagacctgtcttcaagctctgagagcaagtttttctgcttgatgtaatctgtaattaaatctttcaactatattttgtaattcttcaatgaatttttaatttccataagttctatttgttttttaaaaaatatttttagtacatttttcattcatatcctgagttttttttctaatttctttgtgttgcttttcaactttctcttggactccatttagctactttaaaataaatattttaaattctttggtatttcaaagattttattttggttaggacttattgctgaagagttagtgtgatcctttgcgagtgttgtaatacgctgttttaaatcatacttccagaaatgtttcagtggtttcttctcatccagatgaactatcccttcttatttttaagtccagtttccaacagacaggattttttttttccctttgagaatatgactacgatgtatgttgtatagggctatttggtttaggttctgggttctttcagtggtaaagactctgtttgagtaccttggttagagataacttttgtatgatggctttcttaattgctggttgtagtagttatgtactgggtgtatgacgaggcttactgcctcctgaagggctggtatggaggactacgcagaaaactaaccttgttctgcatcatgccctagtgtcagcattttgcactgggctgtgcagttcaacattcaggacagtaggtggcacggacaggtaagagccagctgcagcagaggcagatgagcctatgcttgtcactgtttatgggagactctctgttgccccaaggaatggactgatctgtgaaaggtacagtggtctgaggagctggggacaaagcgggatagatctgtaccactaagctcacccttggatgctccaaggatgagcacaagcaccagccctgacaggggtgtcaggggaagaccctggggagatacccgtagcttgtctttcttgcaagcctggcttcattgggcacatgaccagtggagttgtagccaccccctaatacccctacaatgtccgtcctctggtgtgtctacaccagtctcctttgcgagtgaccacagctatgaacacagaattggatccacgggacatgttcccctctctacatccgtgcccaagcgctgggaccattgggctcctgggatggatctatactcctcccttgcagagccaaacaccgcgtctgcgtgtctgctggaagtggcgtagtcattttcagcccacaagcaggttgctcttgcacacaggaaagtgaatgctacagtcttctttgccacaaggggtgttcctttgttgcactttccattaggaatagcctccctggtggttaaactattgggaatgctgtaactcctttgggtccagccagctatgggtgactgccacatccaagcaggtgacagggaatatttgtgcggctctggtgttatggggacagagggctgaggttcctgggtaggaaacagtccccacatgagtgcactgcaggcatgaaacctaccactgcagctcaggcccaaggggaaggcagatgaccctattcaactagtagtttggtgtaatgccctcaagaagttcccaaatctccactcacaccagtgtgtgtgttcacgaagacagaagagctctctgatggcttggatccacacggtgagctgcagggagcccagaagactcctacctacactttctatgaggtcccacagggtcctagtcaacctttgtcaggctcttgcttctgtctttttccatgctttggcttctctccatggtttctctatgacgctcctgcaccctctcttaaatatttttcaagttatgatcatttacctgtaactttggttcttctttctgaggagaacttgtgtccaaactccttagtcagtcatcttgttttcaaaaagccccaattctggtctatatgcacttttcttttttaatatgagagagtaatttcatgttttgagtaaaaaaagtaatattaaatttcattaatgtcagtgattaaaactagattcattgtaaataagttgaatttacaaattaatttttagaacagatatatttcaataccataacatttataataaagttccatttcaatttagacagcatataaaacataatatgtagcattctttacagggaaaaggatttatctgatgcccctctgtatgacccaatatcaacctcactttattgtggcatatgtaaaattaactttggcaatgattaattatatattctcatgaaattattttacctttttcaagaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaaggtgaatgcttatcttacaattgctgaaataagaattagaactttgaataccaacttttttcttattaattttgtttgggctcccattgcctgtaatctaatgaattaagtcaaatatttgcctgtgaaggacatgtattgagtactgaatacctgagattcagtcacttaagttaatctccactgtttcttgaacgatgtgctggaagtattcccagacacacaggtgttgtcggtcttagtctactttaggtttatgtttctataaaggaataactgagtctggatgatttgtaaaaatgttttatttggctcactatactcatgactataaaattcaagatcgggcatctgcattcagtgagagccacagaatgctggtagaaagggaagaggagccactgtgtccagagaacacatgatgagagaggaagcaagagagagagcagggcagtgacaggctctttttaagaaccagctcttccaggagctaatagagtgagaactcaccctgagagggggcattcatctgttcatgagagatccatacccatgatccaaacatctcccattagaccccacctgaaacactggggatgaagtttcaacatggggttggaggtgacaaacatttaaaccatactagtggctgacaatggagggatttctttgttaattttcattttgcttgaaatgtcaacatccattctggacattttatatagtgtgggctgcaacttaagtttcaccgggtgtgtctaaacaatatttaagcagcttatattcaattcagttgcttgtattgattagtcaaactttatgttgatcaaatgcttgcctcagttatgatatttttccaaaatgttatgataaaatgtttccatgaaatgtaaaaattaacatgattttcataaccacatttgctaattggttttcttgcatctttaagatatctagaagtctgagcatattttaacattttaatataccttcaatatgacaatttagtataagtaatacaatatgaacaccattcttgattgtttaggatgctataataagttacataatgaagaatacatgaataaaagaagaaaatctttccattttactgaatttttatattgtaaaacagacaatttaaccattatttacatagtatttctactatagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattggtaatgtataaaatattaatatttaaacttgtcaaaacttttgtattttgtatctaaaacacatacatcatgttttcacaataaactttttttgtaaaatttacatagtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtgggtgagaatacccttcttaaatcaacatttaacaaagtttaatatttttattgtaacaacaataattgcaactatatttttgaaatttacagatatgcctcaacatttccagtcttcaatatgagaccaatcttttgcatattgcttataattcaatatgtgtctagaaagaaaaaataaagctagtaatataattttatgaatctttctgcgtctgataacagtattgtttatatttaaaagtgtgaagcaacattttacttacaaaaattgtcatgtgaggccagggtggttgctcacgcctataacctcaacacttcaggaggccaaggcaagaagattgcttgaggccaggaggtagacactagtgtgggcaatatagcaaaagcccatctctataaaaaaaattttgtaattagttaaggtgtggtggtgcatgcctgtaatccagctacttgggaggctgaggaggaatgattgcttaaggccaggaattcgagattgcagtgagctctattgtgcattccagcctgggcaacagagtaagactctttctttaaaaaacaaaaatattaaaaaattatcatatgattaaatatgagtactaattactgagaaattataacagttttatataaaatataaatattattgttattgtatggtattcctttttaggcactgagaagcaaagaaacaaagttgacaaaatacctacttactactctcccataggattcttttctctcttaaagcttccaaaagtgataatttttcagtttgttccatatcagccaaaataagtgaatgtgctgcagggttggtgggccacaggccctctacatcagtggtatagctgagtggcatgaggtagtcagggactgagtcaggacgtaaatctcattgacggacttcacactgtaaatctcatgtcttgatcagcaagaaggcaaggtgattcacttacagtgtgacttgagatgtacaatctttaaaatcattttgcctctttgatgactaaccgggaggatcttggggaccctcattcacttttctctaaactgagatttttcctaaagttttcctgggtcctgaattctaagagtcctaatgtccaatcatacttatttatccaatgaaatatccaatgatattttgtatttcccaaagaataaaatgtcttctgataggtatctctaacatttcagcgacagaatacagggcttatattttgacataatagcattttgatgcaatgtgatcaggaataacttggttggtgaaatttataatgattaagtcataattttaccatgctaatactatttactttataactatttttatgtaatagttggtttgattcctatcatttgaattttcataaaaatatatttattttatagcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaagtaagctcttattttgttttcagaaatgtattctatttctcatttggaaaagtaataggtatgtgtgtcttttaaaaactttagctatttattattacaaatgctactgaataaggcaggtaaactagaaactaatgaaaacactgttcctaatattaactgtgccctgtgaattagttacctttagtataaacacacacacacacacacgcacacacacacacacacacacacacataaaccaggcactacatgtcatcattactgttggaggaccagtgcttctcattccttttcttgtcaacaaatgttcctgtgcctatacctctgtctatgccaataactactatgtatctgtttgtatatgtctgtatgcatgtatgtatgtatctatatctatttctgttgattcatttatttaatctatctctctgtctattcatctacctgttcatctacctaatcatctatttatctattaatttattgttcatctatcttgaaaagttagtcatattgacacatacagtttcacttgaatagtgtaggttttattccagtcttctcatattttatatctgtattttgctatccaattgtgggtttccttgcctcactaacttcaatatttttaccaatgtctgccagtctaggatatacagaaagcattgacaaccaatacaaaaactaatctgctatcaacatttcaatatgtttagagtccttaaagaagcaaataatatatatatgcagtgaagtgtacatgttctacagttttttcttgaagttttatagttttagccattctatatagatttattaaaatgatcgtatagttatcgtcctttctgttaatgggatgcatcacctttactaatttgcctatgttaaacgacctttacatttcttggattaaacccatttgatcatagtgaatgatctttttaatgtgctgtaggatttgttttcctagtatagtgttgaggggttttgtacctatgttcatcaggggattttgcctgtagttttctttttgcgttgtgtccttgtctggttttggttccagagtaatgttgggccactagaatgagttagaaaaatgatctcctcatcaaatttttggagtcgttttagaagaattggtattagtcctttctaaaatgttgttataattcagcaatgaagccatcaggtcttggattttctttgatgggaaacattttattactgacttaatctgttgcctcatgattactctgttcagattttctatttcctctgaattaatcgtcgtaggctgtgtgtctagaaatttatccatttcttctaggttatccaatttgttggcatataattgctaataacggtctctcattatactttgtatttttttgatatcagttgtaatatcacccttttcatctccgatcttgtgtttctttaagccgtatctctcttttttagttattctggttaaagctttgtcaatttttgattatctaaaaaaaaactattttcattgatattttgtactgctttgggggctctattttacttacttttactctgatctttatgatttccatccttctactaattttggaattgactagtttgttcatgtttttctgcttctttgaggtgtactactagactgtttatttgagttctttccactttcttgatataggcaattattcctaaaaacatccatcttagaactacttttgctgcatcccataagttttgctacgttttgtttccattctcctttactgaaaatatttttaaatttatttaaaatggtttgaccctatgattgtttcagagcatattgtctaattttcacctaatttaaaattttccatagttcctcctattattgatttctcatttcatacctttgttgtcagaaaagtgacttgatatgatttcagtcttcttgaatttgataagacttgttttgtggcctaacatataacatattctggggaatattctgtgcgcatttgagaagaatatgtgtttttttgttatgtggaatgttctttatatgtctgtccaatctatttggtataaattattgtttaagtttaatgtttccttattgatattctgtctggatgatctgtctcaacgttgaaagtaaaatattgatatcccctactattactgtgttgcagtccacatctccattcagattcctaaatgtttcctttatatatttagttgctttgatgttgggtgcatatataggtttataatagttgtattatcttgacaaattgaccccactatcattatataataactttctttgtacctttatacaatttttcccttgtctattttgtctgaaatgagtataactacccctgttctcttttagtttttatttttataggtttttttccatgccttcactgcaatctgtgaatttacgttacagtgaagtaagtcaattgtaagcagtttataattggatattaatttttgatttatttagtcattctatgccttttgattatagaatatattccatttccatttaaagtaattttagataggtaaggatttatagtggtaatttgttaattgtgttctggttgtttttaaaattctttgtttctttcttgcttgctttattcatggtttgatgactttctgtagccatatgcttaggattttttcttttaatcttttgtgtatctattagatgttttgcttttggctatccttaggcttgcatagcataccttataaaaggctatttgaagttgtagttatccttaggcttgcataacatatcttataacaggtattttaagctgataggaactgaattttgattacatataaaatatctaaattttactctgctcctcccatgttttctatttgatcacatgctttgcatctttcaataattcgtatctcttaacaaagtttgtagcttcagctgttcttaccacttttgccttttaacctttatgctagctgtatttacccatcactattacagtattagagtgtttgaatttcatattgtgcttacttttactagtaagttttatactttaacatcttcatgttactaattagcatcctcttctttcaccttcaagaactccctttaacatttcttgtaaggcaggaaagtgtccttatgctctctcagctttttttcaatctcagaaagcctttatcactcctttgtttttaagacagaatagtggaatctagaattattccttggcagttgttttctttcagaattttgagtatatcattccacttccttatggcctgcaaggtttctgttgagtaatccactgatagtcttgtggaaattccattttatgtaaccattcacttttcattggcttttttcaatacttggtctataacttttgataatttgattgtgttatgtcttaaagtgactatctttcattaaacttatttgatttcctttgagatttctgggtgtgggtttctatttctttcccagttgttgaaagttttctgtcattatttttttgaatatattttctgtatcgttgtgtttctttctgtttttaacatggtgataatgcatacgttattccacatggtagtattccatctggatcttaagctatcttcacttttatttatttatgtgtttattttggttctcagatttggtgattttcagtaatttgacttcaagttcactaattccttcttctccttcatctagtctgctgatgaatacctctttaaaacttttccgttcagttatagtattctcaaatttgtgatttttgtttggtattttaaaaatactttctacctctttgttgaagtagttaatttgtttttgcattgctctcttggtctcagtgagtatctttatgaccattattttgaattctttcttgagtaaaacacctatatccacttccctcaggtcaatttctggagactcatcttgttcttttgtttggagttatgatatcttgtttctttattttctttaactcacagtgtttctatgcaatagataagacaatggcctttctcagtcttatcagactggcttcatataggagaaagacctcactaatttttccagccagagattttcatgtgcctctcaagtctttgtgcggactgctgtctcttattttttgtggccccctggaggttagaatgtgccacatcttttcaggacctgggaccaacaagttaggagccaggaggtctagatgtagctgaaaatattgaagacttggctgtgtatttacttacttctattttcatagtgaaagtgaatgtgcgtgtttatctcccactctctctctgtattacaccaagtaaagaatctgtggctaatacctgtactaatattcaggctgcatgctctgatcctgaagaggtatctgcttgaaatgagtccattgtattaccagctttttgtattctgtgatgtagggcctttcaggaatgcagatctctatcatctcccagtgtgagtttgttaaggagacgatctcttgagttggagctatagaagtgatgacctttgaatgcatggctaaacttggtccaggaagaatggataaatctgaatttatcattggggcgagactcatgaagtgccaaactttggctttggctgcgggaagattattttttgtttgcgtcattagataccctgtgcaagctcgatagaggccagttcattaagtagccagtggaagtatgtgccctaagccctttcgacagagaaatggaaattgaactttctctttccttttctgcactgctccaatttggcatagcgcctggagtttttacatagcattttaagaccatctatttgctttacgatctatggagactggtatttttctaatatctgctgtgacagttaagagttttaagaggagtccttttggaggtaactgtaaaggttgtagcacttgatggatgacacaaacctttttgaggataaacaggggagctgcattttaaaaaccttttctctgcactgctcttgggcaatgaagctcctggaagtgcttacacacccatataaaacgccatttcttttttcagtggtctagatagactctggatatattttgtgccctctactcccagaactaagagctttagaatacagtccctgaatgaaagttgtaaaagttagggcactcaagtttgtgtggacaaacttgttctaagagtgattaatgtacctggatgtatcactggggtgagccacgggaaccggctagagaagtgcctgatgcaagttcattagaatccagactgcaagttttttagaattcagacctctaagtagccacaggaagaatatatcataaaacttctcgggagaaacaggggactgttttttcagccccttctctgaactgctattaaggaatgaagtttctggaagctcttcagcacttgtatcataccaccatttttcctgtgatctagagagactctcatgtgtttaatctcctctgcttccaaaattagtgaattaaaggccaaaacacaggatgctttatgtgagatccaaaaacttctccacaaggagaaactgggtttttgagattccttttctaattgtgtggtgcagtgaacaaggctggggtccatgctccattgtgttgcaacttttcttacttgttcaatgtgaatgttgtctttgttgcctgttaagtaggagtccctttactggtctttcattttctttcaggaggagttcatttatgaatagatgtttttttaggacattcttgggtggaagaagagtcaggagcttccacttctgccattttgctgacatcactccctgcctagctctttattttacccccaggaaactagagtattgcaggtatcgttaagtgctcctacacaagcaagagagaaacctgtactttaggatgctcccccaaaagctaggatgatagatgcttagttcactcttatctttcctctctgagggagaagcagtcaaaatatattggtctctgtttactttagggggttgcaggaggctttgaactggtttcttgatttctcataaagggaattgtttccagtatcgtcattgaatcagtgtgcctgtggggggaagggagagtggtggcttcctatactggcatcgtgctgatgtcactgccctctttcatcctcaatattgatcattttttaaatcttgatcattgtttttactttgtcctcaattttattaatattttcaaaaaccaattgtaatgcctttaaattttctccatttgctctgtattttttagttttattatgttttactgattttagctttgctaattttctcccttctctgtgtttctttgtccgttttctcttcttcactgattttactgttttcttccttctgatgacttcagttttaatttcacttttctcaatcttagggtgaaaaatgaaaacatggtcataaactatcatactttgaaaatataaaactttaaagctctattcttttaagcactgctttagctgtgtcccagaatgttacacacgtgtgtgtgtgtatgttctatgtgtcgggagacagagagagagagttcatttttatttgatttgaaatattttctcatttgtcttgtggtttgtctgttgatgattaattatatggaagtttattgtttaatttcaaaatatttgtttttttctagataagtgatttttgctggtttctaatttaattctcttgtgaaagaatactgggaaaatttcaatattttgaaacactcagttttttaattgctcagcacatagtctaccttgctaacggttctatttacaaataaaaatatgcatacacactaaatgtagaattaggctatactgggtcacaatgttcttcaaatttatttgccatgtcacaaaatgttaaataatctctttcttaattgtttactatcagcaaatactttaaattaaataataatgattgtggtacacattaaaatcaatgggatacagctgaaacagagatgtatttagcattataacatgcatcagaaaaaacaaataaaaaaataaaagcaacaggtactacaatctagaaggtagacaggaatgtacacccaacaaaaatagaaggaaagaatcattcaagcataaatagttgaccattaatcttaagaaaaataaattgatgagaatgttaaaaacatgtcaaaatattgaaaaacagaaataagcaaaatacttttgataaatatgaaatactttatcataagcgaaaaaagaaaactcgacattatcaataacctttaatgaagttttgttcatccaaacgtctccctgaattgataacaaaatgtcagacacttaaaatcattgccatgatttcctatagtacgattacataaagctttaggtgaagtagagcatacactatgataggagaaaggaaaatcaagggattatagaatgctcccagatgcttctaaactcccccgtcagtcaaacaggacatgcttcattttcatattatgaaaaaatgagatatttctgatgtatcgcagtttaacaggagcttagctgtgagtttacaaaggtgtctttatatgtgattatacaactaaagccaggctgtgcaatgcattaaactgggtgcataacatccatttaaatatccctaaacagtacaggtaagctagtaaataaaagctctaggggagtttcaagttttaaatagcacactataaatcactagtgattatatttaatgcttatattggtcaagtgtcagtaccaaattgattattaactacatataattctacttctggctaatcagattccattggcagaaaatttgtgagtgttttaatccaatcctgatacatttgattatagatatcaatttttatttaatgcatgtaattaagagtgtgtaattccattaaaacattctaaaggctcaaaataattaaaatcaatattacataaattatgcaaatttattaaacaaagaatatatgaaaaaactacaagaaagtctatgagaatacaagccaaaagttctattgtttaatgtaactgttacacagctgaaaagtataatatttgcatacaaaaacatcataattaatatgtgataatttatgaaacagttattgatctttctatttattctattttaatcatataaattatttttcatcaaaaattctaattttaatatttttattttttattttttattataacattaattatatttttaatattttttagtggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttggtcagtagtgtataatttgttttacataattctttcaaatgaggttaatattctcttgtgcttcgtgtaaacaagagagaagttctttctctgtgtctattactttatcctgacaaaataaattaggacctaggcacattaatcaatcaccactctttcagttttttgaacaaaatacagccaaaatctttggaatattatgtaaatgtcagataacatttccattcatgcatattttaatccttgtgatgaacaagacatgaatgaagatgattattgaacaagaggatggtaacatagatatggtggaggaatatatctttgcgagtttctaatatgtttttgtttttaaataattttatttgttcaaattatactcactttaaaatccgaaatagtatttagttttatatttcaatttaagtattttatttgtttttaaccctttgattttcattcttcatttagaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatctattctatttatgttaattttatttgttcatgatagagtcactttgtattctggcattaaaaaataatatctagtgaaattaaacctatctgtattattctcatgctgccataaagaactgcccaatactggataatttatacatacaaaaaaaggtttaattggctcactgttctgcatggctgaggaggtcttaggaaacttacaatcatggtggagggagaagcaaacgcatgaagacaggaaggagaagttctgaccaaagggaaaaggcccttataaaaccattagatctcatgaaaacacactcactatcctgagaacagaagcatggggataactgcccccattattcaactacttcctactgagtccctcccacaaaacatggagattatgggaagtacaattcaaattgttatttggttggagatacagtcaaatcctatcattccaccatggcctatcccaagtctatgtcctcacaattcaaaacacaatcatgccttcccaacagtcctccaaatcttaacttattccagcattaactcaaaagttcatatccaaagtctcatctgagacaaggcaagtcctctctgcttatgagcctgtaaaatcaaaagcaagttggttatttcctagacacaatgggggtacagggattgggtaaatgcttccattccaaaagggaggaaatggctgaaacaaagtggctatatgcttgatggaagtctgaaatttaatagggcagtcattaaaccttaaatttccaagattatctcctttgactccatgtctcacattcaggtcatgctgatgcaagagatgggctcccacagccttgtgcagatgtggctttgtccccctcctggttgctttcatgggctggcattgagtgtctgtggcttttccaggaacatagtgcaagctattgatggatctaccattctggggcttcaatgattgtggtcctgttctcacagctccacaaggcagtgcctcagtggggactctatgtgagggctctgaccccacatttcctttcctcaatggcctagcagaggttctccatgtgggctcccccctgcagcaaacttctgcctggacatccaggtattttcatatatcctctgcaacctagttgtaggttcccaaacctcaattcttgacttgtgtgcacccacaggcccaagactacatgtaatccaccaaggcttggggtttcaccctttgaggcaatggaccaagctgtttgttggccccttttagccacagctggagctgaagcagctgggatacagtcctgaggctgcatagagcagcagggacctgatccaggtccatcaaaccatttttccctcctgggcttctgggcctgtgatgggtgggggtgtcatgaaggcctctgacatgccccggagatatattccccattgtcttggtgattaactttggctccttattatttttgcaaatttctgcagcaggcttgaatttctccccagaaaaatgaagttttattttctattgcatttacaagctgcacattttccaaacttttatgctctgcttcctcttgagctctttgccacttagaagtttattctgccagataccctaaatcatctctctcaagttcaaagttccacagatctctaaggcagggcaatatgccaccagtctctttgcatagcaggagtgacctttactccagtttcaaacaagttcctcacctcatcttcatctgtgaccaccccatcctggacttcattgtccatatcactgtgagtattttggtcaaagccattcaacaagcctctaggaagtgccaaactttcccacatcttgtcttctgagccgtccaactccctaggaagttccaaacattttaacattctcctgtcttcttctgacccctccaaatggttctaacccctgcctgttatccagttccaaagctgcttccacatttttggttatctttacagcagcaccctactctctgcagtaccaatttactgtattagtctgttatcatgctgctataaagaactacccaagactgcataatttataaaggaaagaggtgtaattgactcacaattccacatggctgggaggcctcaggaaacttacaaccctggtggaagggtaagcaaacatgtccttcttcacatgatgacaggaaggagaagtgcaaagcaaagacagaaaagctccttataaaaccatcagatctcaggagaactcacgcagtatcatgagaacagcagcagaggaaaaatcgccctcatgattcaattttctcccaccaggtcccatccacaacacgtgaggattatggcaattgcaattcacgatgagatttgggtggggacacagctaaacctgttctgcaagttgtcatgtttgctttgccactatgttttaaaacttcttttacattcttcccacaatgccccttcttatttcctacaatatattatgttttacctggaatcgttaactctcaatgtgtatcttattatcactagtaagtttacagaggcattgtttaccaggcatagatgatctctttctgaaatgtattgctatttttagtttcaagtccttcttcagttggtgacagtccgatagacagacagacaccagaaggctagttttaggaaacatttgtgttacttctctgtgatgtcatagtagctcctgtattgtttattttcaaataaaactacttaatattaaaacaggcatataaaattaaatttatgagttagtgaaacctgaattcattcttttttttttaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaa

SEQ ID NO: 2429 - DNA, 49688 bp, Homo sapiens
  source 1..49688: mol_type = genomic DNA
acagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaaggtaagattaaaagagactcttttctgaaaactgtattatgaaacatttgctaatgatgcttttcacaggagtaataaaaatttgatttagaaaatgtgcttaagtattctgtaacttgacaattgagtggcttttgacattgttgagtttaaaaaatgtaagaaccttatttgaatggtatatctaaatattcatcataattatatttaatataaaatagaataaaatgttttaataaacatttctgaaaaactatgatctggaataatcatttcccttgtaattatcataaaatgtaatttacttttttgcttaggagtataaccaaaatgtattatgtgaaagcattaagaaggatgtgaatatacatagtcaataaaagccatcaaatcataatgattagatttatttcaaatatgattttaactcttcctaaataaaaattcatttatcatttacaactgatattgtcatgaccttagaattcttgtagacaagtattacttgtattatcagaataaaaatattatataaatttgaaacccaattgaatatacaatatttgtaacagttaagttgttcaatagagatttttttcctgtagttgtatataacatatattcttgaagagcagtcttttggagtagtgaatatgaatgtaggagtttttttctgacctcagtaagacaatttctggattcataataaaatttaattatatcactgcttcttgatagattaaaaagcttattcttggaggaggtttgctttcctagtttttgataggtaaccagttatgtgatagatatttggtaaacatttttaaactgaatgaattacatattattcataatttctaaaatcttttcacttagtaaagaaattttgattgagtgaccattacatagcctctaggaactgaagaatattagcaaataatacaaatctctgtttcagtcttccaatctagaaaataaaagcagatatattcttatagttatacactttggtaatttaaaaaatattcaaatatgtttaataccttttgaaaggttgaattattttcagttatattttctaatgttattgcttgttctttggcttgtaaactttatatgtagccactttttaaatgaagaaaacaattatttccttgtacatataaatattataattagtattttaaaatgaaacctttttgtatttacaaacagttccagaacaatgtcaatattacctattgtaaaagacatctttttctgtttctttgtgtaaatatttctgtcttttcttactaaatttatgggaatgtttctaacgtttcatacctacatactgtttgctccagttttacatagataccatttgtcatataagggagatttgttttatttctaatctttaaaatcaagaatcaatggcaagtttaataaacagtttaagttattaaaaagttgaatttgaaatattattaaaatagagtacatcaaagtatatgtgataattaaacaatagtgatttaaacatcttatttacataattgattattgctgacttgtttcacttttattttatttttcatcaatgtgtgtttaaatgtggtatcagtttctactggtgaattgaacatcggcactatatatgttatggtgaaaatgatataaatctgattatttcctaaaagataaagcacaactttgtatttaaagcaatgcttaggccagcctcataattttcataaaagcacatgtaatgcaaaagccaatggagaaaaactacatgaattttcagtggatatcagactcctaatttattccttgtttcccaaatactctctgaaactaaactagttcgagatgtccatcagttctattaatctaccatatctaaaaaatttttacttaacagagtagctttgatcatgaaaaatactcacatatatttcaatatttgcttctgtttatattttccacattgaatactgaataccaaattgagaagatagtttgaatactatcacaatctgctttattcaacagcataacattttagcattacttctgctctgttaagagtgaactttcttcaaaaaaaacactattcattactaagaaagaattatagccagcaggaataatttgtaatttcagctttctatttgttttctttttttaatatattgggtactacatagaacctttctaatgcaatatattgtctacaataacatttccaattgtgtaggaacgttaattgcctccttgttttaacagtctggctcagggggtcactgcaggctactaagaattgggtcagatttacaggacaaagtttaaaataacagtttctcaatcgtaccacctaatttcacctttttgaaatatagtatgaccaaggttttgaatatattatgaccaagcagattttttagatttagggtctaacaattgtgtactatatgaaattaggccacagcccagaaattccaagatgattaaagtgaataaattaaaactctactgaaacatgttcaagtaaatactggctgtgttgtttgggagacatgttttttaatcctggagatttagagtgcagaaacgttatttcaggtcccagaagactttatagatcagagattgatggattccattacagtcagagaaaggagaatagtggtctaaaatcctaaattgtatgtttgaatttcagtgtgataaataagaattcccctttgctcccccaaacccccatattttcagagatagtagtatgtgtatttatctatatggtgtgatttaaattgtgcgatggcccaattggcttcaatatctcatctcctcctaaaatactttacgtgttgatattaatattactataatttcaaccaatctgtcatttacatggaatgacaaatacactgaatacatattttaggatagttaaatttagtattattcataatttactttgaattattatcatctgacaacttccctgaaacaatttcagtgggcgggggagggtagaaatggatgttgatgaggataagaatagaacaaagtgattctggaagatggggttttcccaggtaggacagatctgctggttgaagtgctatagtgagtgctataagagaaggggtagagaaaatgcccacagaaatggcacgagcctgagacgtctgccaaggcaagctttgcttattttaaatttaggcatatcctgggaatgcatatgctactcttttgcctacatataatttaaactaaaaatgaaatatctaagtattgctaactaaaattattcttaggtagaagtaagttcccaaatataagttcaaaagcagattggtaaatgttcttcatgtgtggcctttggtttctaagatctgagccagtctacattgacccacttttatttgcttaatcctcgattgtttattctgcagtcttttgccacttttcattcttcccagttatgccttctcctcctccccacacacaccatcccccacctgcctaggcctttgagattctgccacccaatctatcccgtgctcagttaactaacgtgtactttacccatttcttcacaaaaccatagtacatggaaaggggatgatgtaattgacaaaaaagtattgcattttagcttaaaattataaggagtcataaaaagatagctcagaggaaataaagtaactgaacatcaaaaaatgaaacaataaaaaggaaagaaaaaacatttgacagaacacttttatttcttctgacattttaacttagccaagtttttcataaaccttgttaactggaaatgtaatagatagaaaagtgattattcttccaggccgggcatggtggctcacacctgtaatcccaacactttgggaggcccaggtgggtggatcaccatgtcaggagttcgagaccagcctgaccaaaatggtgaaaccccatctctactaaaaatacaaaaattagccaggcgtggtggcgcgtgcctgtaatctcagctactcaggaggctgaggcaggagaattgcttgaatcagggaggcggaggttgcagtgagctgagatcatgccattgcccttcagcttgggcgacagagggagattccatctcaaaaagaaaaaaaaaaaaaagaaagaaagaaagaaagaaaaggaaaaagcaatattctttcagaaactcctgaactgtaacataaatttaagcttaggacacataggtcagatgtacaatggaattacaaatgttagagtttcctgggttcttgcaacagagttttaagtgcactaaacagttatcaccttgtcttctcttatattttctagtcactactgtctactacgctttttccacaggctgtccataatctacagatataatggaaaggcttccagatagtttcattgttactcatctgttctttcgctcattcatttttccatcactttaacttccacaagtactacttagtaatacttggtacaatgtgtgttgcgtttttttttttttttctctattttcagggtcctaattgtactgtctctttgtggctgagttcgttttttgtgactggaacaataactggcattagaaattagctattcaaatacacatttcaagaaagttgtggaatttcaacccatgttctgatagtatcttgttttatctctaattatgacatacttgttattctatccaacttcatgtgactatcgtctattctcctatctgctttttatggttctggaattttcttcttgctcttttcactgttaagttgtttgtttgtttgtttgtttgttttgagacaggatctcgctttgttgcctgaggctggagtgcccacgctggagtgcagtggtgcgatcatagttcactgcagcttccaacacctgggctcaagcaatcctcctgcctcagcctcccacacctagctaaatttttttcttttcttttttctttttctttctcaaatgcctattaagtgtgacataatctctattctgctttgtctctagagtttgtttctttaaacaattctttactctgtttacaaaggtatatatgttacttctgaaatgatctttattctcatgttatttataaaataatttgaatatttcttattttgaaaagctaattagatcatatcgtatatatgcatatagaattgacccttgaccaatatgtgcttgaacttcaggggtctgcttactatgtgaatttgtttcaactaaacctgggtcaaaaatacagtattggtgggttgcaaaacttaagcataggaaaaactgacttttcgtacatgcggtttccagagagccaaatgtagaatttaagtatgtgcagattttggcctgtgtgggagtcctggaatatatatcccctgtgtataccaaagccaaaggattattgaataaatagtattactatagatcagtgagaagataagaaagaaatttaatgcaaaatacctatttttgctatttctgttttgttcatttgctttatttttttccaaattgattttgtaactttgctttataatatattctgatacctactaagtttagaagtaggctatttaaaaaataatatctactgttttttatgcacaaaataattttagaaaaatagaataattgaacaaagagaccaactttagtctaccaaaacaatctagcacaaatttgattaaggatttcccaaatatataattttatcatgatttatttcatttgaataaaaacacttttcaactaacagttaaaagatatattgacattgaaaataagtaattagttctatgtttgtatgtcaataataagtaattagcttggtgtttgtatgtcaataatgcccccttaaaatttgaaagtgaaaaaattaggtaaattaagattattaaaatattaagtaatattgatttttagctttgaccaaaattatataactattttcctcaaattatagtaaaaacattcctactctttaccagtagttaaacgtattcacactcttaattcatgggctaaaaaaaaacttgattttgtttagtattattcttacttttttgagacagggaatcactttgtcacccaggctgcagcgtactggtgcaatcatggctcactgcagcctcgacctcctgggctcaagcagtcctcccacctaagcatcccaagtagcagggattacagccaccttgctcaggtaattttttttttttttttttttttgagatggagtcttgctctgtcgcccaggctggagtgcagtgtcgctatctcggctcactgcaagctccgcctcccgggttcacgccattctcctgcctcagcctcccgagtagctgggactacaggcacccaccaccaagcccggctatttttttgtatttgtagtagagacggagtttcaccgtgttagtgttagtcaggatggtctggatctcctgacctcgtgatctggtgatctgccggccttggcctcccaaagtgctgggattacaggcatgagccaccgcgcccggcctgctcaggtaatttttaaaattttttgtagagacagggtttcaccacgttgcccaggctggtcttgaactcctggggtctattgatcctcttgacttggcatgtcaaagtgctgggattataagcatgacccactgcatccagactaaaactaattttaaattgtaaaataaagccaaatgaattaaagcttcaccaatgtagtgttttgtaaacaaaattaactggcaattaaatgacttgtaaacgtaagatgaagtattcattgtttaaactcaaatacttagatatgatggcttagtctactcattaatctagaatgagaaaaatgagatggctatttcttttagttttaagataaatcacatctcaaaaaaatgtttctgtgcctttcaatttgtatgcatcctatttaataagcccgttgtacatacatgctgagagtttgactacttgggccaaaataaccgtttgttgtctacttgaaggtggttcaactgagcttgaacattcgattgttagtcaattcaggcaaataaaagttatgtcacaagatatacctaattattattagaactcagtgcagtgaatcattaccttaaatacttttgctatggcatgagttgataatgatgtaggacagcaagcccccaaattgggtcttagcctgggaaggttcttggttttgtccagtaaagaattcaagggtgagcctgtggtgttaaacagcaatttttgttgaagtggcagtgtatagcagcctcagaggcacctctccttgctaagcagggctacccataggcagtgtgcccacagtagcagctcagaggcagttctgcactcatatttatatgcacttttaattatatggaaattaagaggtagttaatgctgaaattgccaggaggaggatggtaacttccggttgttgggtcattgctgtggaaagggcctgtaacttctgggtgttgccatggtaatggtaaactgtcatagcacactggtctgtgtgtcttacagggaggggcttccactcagacctgttttggataatcctcaatttggtccagtgtccaagtcccatctcctatctcaataatactcaatacaataatggttagaacaaaagcagacaggaaagtgtatctgaagtgagaagacctagacattaatgaaaattcttccacgaactatgaaaaacattgttcttcaattgtggggagcttacattttgatgtggggagatagatagaaaacctaatgaacaaaaatagttatagcattgtgaaaaattttgtgaaggaggtaaagtagggcctaagagaaaatagagatggggatggtagtatgtagagacattaggtgggcttggtcttggggactagaatgagtggatcactttgaggacagaacatttgagtagaggcctgaaagatgagacaaagccagtcatcagaaatctgtcgtaaaattattctaagaggaggaaataacccgtgtaaaggatctaaggaaaaaataagtttgaaatgctcaacaaaatataaacaaataaatcagcgtgactttgcacagtaaatacatgggagatttaacatgatgagatccgagaaagtggcaagagccagataaggggttcccaaaccaaggaaaggagttagcaatgctggataagtaaaaagtgaagtcatagaagaattttaatcacaggaatgacatgaccagatttgcaagaatcacttgtcactctgtgaatagactgaagtaacaggagagtagaggactggaggctagttagcaggcaagtttcatgaccaaagtgacagatgatgatctgaactaagattttgaagatggtagtaggagcaagggaaaatagaacaggggcggtcatatctttttcttacaagcagaatcaaaagatgccatttaacactgatggaaaaagcaccagaattttaagtactatttgaagagaaaaggtaatcaatatgataattctttatatatagtaaacatattcacagagtaaatattgtgagaagttggtaggaagattttgtggaagagatgtatccttgttttctacatctggttgttaaaagcaatgaactatatttggaaatcaagaattaggggcacaaacgtatcacctggaaatataataataaccagaagggaaagcatttacttctcactaggaagtgagcgggctaaactttttttgtgttaatggattactttacttatttattttttccaataacctgaacatcatcaaatggatctaaattttgaaagtgaaaaacaaacatatcagcttgtaattaatcagttttccttttgtgcggaaggggccggggattgtgttgttatgatagagtattagcaccatctagtggagtagaatatgtttacttaaattataaacatcgaaatagtgcaatgtggaatcacatattatatgagttcactaatacaaatttgcaaaaaggtcaagggaaaattagtgcccataaaaactttcacattattttgtaaaatataattttatatggtgttttctttcttatgaaatattgcaaaatgttttcatatggatttgttccaccatgttaatgggcacttctaaaacttttttctttgggctgctacaacaaaatattattaactgcctagcttataaacaacaggaatgtatttcttacacttctgaatgctagaaagtctaacagcaagatagtaccagcagattcagtgtttggtgaggtctgctctctggttcatagacagtgccttttggctgtgtcctccaatgatgaaagggacaaggcagctctgtggtgcctcttctataaaggcacacatcccaaatcatgacagctccaccttcacgacctaatcacttcccagtgtccccacctcctaatactatcacattggtaattaggtttaaacatataaattgggggttgtggggaggttgcatgtattcagagcatagcatatgccttcttaacttactaaagtctaataataatttatcactcaggattcaatgcgggaagcttaagtagaagtagaagattacctatctatcagtcaattaattgattgacataccaatctcctatctacctacttaaaaagaggttttgttttgtttgttttgttttgttttgttttttaaataaattgcctcaaggaattgtgagcatgagataagcaagtctgaaatccacagggcaggtagtcagaaaaggaagattacagacaggatggaactcacaggaaaggaagctgctttccacagaattccctctctttttcagaggagcctcagccctatgtttcagacctttcaaatgatttgatctggcctatctagattacctagaatgatcagcttgtttaaagtcaactgattgggagtgtatctggcaacatattttctcaccaacatttagattagtttgactcaataactgggaatgctgacttaagcaagatgacttattaagaaaactgtcacagctcattaatacctttctgtttttctggacactgtgaagaacttaaaagacattaattttattaatccttctcacagtttacctactattgtcatgtgttttatgtatatgggtgtatacacatacatgtttgtatttaaaaccatgtaaggtaatatttttattattttatagtcagtattcatttatatttacttgaacatttaccattttctttgtttttcatttcttctttcatcctaagaccttatatttaggatcagtttcagttttctgaaatatatcttttttctctccttaatgtgtatttatagtggcaaattctctcaaattttattaatcagcccgggcacggtggctcactcctgcaatcccagcattttgggaggctaaggtgagtggattgcttgagcccaggagtttgagaccagcctgggcaaaacggcaaaacctcgtctctacaaaaaatacaaaaattagctgagagaggtagtttgtgactgtagtcacagctacttggggggctgaggcaggggaccacttgagcccagggggtcagggtcgcagcgagctaaaatcacaccactgcactccagcctgggcaatagagatcttgtcaaaaaataaaataaaataaattttatgaatcaaaactttattctcaaaaaattatttctgtatatagaattctatatagatagttatttcttcctgaaaatggaagtgattaatacctggtggcgtctgctattgctattgagaagtctttgtaaatctaaccattactgcttttaaattaatatttttctctaacaaggttaagatattttctctttggttttctgcatattccttatgatgcatataggtgtgtttttttactgcttggaattttttaattcttggatatattaattggtatgttccattcattttttaaaattctcttccaacattgctctggcttttctatcctcattgactcttagctcatcttgtgtattttccacacatgtgtgtctccatgttgcatcctgtattatttcttttgacctgccctcctgtccacgaattctttttacaactgtgttatctgctattaagctgtccattgatgattaaaatgggttttttcatttttagaaattatatttggttctttttaaaatctgctactactttgttataatttctttcctcagatatcattagtcaaacttttctcttacatttaaacaacagaattagtattgttgattatagtctgtatatatttattccaatatcaaatatctattttgttccttatgaagtttatggtaactaggtgctttttctcccgtataatgtctttgacatttgtaataataatttggtgcttaagaaaaaaatcttcctcatattaaagttacaacttatcttttctgggtggctagaagaactttcagtgtgagactaccttaagccaaatttgtgctttaaaattccttggtgctctaagcaattcaaagctgggttcctgtaagaagagtgtggtttacttccagttctcccttatcctgtgggtgaattcatttaggtttccaactttgaattttgttgctttagcctaataaggctatcaaaaagcaagcttgtgtcttccccaaatggtgaatgcccacagtgcagaaaaaaattggctgcctgttttcctttctgggttctgattataccaagatatgttatggtaattctttactgtctcgtcagctttctaaatgcctctatgaaagtatttatttcaaaacatatgttttcctgtttttttccccttttgtgacagggtctcaccctgtctctcggctggagtgcggtgacatgatcatagctcactgcatccttaaactcctgggctcaagagaccctcctgtcccagcctctcacatagctgggacaacaagtgtgtgccaccatgggtaactaatttgtttctttaattttttgtagagatgggatcttgctatattgcccagggtggtctcagactcctgggctcaaggggattctcccacctcagcctcccaaaatgttgggattacaggtgtgagccaccatggctggccacctggttttattgtgaaggtgtcctaagtgataagattaatctgaaataatgaatcccaaggcactcaaattttttgtgaaatagccagacaataaatattttagacttcgtgagccataatgtctcgctactcagctcttctattgtaacataaaaggagtcatagacaatatataactatatgagcatagctgtgttctactaaaattttatttacaaaacaagcagcgattggatttggcccacaggttagttttctggcccctgacctaatgtatctcactataacagaaaatatatactgactttccttcttactattataaattttatgcacataattaaatattacccaaaccacaatttttaattcagatgggtgtagcataatttgacaattttcataaatattctaattatatccattattaaaaatgctggaataaacactctgtacctaaatatttcacaaaatctttaattattatttgttacttttaaaaaattgaaattatttgtcaacttacgtatgagtacttttaagattctttattgctaagttgctttttagtgaagtaatagtcatttatatttcagttttatttaataataatatttatattacctaattttccagcaaaattgattatcatctcctttacatttttgtgttaaaattggtcaaaaaataattttcttttaatttttatctcttttaattattggtaatggtcacgttaatgcctgttcttaagtaaatgatctatcctactctaacatttttctttagatagtgtttagtgcttttgttactgcaagaagtgtttgtgttaagaataatttttcagttaaattttctccacattttgtatatatgattttttcacaaatataatttttaattaacaaagttttaatgtgtatatgttctgtttgcaaattgctttatgcattaagccttccttttttgatatttattcatactttttaataaatatatttataaaataaatataattatagatagatggcactaagataatagtaagttaaaatgacatatcatcatatatagcagataattaaaaaattataaaagaatgaaacatatatgtatttattttaaatttgtttaaacctaactctttagtctacctggcatttgtgtgcatgtgtctgtgcaaataaagtaaggattcaaatttatcccatttcatttccagtgggttttattttttatttattattattatatttttttgagacagagctttgctcttgttgcccaggctggagtgcaatggcgtgatcttgggttactgcaatctccgcctctcaggttcaagagattctcctgcctcacgcccccacgtagctgggattacaggcatgtgccacaacagttggctaattttgtatttttagtagagacggggtttcgacatgtttgtcgggctagtctcgaactcctgacctcaggtgatccacccatctcagcctcccaaagtgctgggaatataggcgtgagccaccgcacccggccccagtggattttaattgcaagcctgccagagtgagtttcaatttgaggtagtccaagtttacacagtacgatagacttacccattgccaaggttacttggcttgaaggaaaatacagaataaggataaaggcagtatgcacaagaacagcttgatggagatttcaggcactgaaactcagcttctaatatcttaacccccaccaggataattttgctgatgaaggatgaaagttgatgccagtataggtcacatccatgcccggtaacaacagaattgggtatccttagtttaaatactttagttgtcaccttgaacttggagggtgatttatgtgatcatcactattatttgctgttttctattttctttagatttcatttaatgttttactagtttcttgaattagaaatttggataattgatttccaacagttttttatttctaattcattcgagttatatttttttctctctaatcagtgcttcagcatcagcccacaaattttaacatatatttccattattgtttatttcaaatcatattctcatttatattatatttttctttaactcatgagttatttataagtgttgcttgccaagtgcggtggctcacgcctgtaatctcagcactttgggaggccgaggtgggcggatcacttttgggaggccgaggtcaggagattgagaccatcctggctaacacggtgaaacaccgtttctactaaaaatacaagaaaaaaaaacccaaaaaatagccgggcatggtggcgggcacctgtagttccagctactcagatggctgaggcaggagaatggcgtgaacccaggagtggaggttgtggtgagctgagattgggcactccagcatgggggacagagcgagactccgtctcaaaaaaaaaaaaaaaaaaaaagggttgcttaacttcaaaaattttgtgaattttccacttattttctgttagcaatgtctagtggtcagggagtatacttagagtggctttaattttttgagattggtagagatttgcttggaatgaatatgcatcttgcaattgttgaagacagtgttttattaatataaaaaacttaatttggttaataatgttgcttatatcttgtatatccttatttttctatttcttttctattggatattggaaacagtgtgcttaaatctcaaactatgatggtggattgcttacttcttttatttctgttatattttgaagatgtattaatagttttatgcaaagaggcatgctggtaaatgtaaaacaaccaactattttttaaaaggaaagggaacaaccatgatttgtaaaatttgctgagtttcatggtgtaaattctcacaatatggtcaatttcaagttaccaacgtgtcatcaggagacattgtattagcaaaagatgtgtataattggctcctatgagtcagtatgagccagctccagcaaacattgttcagacacatttgcaattattacatctttctgttaaagtagcctttttattaatatgaaatgactctctttttatctaataatactttctaactaaaattatcatttgcttgatattaatacattaatatcattcttactttggttgatacttttctagcatattggtttttatcatttactctcaatttatatgtacaattttattaaaagtaatcatcatatatttgagttttcttttatgcttttatccagtcagacaatctttgtatgtttagtatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaacatgcttaaattattacaatttattctaaattaatatttttaccacatcaagactatggggaaaacatcacaacacttttattttctttaccttttcctgacacttttgctactattgtttcatattatactcttgaatttattaaaaacactattaaacatggtctattgatttaaacagtcaaggctcttttttatttgagtaaaatatacatagcatagggtttatcatgtttcaatagcttttttatttactcttctatttattttcttcagttctgcttattcctttttgtacttctttgcttatattttagatcagtttccttcagcccagagaacttttttagtatttttctatagttgagtctgctcttgttgaattctttctgcttttgtttgcttaagaatgtgtttctatttgctttcatttttgaagtatattttcaccatttatagagttctctgctgacttttaattttcagcactttagtaatgctaagacatatatattcagacttcagtatttacttccacagacttggctgttatttttactattctcctggaaaaaaaatgtttcctctgtctgtgatatggtttggctctgtgtccccacccaaatctcatcttaaattataatctccataatcatcacatgtcaagggaggaactcagtgggaggtgactggatcatgggggttgtttgtcccatgctgttctcatgatagtgagtgagttcttatgagatttaatggtttaagcatctggcatttccccaacttgcacttctctctcctgctaccatatgaagaagatcctctcttcttcttcaccttccactatgattgtaagtttcctgaagcctccccaaccatgtgaaagtatgaatcagtttaaacttctttttttatgaactacccagtctcaggtaattctttatagcagtgcaaaatggactaatacagtaaattggtaccaaggtagtagggcactattataaagatacctcaaaatgtggaagtgactttggaactgggtaatgggcagaggttggaacagtttggaggtctcaaaagaagacaggaagatgtgggaaagcttggaacttcctagagacttgttgaatgctttagaccaaaatgctgatagtgatctggaatatgaagtccaggctgaggtggtctcagatggggacaaggaacttattgggagctggatcaaagatcactctaactgtgttttagcaaagagattggcaacattttgccccttccctagagatctgtggaactttgaactttgagaaagttggtctgaaattggaacttatgtttaaaagggaagcagagcataaaagtttggaaaatttgcagcctgatgatgcaatagaaataaaacccgaattttcttgggaaaaatgcaagcccactggagaaatctgtgtaaggaatgaggagccaaatgttaatcaccatgacaagggaaaaatgtctccagggaatgttagtgatctttaaggcagcctctcccatcacaggcctggttgcctcggaaggaaaaatggttttgcaggcctgggccccactgctgtatgcagtctcaggagttggtggcttgcatcctagctgcaccagctgcagccatgtctaaaaggggccaacatacagcttgggccattgcttcagataatgaaagccctaagccttggcagcttccacatggtgttggtcctgtgggtacacagaatacaaaacctccacctagattcagaaaatgtatataagtgcttagatgtccaggcagaggtgtgctgcaagggaggaaccctcatggagaacctctactagggcaatgagcaagggaaatgtaggattggagcccccacacagaggtcccagtggggcactacctaatggagctgtgagaagagggccacagatcctccagatcccagaatggtagattcactgacaggttgcaccttgtgcctggaaaagccacagagactcaatgccagcagtgaaagtagccagggcagggggccataccttgcaaaaccattggggcaggtctgcccaaggctgtgggagctcacctcttgcatcagtgtgacctgaatgtgagacatggaatcaaaggggactgttttggaactttgagttttaatgacttccctattggatttctgactttcatggagcctttggtccctttgttttagccaattcatcccatttgggatgggagcatttacccaatgcctgtattcccattgtatcttgaaaatgactaattttcttttgattttacaagctcatatgtggaagggacttgccttgtctcagatgagactttggacatggactttagggttaatgctgtagtgagttaagacttggggggactgttgggaaggcatgattatgttttgaaatgtgaggacatgagatttgggaaaggcaaggggcagaataatatggttaggctctgtgtccctacccaaatctcatcttaaattgtaatcaccataatccctgtgtgttgagggaaggacccagtgggacgtgcttggatcatggggcagtttctcctatgctattctcgtgatagtgaatgagttctcatgaggtttgatggttttataagcatctggcatttcccctgtttgcacttctctcttgccatcatgtgaagaggtctttccttccccttccaccatgactgtaactttcctgaggcctccccaaccatgtggaattgtgagtcaattatatctcttttctttataaattacccagtcttgagtatttcttcatagctgtgcaaaaatggactaatacaatctgcttttaagattttgcctttatctttggttttcagcagagtatcagtataggttttcttggtatacagcattttgggggtttttagaaattttgattttgtgagctgatttctttcatcaattttggaaacctttgagctattgtttcttcaaatattgcctatgttcattttcttctctattgttagaattccaattaaacatgttttataacttgactctacaccacacatttttttatactctgttttgtttgttgttgtttatacacttttgtctttctatatttccttttggttatttttacattaaacttcctctaagtttaataagtttgtattgtgctgtgtccatttgattcttaaaaccatctgacaagttgttatttctgatttttgatccaattttaagatagcacatgatttatgagtcaattttattttgaatatcttttttaaattttcatttctatattttctatagttcctttaatgttcctaaaatagctgttataaagacctaacactaattctaacatctgaatctgagtgtctagttctactgaatatttattttctctttttgttcacagttgtttttgcttttttgtgtatcttttaatttttattcaaaatcgtatttttaaacaaaaacatgtaatgacaaaagtttatataacttactctcatcaacaagattgtttgctctttcttgagccactcaaaaatttaactcagagggacctgggtaacacttttagtttgagtcagtcccatttctggtttctagtctcaaagattaaaccctcttgggtttttaaagtcaagaatctggttggtttcttctatctcaaaagactaatacacacacacacacacacacacacacacacacacacacagagtatatacatatacacatatatatacataaatataaatatgtgtatatatatatactatatatgtgtgtacatatattagacttttgagatagaagaagccaacacatatatattatgtatgtgagcatatgatatatatataataaaagccatttatatatatgtttgcttttctgctgttttgactctgttcttatatatatataatcttaaatgctcatatataaatgaaacagcagaaaagtgaacatatatataagagcttttattatatataaataatatatatatgtatacagcttttctgctgttttgacatctgctcttaaatatcatccagagtgactttcaaatatggcatgttttgatgagaatactagttgtgtatttgagtcagatccattttcttattgagactttttttctatgagacaacgggaaagtcagtcttcccgtatgaagctacctagactctagcaaagcaacctgatttggcaaagtttcagaattcttcatgctagatatagcctccttatgtttggttctttcttacctcattaccattcttccattcagactaaatagaggcctgatcttcaatccatatccagagctgacaaacataaccaggtaaaaaatggccagagaccctatatttacttgaaacaggtccttcctacttgtgttttgttcatttaatcctctttgctcccacaacttacctttgaacatacacatgcacacacaatttgttgttgttccaatttggagtagaaacattgttcttttccatcctattctatcttatttggagtgcctgtataattctgtattaacttatcatgctaatttttgtaaatataatttttctacctgtaatgcatattatacatctctttgattacttaataactggcttccctaatagaatggaaatgctttgagaacagatagtttgtttcttcattgttttttctttataacttagaatagtgctcaataaatatttcccaaattaatggaagaatagtagaatgctctccagcaattaagagtaatataacaaaatatatctattgctttgcaaagttttttaggtgtttttccacagtgaacattcttataaaattatgtagatacaaattttataaggtgaaatgtatagttacactacatgcatgaaatgtatgtttactccatagatatggggttaggagagagagagagagagagagaaatttagatagacctgtgactgtctaggcatttttaaaagcaacaattacctaaatatactgtacatttaaatagacactttatgcacttattttgtttttattgtttgtagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagagtaagtacttaatacatttgtgaaatttatgaaaactaggtgtaaaaatacttaagatttaatattgtagcaattatgcctgaattatatcactattgccagtcaaatacaaaataatacataatcttttttttttgttttgagatggagtctggctctgtcacctaggctgcagtgcagtggcgcaattttgagatggagtctccctctatcgcctggctggagtgcagtggcgctatttcggctcactgcaacctctgcctccctggttcaagcaattctcctgcctcaacttcccgagtagctgggactataggcacgtgccaccacgcccggctaatttttgtatttttagtagagatggggtttcaccaatgctgggcaggctggtctcgaactcctggcctcgtgatccacccacctcagcctcccaaagtgctgggattacaggcgtgagccaccgtgcccagccaatacatcatcattttcaaaaaggggtggtcatcctccaaaattaaaaaagcaagcatatagtttaagttcaattatgaaataatggctttgctatgtttaattttccttacattcaatctgtcttcttatataatatcaaatatacttgttcccccactcctacataaaatatattccttgctattacatactaattcataactttttttttcgttttagaaaggccctgtggacatcctggagatactccttttggtacttttacccttacaggaggaaatgtgtttgaatatggtgtaaaagctgtgtatacatgtaatgaggggtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcaggtatcaattgctaggtgagattaattaccgtgaatgtgacacagatggatggaccaatgatattcctatatgtgaaggtagacataaaatgtatttacaagtatattgaaataaatatctaagatttaaaaaaagtcttacattaaaatatcttaaagtctctattaaatatttttatttaatgtttttttttctcatacaatgtagagtgggaatctagtctttttattactacattcttggtgtttcaaaagccaaaaacgaatgcagcctgatctgatataataattgaagtattagacattaaggaatctaaaactgatttttatttccttttggattctaatgactagaaacgcatataagcatcattagctaaataaagaccagaattttgcctttattaatgaagaagaactcacccagtaaccacccaaatgcagggatctatggtaacagctgaagtggagaacgtgattgagacctcccactaagggaggttgcctgtggacttacctttactgaaaagaggaataaactaagggcgagctctgttatttctcactggtctgtaaagcaaacagtgaaaatgagaaaatgtagattctgttttcatgttttgagctaataatccaaatctctagtcattatggaaataaaagaaatcaaccagagtagtatttcctaattccacagtgagtggcaagtggagagagatacagaagaaacgtgataatcattcaaaaactgtcaactacagaaaataatggaagattttttcatctatgaaaattggaggaagaagattaatggtctagggaacatctacattgaaatcacctgggatgcttgttaaaaactaaaatctttggttactaaaaaatgacctactgaatcagtatctttggggtgagcatgcaggaagatagccctaaaatttttattttaacaagcatcctgagtcattctatagtacaataaagtttgaccacaactttagagaaattggaaaatattaagtagaatcaaaagaactactcaaattattttaaacacttaggtcgaagaggatggaaaattaacgatgatttctctattgaagttaatgtcataaagtttgcttttacatcttttaggaacacagtgttatattattctagggcataaatgaaaatgtatttaattatctcaagctttatatttcttaattatttaaaaatactagtttgttactacaaaaatacaagctagcattgaaagtagtaattttcattgtccactcccatagaaaagaatcaggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacatttaaaacatcgttcattctaaggaatatcagcaatattaacaatagctaatgtttattgagcacttactatctgcctgtaattgagctaagttctttgcatgcatcatttcattttaactttcaaaaaactccatgatttacttactcatcactttcattttataatggaagagactggtgcaaagaagttaaatcacatgccctggattatcatggcataaagagtcaagttaggatttaaatgtaggttatctgacaccagagtccatgctttaaccataactccattgtagttgtctcttaggttgaaagagaatgctaagtatttctgctgcaagctgtaagacctctggaatagacatttgtttttattttgaaagccaaagattcattatgtatttccagagatacattagaatgacattcgtttttgaataacacttttaggaagcagacctattttatatttgtactgcaagtttactataaatgttgctgaattgaacagaatccactaaataaattgttgcctcttaaaaaaagttttatagtaaactgtaagccaggatttttttagtcataatactgccaacctgtgcatcatgaccaatcaaagattttggcttctgtgataaacatcgtggttgatttgtttagtagtaccatagttcaagttcattttaccaataattgtttggcagaagtttctggcatatttatattttaatattatctaaaatatctaaattatttttactattaaagtctgttatatcttagatacagataaaagaatttctcttcttaagaacactttgtaacaacaatagttctttatgttaaatctaatatttttattcagcatagcaaatattatgtactttagaagtacatggatggaatttacatccttacaactagattcctgtggttagtgaaaacttcctggaatggctgatgcctacgattaagtcttaaagaaaaaaaacgagattttgtagatgaaaatgagagcaaaagcataccagagttcagggaaagggaagtggaagggcagtgaggctttaaggagcatgaagcaccactgattcttgtccattgttcctaggcaccttagtctaggatgcaagtagggaacgagtcagtgataaatagaaggtgggccaatacatagtgctgaggtgctgcatgcaccatgctgaagaacgcgtcttttattcagattgatttgggaatcaatgaaggatttcaagtggagttacgatgtgtctacctgagaggtcattaagctatacacaaggaaaatggattagaaagtgggagaacagagtttgggaaactacttatgattggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatcaaaagtagagtgctaatttatgtaaataaactattataaaaaacatatagcattttctgtgttcaaggttcattttgagtacacttcgtacgatacacacactctgaaaacagacataaacagggccagaaaagttcagtagcttattaagtcattggtctatcatcaaaaaccatgtctggatcagagtgaggactataatagacttcctaattctcagtaacatacaattctcaaacaagtagattgctccactaatgcccagaatttatttaaattatatgaatattttaaaatactttaaaagtaacttgtattaataccaggtgaggaaactctcaactgacaatggaattaagttgaaggaagtgaatatttttgttaacaacaggcccagtatgactcaacggtgatgatggtcctggaaaattaccaaaaaaaaaaaaaaaaacctctcaactttcattatggagggatgttacacagagccaaagagttcatctcaactgtgctctttgcccaccaaaaaatatatctggaatagagtgttctacttaacctacttcattttaaacgggaaagtttcaaactatcatggccaagaagagagaatatggacagttgtggacttttaagaaattatgccataagacgtacagtaagaagctacagctatagtgtggtgataacagttttgagatattttcaaacatttataaaataagtgggtttgcttttgatgaggtctgctgcaattagtgaaacaaggaacagtgttaccacatatggtccagaaatctaaaagggtgatactgccatactgtgagagaaagaagagttgaactcttaagagccctctgaactttaaatcccatgattcataaatacatgtttaaactgtgctttagtaatcctcttttacaaaagaatagttaattttgggttaattttatacactaaaaaaattttggtttgagcccacaagtgtctccttggaaaacatatttttcttcacaattgcgtgatctctacttttaggcactgttaagagaatattttagaaagaaattaatgaacatgagacagtaataacccacatcagatccatgtttggctaatggtgtgtggggtccaactatttgtcttcatggcattcgtagttcctaagcaaaggaagtgcatgcacaagtcctttggcattaacttctacctgaagtatattatttccagagcccctctcaaatctatagtgaatttatccatgcagtaatcaaaatgtaacttataaaccacttattttacatcaggaccttgctgtgtattgaagataaacattgcaataaaccatcattccagctttcaatgaattcaaaataagactctgggaatttagttttatttgaatatgtgactctgtagcattactacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttttcagaagacagttcactaataatcgatataaataaaggaggatttatcccaaattagttaagcatacactctctcaccacgttttattttattgaaatatactttacgctgattagatatagagaagtctttcttaataaaagaattccactctttgtatgccaactaatatagcataaatatgactattttcttggtacaaagcaaggatctacttgctgatataagatgaattcaaaatctatacacatcattttctctgaaatcaggtaacttcaaactctctttgttgcttctaaatctataagaagtttggaattaaataataagataatattaaagtgaaataatctacttaaattttaaatactttaattttcttcaatctggtctatggcacacacatgtcagaggactgatttaaaggtgaattgtcaaaactttggtctctgtgtccaatagggacaatctgtaacagaaagttatttatagaaacaatcaaaggtacgaagaactgctaaaggaaagctatctttgatccgaatctatctcttccctgtacagattggattttctattggttcaaagcatagagtgctaaccttgaattagtattctaacttcaaatgaccaatggttgtttccaatagtaggaaaatatggatagtctcaagtattgttttggataaaggtacaggttcgggcaatgttttaataacatgatgtatttttaaaaagattatgagtgtaggaaattaaggtttatcacaggatttatgtctactgcttgagcataatcaccagaagtctttctattcttaattaacaaaattgttccatattattttattgatttcttagttaaactcttgttttttgcatctcatagcttttgacttcaaaaattggtattaaattgagctatatcataaggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgactaatatacaacttatgagaaaggaatggtggtagtatagagaagaagtagaaaaatggcaggagatgagatgtgacaagtatgcagggcccaaaaattaaaaaattaagtaaagtacaagaggagaagcaaaaaatataaagtaaaggaaaataataagatataaaagaaaagcatcacttagacaaagacaaggagaagcaggagaacataaatatataaggtaatggagaacaccaaaaagtatgtaatcaacagagtcaaatattacagagttttatctgttcagttcaataaataattaagaagtccataatatgtaccagtgactggaatatgtgaaatgcaaagcatttctgaatttggacattgggctcattggtagcttttatcagagcaatggcaacaaaatagaggtcagaaactaggtagtagtgagttaaagaataaatgtgagacgggaaagtggagacagcaattataaaatggtattttaaggattttggttttgaaggggaggagaaatgtagtacattagctaaacttgaacaaagggttgagtgaagggactgaaaattggaaaagcttccatatcaatttaagagtgtggttgataaggtaagaaagagggaaggaataaacaatggtttaaaatacaggggaaaatgaaagaattaaagctaacctgaatttgaaagcaacactttaccactgaagactaaactaaagacttaaatcagtatagatacagataatgttgaggagtgctggaaagaagtataggaaactcactactgctggtctcaattgttttgtgtgaatggagacttattatctgttgatgaagaggcaattgtttcaggtggcttgagaaaagagaggagactatggatcatttaccatgggaaatcaaatagtaaataaattgggggtatataaatggatttcaagcaatgctgaatgtttgccacagctttttagtccaaaataaaatatgactccaatagaagtggtcatatagtttttctacaatacttaaaatgcatagtattttatcttaaaacgaattttgcaaatggatccaatattgagatatagcagagttaatggaaaggagtgagaaggtgccttatagattaagatacactgggccaaaggatggcaaactataggctgcaggtaaaatacaacttgccccctttgtgtaaacaaagttttattgaaacacagccaagttcatttgtttatgtattgtttttcattacttttgtactataatggcagagttgagttgttgcagcagagacattttatctggccctttacggaaaaggttttccaaaccctctgctattttatcctattatagtaagaaaaatgtaatgcagtatctcaatgtttaagatattaagactgaagtttattttcattcatgttcactgtcaatgtagatcagaagggactttactcattgtattaattgtaagaatcaagtgacagaaacatcattttttttcatgtccttctttaatcgcggtatctttgggaaagagaacataaaaattcacacaatggcttttaaaacttctctctaaagtggaagatattacttccacttttattatagtctcctacgcaatcacatggccacagttacttcaaagaggaagggttgcgcagtcctatcaattgtccagaagaaagaaacactgaatatttgtaaacaatccttatgagaaccacagaaaccaaagaatagaaggaaagtgaaagtaagaattgaagttatatgtgatgagaacattgccagttatggaaaatcatgaagtatgggatgactttggagaagaagggattaagagcccaggaggtacaaatatgtcagatgagaatatagtgaagggaaaaataagtgatataccagaaaggatactatgatatgttcattttaatgccattttgtattatgctaaggacaaataaataacacccacttttaaatgtttatataaatgattaattttaacggatacttatttctgcattatccatatatcctttttcttttcagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctgtaagttccattcatatcttgacccatttcttaattctgaaatttcttttaaacacataaaaaatagggactcaataaaaccaaatatttgtcttattgtatatacaaagtaaggctgttggaagcattctttagttttcgaagttgccgaaactcatattttttgctactcaaaattaaatgtgtatgtgtgtttatgaatgtatgtttccctaattaataaattattccaatatctgaattaaaacactagataaaaataatgtcatctaacacatactatattagttatttattgcattgtaacaaaataccccaaaaacatatttacttaaaacaactaacctttattatcttacagtttctatcggtcagtaatctcaaaatggcttatataagtagttgtgaatcagactgtcttcttgtgttgcaatcaggatcatggcccaggctacagtgatcagaaggcttggctgggaaggaggatctgcttctaacattactgacacacatggctgttgtcaggaggcctcaggtccttaccacataggcctttccatgagttgataaatggcagctttctccagcactgctaatctgagaatagaggaagccacaataccatgtattagtgtgttctcacactactagaaagaactacctgagactggataatttatgaagaaaagaggttaaattgactcacagttccacagcctgtacaggaagcatggctgggaggccttaggaaacttacaatcatggtggaaggtgaaggggaggcaagcacatcttaccatggcagagcaggagagacagagagcaaaggggaaagtgctacacacttttaaacaaccaggtctcatgagaactcactcactatcatgaaaacagcaagggggagatccacctctatgatccaatcacctccctcaacattgggaattacaattcaacatgagatgtgtgtggggacacagagccaaaccatatcaattatctactcacacactgttaacttcagccatatctattctttcgaagtgagacactaagtccagcatatatccaaggggagagaaattaggcaccactatttggagggaggagtgttgaaggactccaagtcttagtcatttcctagtgttggaggtaatttccaaaaatcatcacatgtagcaaaataccactcaagtcaatagagtattttatttctgggatgctcctttacccctttttaatgttttttctatctctacaatcaaatttcttttctttctatctataagtacatagacaagaagtactacacttaaactatatattccatgaaagaaaaatatgatacaaatgattgattaatgacttcaactttaattcctggcataattccaatccctaagagaggaagctattatcagtatgaaacatttcagtgtgcataagaattatgaggaaaatatttaatgattttatggttggcttatgacaatgtagttcagcccaaatgtatctaaaccaactgagacccaactatatttggatttcaattattaatgtttgacaatgaaccatctggagttctcatggacaagatagaggagttgatgagttatatggtttatcagtttttaatttcattaaataaccatatctaattatcagacgcatgactttattctcaggcctgcttcattactcacttgtgtcattgaacagtttaatgatttaggggaagtgcagtacaaattcacaattggaatgatacagaggatgataataaggaatctgcattagggcagttcagcattcaaagagactcttatgtgctaagctgaatctaataagatgaaatttaacaatgttgactctaagatcctggacttgggtcaaataaattacagtatgaatatattagcagcagttataaaaattagtgaatatttttatcaattttaagatctgtttgagccaactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatatacaattattcagtttataatccacataataaatgtagaaactacatgaaaatttctctaatcaaatacaaaagaaaataaatcacagaatttaagaaagatggagatgtaaaagaatatttatatgtgtgtgtgtgtatgtgtgtattgaaattctttttaacctattgcataaggtttattgaaatagaaacatatttcatggaaaacattaataccattttgttattgaaagtactagataatctacaaataatcccatgaaaagagcaaattttctgaaaaatatataaacctgttaatataataaacaagatagcactcaaatgtatttgtcaaaattaatatataataactcagtaaaatgtaattatattgtaccttacttaaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaaaaaaaagaaagaaagaaagaaagaaatacatgagctaagcggtaaaattggcatatttctcaaccgaaaagcttatttaattaaccagggatagggtatgtgtatttaagggaaatatattaaataggtctgtgcatttttctttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgagtgtttattacagtaaaatttctttatactttttttaaaatttttattgcaagtgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagtaagtaaacctctgaactgctatatatatgtataaaactttcaaagatcgaagaaaggagagcacataagtgattacacctgtcttatgtaacagaaatagggccaagaaaagagttgttcaagcaaagtgaccaaaatagatcttttctattatgagggtttcttcttgaaaatcacaggagaaataaatatagggactttatgagaatatctatataatttatacatctattaattataaaaactaaagataagtaatattgaatattgatatttctttttgtgcaaacctttgttagtaactttagttcgtcttcagttatacattatttttggatgtttatgcaatcttatttaaatattgtaaaaataattgtaatatactattttgagcaaatttatgtttctcatttactttatttatttatcattgttatggtccttaggaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaagagaaaggagaacagcttcctctcttgtgagagagagcggcacctgaaagtgaatccctgcccctggtggagtgcactggattttataaacggtcttgaggaagcagtgtctgatttacatagggcccaaagattggttaaactaggtgtgacatttacataatatgccaggaagctggccgccccaccctaatcttattaatcaaatgggatctttgcctggccagcgccatgttgctttctccttactgtacacgtggctggcaaagagaaaggaagatgcacctgccatatgaacatgcctagtcccaggtagccttttcctattggcacaactgctggcattcaccttgcaagcttccagcttgcttgtctatgtttgcagttcgattttacaggctcctcttgttagaaaagaaaatgatttgggggctgcctttcattaaaaggaaaaaccttatcaaggactgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacattatagtgtaaatttgcatttcttttaccactaactgggtttagaatatatattcacagtttaattggtatttaatgcttctaatctttggaaatgcagtttgattttctttatttacctttttgagagttttggtattattagttggaatcatcttaacaattctgaatataaaatctcttttaattatacgtaatgcaaatgtattctctttgtggctagtatttttctttccttttttctgcattatgaacataagttgctcattctactacataatagtcaatcttttttcatgatgaatgtttcttgtttctatttaaaggaatacttcaaaaacatagagccactatactattctttattctaaaaagttataagttaccttttcttttcatattttaaaaatattttgtgttgattttattcatgataatggctgtatttcatgtttaaatgaaatatggtaaactcaacatttccctaacaatttttatagtacctttctcaaacagtatattttttattgtatattttgtacattgtgtgtgtatacacacacacaataactattactctgagtattctgcactattagtaaacaattttttaaccagcattgcagtaaccctctattgaattttatttatttattttattttgagatagaatctcactctgtcacccaggctggagtgcaatgtcgcgatctcgcctcgctgcaacctccactccctgaattttaattaatataggtttttaataagtatggatatgacttttcaccctaatcatgacctttcacccaaatctttttgcttcatcagtctcttttttgtctcatcattcagtgtcagatgatcccattacttttatttttttcttcacagattaattgaggctaataatatgccttgattagatatgcaatttctcctgatatcaaacaactcaatcaacgtttatgcctcttggtttgattttggagctgattgtagaatcaactacttattttttctctttctttccttccttccttcctttttctttctttctttttctttttctttctttcttctttctttctttttctttctttctttccttctcttccttctttctttttctttctttcattcttttttctttcttcctttctttgtctacgtttctccttctttttcttttttctctttctttctttctctttcccttcctttctttttctttctttctttctttctctttcccttcctttctttttctttctttctttctttctttctttctttctttctttctttctttctttctttctttctttctttctttctttctctttccttctttctttcttccttccctccctcccttccctccctccctctgtcacctccctccctccctccctccctcccttccttccttccttccttccttccttccttctttccttttgtcccaagtttgtctggctcaagttattcttaagaatgttactattttactcttcatgctagaccctgtactttagtcaggttatttagctactttacggttgtcatataattaacaagtcttagcttcatcttcagattgagatatcaacgttatattttcatgtacagtcaattgtcagtgaatcacattgtttttcaatttaataaaatctaaattcctcataaccatgttgtgagaatatgcagaaaaaattaaacatacttgagtgagtacagtagatatatattggagtgtatcctttatgaatgcaaactggctgtagtttcctttaaaatagtcatttaaataaaaaatttgccagataaatcacagaatatcaatttctcttgacttgtaaaacttgaattactagtgccatctgaatgattcttctgaagatagacagagtagtctctacttacctgtgagagaaaaaagctgcactagtccctcttattcatgtgggatatgttccaggctccccagtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgcatgaattagctctttgtcctgatgctctctctcccctttccccgcacaccccaacaagccccggtgtgtgatgttcccctccctatgtccatgtgttctcattgatcaactctcacttatgagtgagaatatgtggtgttttgttttctgttcctgtgttagtttgctgaagatgatggtttccagcttcgtccatgtccctgcaaaggacacgaactcattcaatttatggctgcatagtattccatggtgtatatgtgccacattttctttatccagtctatcattgatgggcatttgggttggttccaaatctttgctactgcaaatggtgctgtgataaacatatgtgtgcatgtgcctttatagtagaatgatttatattcctttgggtatatacccagtaatgggattgctgggtcaaatggtatctctggttcttgatctttgaggagttgccacactgtcttccactatggttgaactaatttacactcccaccaacagagtaaaactttcctatttctccgcatcctcgccagcacctgtggtttccagatgttttaatgatcggcattctaactggcgtgaattggtttctcattgtggttttgatttgcatttctctaatgaccagtgacaataagcttgttttcatgtatttgctgactgcataaatgtcttcttttgagaagtgtctgttcatatccttcacctactttttgatggggttgtttgtttctttcttataaatttgtttaagttccttgtagattcttgatattagacctctgtcagatggatagattgcaaaaattttctcccattctgtagattgcctattcactctgatgatagtttcttttgctgtgcagaagctctttagtttaattagatcccatttgtcaattttggcctttgttgccattgcttttggtgttttagtcatgaagtctttgcccatgcctatgtcctgaataacctactgcctaggtttttttctatggtttttatggttttaggtcttacatttaagcctttaatacatcatgagttaatttttatattaggtgtaagggaagggtccagtttcagttttctgcatatggctagccaattttccctgcaccatttattcaatagggaatcttttccctattgcttgtttttgtcaggtttgttgaagatcaaatggttgtagatgtgtggtgttatttctgaggcctctgttctgctccattggcctatatatctgttctggtacaagtaccatgttgttttggttactgtagtcttgtagtatagtttgaaatcaggtagcgtgatgcatcagctttgtgctttttgattaggattgtcttggctagatgggacctttttttggtttcatatgaaatttaaagcagttttcttagttctgtgaagaaagataatgatagctagatgggaatagcattgtatgtatcaactactttgggcaatatggccattttcatgatattgattcttcctatccatgaggatggaatatttttctatttattttggccctctcttatttccctgagcagtggtttgtagttctccttgaagagttccttcgcatcccttgtaagttgtatttctacgtattttattttctttgtggcaattgtgaatgggagttcactcatgatttggctttctgtctattactgatgtataggaatgcttgtgatttttgcatattgattttgcatcctgagactttcctgaagttacttatcagcttaaggagtttctgggttgagacagtggggttttctaaatataccatcatgtcatctgcaaaaagagacaatttgacttcctctcttcctatttgaatactccttatttctttctcttgcctgattgtctggtccaaaactcccaatactatgtccatcctagacagatcaacgagacagaaaattaacaaagatattcccaatttgaactcaactctggaccaactggacctaatagacatctacagaactctccaccagaagtcaagtgttcttcttggcactacatagcacttattctaagatcgaccatataattggaagtaaaacactccccagcaaacgcaaaagaacaaaaaccacaacaaacagtctctcagaccacagtgaaatcaaattagaaatcaggattaagaaactcattcaaaactacacaactacatggaaactgaacaacctgctactgaatgactactgagtaaatattgaaagtaaggcagaagtaaataagttccttgaaaccaatgagaagacagacacaatgtaccagaatatctgggacacagttaaagcagtctttagaggaaaatttatcgcactaaatgcccacatcagaaagtgggaaagatctaaacttgacaccctaacacctcaattaaaagaaatagagcttgatggggatggcattgaatctataaattacctttggcagcatgccatccccatcaagctaccaatgactttctttacagaattggaaaaaactactttaaagtttatatggaaccaagaaagagcccgcattgccaagtcaatcctaagacaaaagaacaaagctggaggcatcatgctacctgacttcaaactatactacaagcccacagtaaccaaaatagcatggtactggtaccaaaacagagatgcagaccaatggaacagaacagagccttcagaaataatgctacatatccacaaccatctgatctttgacaaacctgagaaaaacaagaaatgggaaaaggattccttatttaataaatggtgctgggaaaacaggctagccatatgtagaaagctgaaactggatcccttcgttacaccttatactaaaattaattcaagatggattaaagacttaaatgttagatctaaaaccataaaaaccctagaagaaaacctaggcaataccattcaggacataggcatgggcaaggacttcatgtctaaaataccaaaagcaatggcaacacaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcagcatcactggtcattagagaaatgcaaatcaaaaccacaatgagataccatctcacaccagttagaatggcgatcattaaaaagtcaggaaacaacaggtgccggagaggatgtggagaaataggaacacttttacactgttggtggaactgtaaactagttcaaccattgtggaagtcattgtctagatcctcagggatctataactagaaataccatttgacctagccatcccattactgggtatatacacaaaggattataaatcatgctgctataaagacacatgtacacgtatgtttattgcggcactattcacaatagcaaagacttggaaccaacccaaatgtccaacaatgatagactggattaagaaaatgtggcacatatacaccatagaatactatgcagccataaaaaagaagagttcatgtcctttgtagggacatggatgaagctggaaaccatcattctcagcaaactatggcaatgacaaaaaaccaagcatcgcatgctctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaccatggcacatgtatacatatgtaactaacctgcacgtagtgcacatgtaccctaaaacttaaagtataataataataaaaaaagaattagagaagcaagagcaaacaaattcaaaagctagcagaagacaagaaataactaagatcagagcagacctggagatagagacatgaaaacccttcaaaaaatcaatgcacccaggagctggtttttagaaaagattaacaaagtacactactagccatactaataaagaagaaaggacagaagaatcaaatagacacaataaaaatgataaagagggtatcaccactgatcccagagaaatacaaactaccatcagagaatactataaacacctctacacaaataaagtagaaaatctggaagaaatggataaattcctggacacatacacgctcccaacactaaagcagaagaaagaagtcaaaaccctgaataggccaaacacaagttctgaaattgtggtagtaattaatagcctgccaaccaaaaatagcccaggaccagatggatttacagccaaattctaccagaggtactaagaggagttggtaccattcctttggaaactatttcaaacaatagaaaaagaaggtctcctccttaactcattttatggagccagcatcatcctgataccaaaacctggcagagacacaacagaaaaagaaaatttcagtctaatatccctgatgaacatcaatgcgaaaatcctcaataaaatactggcaaagcaaatccagcagcatatctaaaagcttattcaccatgagcaagtcgccattatctctgtgatgcaaggctgtttcaacatatacaaatcaataaatgtaatgacaaaaaacacataattaactcaatagatgcagaaaaggccttcaataaaattcaacaccccttcatggtaaaaacactcaataaactaggtattgatggaacatatctcaaaattataagagctattttttaaaaacccatagcaaatatcatactaaatatgtgttcatttttataagaaatagacaaactgttttcctgagcgatcatacattgtaccttcacatactcagtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttccttgcctaaaccaaggccatatacagttctagaagttaacattttacacttagttatatgagttaatttttgtatgaggtatgaggaatatgtagagggttattattttgcatttggatgcgttactgttccagtatcacttgtttaaaagactatgttttctttattgaattgcctttgctccttttttaaattgaaaacatcctcaaaaaatttttaaaaacagttaaggaggaaaaagtaaaattcaactaggcttgtaggacaatcaatggtaatcattaggctagctttccattgacccacttccttatagctggtcactgattactagtccaggataacataatctttgtcactagaatctttgttctttttctgttctttagttaaaatttaagacaatatgagatgacaaactttccatttgagtttctcctttaggttctgcatactaacaaaactactgatgccagccattctgaaaggcttgacaagaaactcaacttagggaagaatgtactttccatatcctgatgatttcagcccccttacccgaatcaattgatgacctcaattttccagccactcccccttcaaagattcttgcccagaaagcttcagtgaaatgggtttgagtcttgagaattcttctcatgtccttgtttggtgaccttgcaattggtaaactctctgttgcaaactccactgtcttggtatattctgttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaaaaaaaaaaaaagaaaagaaaaaaaaattcatggcaagccactctccttgcagtcatttacctacagtccagtgcccccatgccactggggctgacccagagagaagctcaagaagctgcttagttatgatgaactaagggccttagctggggccttctgtgttggcagggcagtgctgactttcagcacacaaccttgtctgcagcagagaaaccatttctggtctcagaagaagtctcaggtgagttttctcagagcagctggcaccccatttccttctgtgtgtgtgtgcctgttttcgtcttagaggtcttgtggcctctttgaggtcttgttgacactccctaagtctaggtaggaacttatttgaggagatctcccttcagatggaaaaagactagagggcattgcttgggagaaatggtcttggattttggaatctgaaactttatatggaaaggtcttttgtttgtctttgtcttgttatatgtatttatgtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaa

SEQ ID NO: 2430 - DNA, 12459 bp, Homo sapiens
  source 1..12459: mol_type = genomic DNA
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacgggatttttaagaaccatcatcaatttcaaaacccgtgtcctcttagtgttactccaaagaatgttgaatatgaaataagaaactttctttgtcatagttttctatgtttagcatgtattcattcggaaagatatttcttaatcctgatctaccataagcagcaatatttgttaatgttttatgtgttccttcagtaaggagaaaagaacttaaatatattactttcagtttaaaggattaaaatttcttccaggactcatttcttttaccagaaatcacaaaactgttgatattatataaagtgctgtgtttgtatttgccttatttgaacttgtattttgatttgctctcacaataaatcaagtgatgaaatgatgttttttagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatcagtgtgatgagtctgatattttgctgttggtaacaaaataatcacagattattgaacaaccattctgctgaatgcctgcctaccaaaaatttcttttagaaagtaaagtttagaaattttctctttagggctgggtgtggtggctcacacctgtaatcccagcactttgggaggccgaggcgggcagatcacgaggtcaggagattgagaccatcctggctaacatggtgaaaccccgtctctactaaaaatacagaataataataataaccggcatggtgacgggcacctgtagtcccagctagtcgggagtctgaggcaggaaaatggcgggaacccgggaggcggagcttgcagtgagccgagttcgcgccactgcactccagcctgggcgacagagcgagactccgtctcaataaaaacaacacaaaaaagtaatttttctctttatatttatattttattttaaagaatttagttgataaataaaaatatactttcatgtttgacaatatgctgttttgatatatttatgctacaatgattaccacaaattaattagcacattcttcatcacctatgcttagcattgggtgtaggtgggtgtgtgagtatgtgtgtgtgtgtttgtggtgaggacacttaaaatctgctttcttgccaattttcagataaacaatacaatattattagctctaaatatcactagatctctatgtttgattccaagttcttattcatattatagctgaaagtttgtactctttgaccaatatcttaatcaaacaaaagcagcaatgataagttctaaaatgcagggatcctaaaatgacaactgatgtaatgaatcattgataatacacccctaattctcatacattaaacataaaacctcattttcacatcgattaccattttaagtttatttaaatcaatatgatgtttttacatagtcggtttggacagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaa

SEQ ID NO: 2431 - DNA, 15423 bp, Homo sapiens
  source 1..15423: mol_type = genomic DNA
tgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttatctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaatcgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaacggcttcttatgatattttataaatggtcccattttatttcatgttgaaattaaggccaccatatcaaaggaattgcaaacaaaatctctaccaaggtctaggatactaattaaactatgtctgtacttggagtttcgatcattatgctttaccctttgatttccaaaaagtttttactttactgttttgctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcattttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccaccacgcctggctaattttgtatttttagtagagatggggtttctccatgttggtcaggctggtctcgaactcccgacctcaggtgatctgcctgcctcggcctcccacagtgttgggattgcaggcataagccaccacgcctagcccttgaaattcgttttattttgttttcacttttagtgctgagttgtaatcacaggagtgcgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacacgttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagcaaagtacaataaaaatacagtataaaatattaaaaacggcagacttgtatagggcttttaccatgaatagggtgtgtaggactgaaagttgctctcagtaagtcattacatgagtggtgagtgaatgtgatggcttagaacatcaccatacacgactagaggtggtataaacactgtatacttaggctaaactaatttattttatttatttatttacttcaatagttttgggggagcaggtggtttttggttacatggataagttcttcagtgctaattactgagcttttgatgcacccaggatagactaaatttattttaaacttttcttcgataataaattaaccttagtttatgttgacctttttacttcatcaactttaatttttatgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacatattaacctcagcctacaaagggttaggatcatcagtatcactgtcttcttcctccgctcttgtcccactagaagatcttcagggcagtaacaggcatggagctgtcctctcctatgataacaaaggtttcttctggaatagttcctgaaggatctgcctcaggaaacattaaccgttttacagttaatttttttaaccagtagaagaagttaactataaaatactgataacaattatactatatgaaatacattaaccagtaacacttctatattgtcatcatcaagtattatgtactgtacaaaattgtgtgtggcatatttttatgtgactggcaatgctgtaggtttatttacaccggcattgccacaaacatgtgagtaatatattacactgctatgttatgatggctattaggtgataggaatttttcagctacactataatcttatgggtccactgtcacatgagcgatcagtcattgaccaaaatgtcattatgtggtgaatatctgtacaactgtatatatgtatgtgtgtgtgtgtgtgtgtgtgtgtatcccagaagaaatatattcataatattctatcagaatgttgagacaagaaaaattattttctacttttgaagtgggtggttgtgtaaaggaggcttgcaagaagacattaacactcctagctagcaccattgcagatatgcacaatgaatacttgatgaatgtcatagagttaattctgaagcataggtacaatataactgggtgatgaaaaccaagttattctggatagcaaagaatatgtaagtacaaatgtatgaaaataaactactataattttggaggagtgaaggataactaaaagagttatggtaggttaatactatcaagatgggagtctttccctcaatacctttaccaaaactatctaatgtcaaattttaaacagttagataatcagtttcacgtttcacaaagtgaaaatatttcaaatattgtgcaacattaaacattacttctagacagatgaaaaagagaaatttctgttgatttgtcagcttaatttctgcacacatcttccaaataaggtgaaaaataaaattatttcttatgcaacagtactatattgcaacaatatcttgacataaaaacaaagagcagtaatatatgaggaactatcttgagctaaatacatactcaaagataaagtatatcaaacccatggaatgtacaacatcaagagtgaaccccaacataaactatgaactttgggtgataattatattgacggtgagggaggttatgcatgtggtagggaagaggaagtggtatatagaaatctctaccttccactcaattttgctgtgaaaaacttgttaataaaatataaagtcttataaaaatatgtgtgtatatatatgaatgtgtacacaaagaaagagtcaaaaagtatgaagatttcacccattttctacattgttttaatttttcctgcaccatcgtgtatatggatgtatatatacatatatacactagtcctttagtatcctcaaggaattggttccaggactctacccacccccagtagataccaaaatccaaggatatgcaagtctctaagacagaatgatgtagtatttgtatataacctgtgtatatcctcccaaacaatttattttattttattttaattttttttgaggtagagtcttgctctgtcgcccccaggatggtgtttagtggcatgatctcggctcactgcaacatacccctcctgggttcaagtgattcttctgcctcagcctcccaagtagctgggattacaggtgtgcaccaccacacctggctaatttttgtatttttagtagagatgggctttcgccatgttggccaggctggtctcaaactcctgacctcaagtgatccacctacctcagcctcccaaagtgctgggattacaggtatgagctaccacacccaaccctctcatacaatttaaagaatctctagattatttataatacctaatacaatgtaaatgctatacaaatagttgttatattgtatttttaattgcattatttttattgttttattgtctttttattgtttttttccgaatatttttgatctgcagttggttgaatcagaggatgtgaaaccagtggggctgaccgtatatatatgtgtgtatacaagtataaatatataaatacaaatatacaatacatatttgtatatacaacattaaccagaatttagctctaactttatcttgagttgttcttagtgattttcttatattctctcaattatttccactgaaactatattaactttgtaaccagaaagtattcaaaatgatattaataaacaaacaacaaaactaactacccaacatcttttctgcaccagaaaaaaaataggacagagtttctggtggagatacctatgacagtcaatgagaatagagaaaataagtaaattgagagctaagaacaaccctgtcactcctctactgtatactaagtagatcaggaagatttgctagtcttacactctgccttcattcttaaattgttgtgtgagggttttcttcttgaagacattgcaggagagttcatatttcatatcactccaaaatatagattttatattcattaacaattacctcctcaaatactcgtgtactcttagttagtgatgtcttttcattcctaatttggacactggagagcatttaagctaaaggcatttaagctaaatgaaagaaaaaaactaaatgagatgattaaaatatagtctagtgatttatttatgtagcttattatgtaattcttcagttttgtgttattttcccagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagtgagtaaatgccctgttcattaaatggatgtcattcaatgaacagagaaggatatgccagacaagatcataaacacttgataatcacaggagcagtgaccagaggagctggaaagatgggagatgtagtccttctattttgagatggctcctatgagaatcaatgaagaataaatatgtcaactgtcttgcattacccggaaattctctacatgttgaaatatatcaatttttttaaactgatgattaatatatttgactgctaatatttctttactaatattcatttggcagcagcctgatcatagttttccttttaaatgtcattttatacatattctgttttgaatttaacattcttttgcatattacaaggaggtttagcattttcacttttatatttcaataaataatttctttggtccttcaaagtgtagctatattaaccctccaataaatgtagagagcagactccaatgataacaggtatattaaaagagaaaacaactgggagacagatagatgaggcaacaaaggagatagcaatgatctttctcctaagaaacatttatgagagttaagagagaaatagatatatgtagatgttcttttgtccctaaaagagttgataaacataaaatattttattataaaaaacatagagtaacaacatgaaatattttcttctatatgtacatataaaggaaccaaaaatatatttcatcatatatatagtagcaagacttaacttcttttgaaaatgtttatatttgatttcagctttgaaagctttcctttttggttttttgtttgtttgttttgttttgttttgttttgtttttgagacagagtctcattctgtcacccaggctgaagtgcagtggtgccatctcgactcactgctacctctgccttctgggttcaagtgattctcctgtctcagcctccagagtagctggaattacaagtgcacaccactatgcccgctaatttttgtatttttagtagaaacagggtttcaccatgttgaccaggctggcctcgaactcatggcctcaaatgatccactcacctcagcctcccaaagtgcagggattaccagcttgagccacttcaccctatttattaaaatattttaaaatgcagttgtactttttctttgctacttccatcttgtctattaatctgtttttggtctttaggactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactagtaagtgcaatgttgttctctcagatgctgttatattataaagtgtaaaagaaataaatctttttttacagattaaatataggttaaatataggttttgccacatacttctatcattattcatttgattctcagttccaattgtgtctaagtggatgtgcaataatatagtttgcctacctatataaatcaaatatatgtgataagtaaaaatattagacaagaatacaccttgaagataatcccttgaagtttaagtaatacctgtgtgtggtttatagtatcgggttagttgacaagaaatggttacaaaactgatgtattgaagtgaaaataagtccaattctagttaaaatgtcttataagtaagacagcatttaatatttatctttatttaaattcatatgctctattcaataaatcatcaattcttaagttttagaaagtccatacttctgagaggtatgtttatttgtgagtagcttagcatttggaaaacgattcttttggaaacctgtggtataaatgatggcacctcccagtcctgtgtgaactcttgcaattcttcgtctttatagctcctcagtaattgttttttgcccagcccaataagattccgtcctatgcttgcacagctctgtattcaactaaaaacaaaaggagcccgatggaaacttctatagctctttctcttcataccactttctctctgctactatgcccagtaacttctggccaccatagtctccaagactgacattattagtctcaactaaagaagaccattgagttcttgctgggttctccctcacagcacagagtctagaaaaggcctgtcagcaaacagatggggctgtgtgctgtggtagtttggggtttcaagtttttttcattttcttagtcatcacggtcatgtgctgggtgatttccagtgttcttgaaatatattttgtacagttttctaatttttttccagtgggaggttatgttgataccagctattccatccaataggaaatagaatccgtggtatgcctttcaaaagatgttatgttatcaaatattattccacacctttaattcttaattttaaacctctagagcagggcacagtggtgtgtgcctctagtctcagccactggtaagtctgaagtaggaggatcacttgagcccaggtgttcaaggctgcagtgagctatgactgcaccagtgcacttcaacctgggcaacagagtgagaccctgtcttcactaaatttacacttctagaaaattgagtcttcttaaaacagctgaaactgtgacagtttttcagtaaacagttaagtcatagcctctttctattactaggggattaaacattattaatatttgcaaaaaacaaaaaaaaagaacaaatgttatgaataccagaaaattgcagtgattgaatagggtttaggatttatagccttcagtgatggcataaatatttccatgctctatgtcatgaacaagctctcttcatttcgtgggatgatggctattgtcagcccaacaattataatttagaagcttgacaaattaagtttgaccagctgtatcccatacaagctggctcttgtgtacagtctgtaagactttgttaggctttgattaagtctgttgctttgtgacacaaaaaatatcccgggtttaattcatgttttccctgtctgagaactagaatcaaccatacctccaataagttctggttccattcagtgggtaatgacatttagaaactaagttgccaaaataaacttgcttcaaaacttagcacattttatttaagctgacaaagaacacatctttttgttcaagttctcacaatattgctacctttccctctttgcctgtcccttattccaaaagcataaggcaacatattgaggttatcagagtagatggaggaagtcagaatctccaaagtggaagaatttagcggaacactctatgtccaaggttgaatggtagctcaagaacgctgtggagagttaataaagtttcagggcaactagactcctaatgatagctgcacagtctgttttttcatgtaaggtaacattttgcaagttatggtaatccatgttgcagggattagtacagtgcaatctctgggggctgttattccgtttacaacaccatgcaataaccttatatgaataaagcagctgggaaaccctacatcagccaagattatttatttatttatttatttatttatttacttacttatttacttatttattttttgagacagagtctcactgtgttgcccaggctggagtacaatggtgggatcttggctccctgcaaattctaccttcaaagttcaagcaattcttgtgcctcagcctcctgagtagttgggattacaggcatgtgtcaccacacccagctaatttttgtattcttagtagagccagggtttcaccaaattggccaggctggtctccaactcccaacctcaggcgatccaccaaccttggtatcccaaagtgctgacgtaacagtcatgagccactgtacccagacagatcaattgttttcaatggcattttgtttttacaattagattttttaaaagatgataatcaataaagaattgccatccaaatattggaataaaatacagagatttagggatacaagttttatataagtgaaatgagtcatattctagtgggatttgcttgagtaaactgcaatcaaaccattaaagtgcctataacagtacataaaactagttactttaaatatttatgagattattagaaaatatttcaattttttgtgtatacttgatttatttggattatttactttgtcttgaatgtcaattatgtagtttacataagaattaatatatacttttatgaactaaccattaatgaaagatgattaaataagaaaaataaacacatattcatatacataactatttctaattgaatcagaagatattcataatgagttagtttttataaacatactagtgatggagttgagaataatggaaaggttcaaaaaacctagaagatgggttttttaaaaagtctttgatatttagttacccatttggtaaaattgggaataatttgctttataatttccctccaactttctgcccatatgggcgaaattggccaaaagaaaggggctacagtccccacacaagttcaaaacccagcagggcactccttaaatcttaaatctccataaaaggtctcatttgactcctcgtctcacatccaggacacactgatgcaaggggtaggcttccaaggccttgggtagctccacttctgtggctttgcagggttcagcccccagggctgctctcatgggctagcattgagtgcctgcagcctttccaggtgcatagtacaagctgttggtgtatctaccattctgtggtctggaggagagtagccccctactcatagctccactaggcagtgcctcagtggtgactctgtgtgggggttccaaccctacatttcccttccactctgccctagcagaggttctccatgaacctgcagactccacccctgcagacttctgcctgaacatgcagaagtttccatacaacctcagaaatccaggaagaggttcccacctggaaccaaaaaaaaacctcaaatcttgtcttctgtgcacccacaggcacaacaccatgtggaagctgccaaagttcgaggtttgcaccttctgaaaaaatgacctgagctatatgttggccccatttagccacggctggagctggagcagctaggactcagcagggtaccaggtcgtgaggctgcacacagcagcagggcccaggcccatgaaaatatttttccctgctaggcctttgggcctgtgattgggaaagcctcaaagatctctgacatgtcctggagtcattttccccattgtcttaggctattaacatttggcttcttgtaacttatgcaaatttctgcagcaggattgaattactccccagaatatgagttttctcttctaccacatggtcaggcagcaaattttgcaaacttttatactctgtcactcttgaacattttgctgcttagaaatttcctactccagttaccctaaatcatctctctcaacttcaaagttccacacatcttcagggcaggggcaaattgacactagtctctttgctacagcatagcaagagtgacctttgctccagttcctaataagtttctcatctccatctaagaccgcttcagcctggacttcattgtccatatctctataagcattttggtcaaaaccattgaacaagtctcaagggggttccaaactttccctcatcttcctatcttcttctgagccccctaagctgttccaacctctgcctgttacccagttccaaagtcacttccacattttcaggtatctttatagcagtgccccctgtaccaatctactgtattagtccactgtcacactgctataaagaacttctccaacctgggtaatatatcagtaaaataggtttggccagacatggtggctcacacctgtaatcctagcactttgggagacaggggcaggtgaatcacttgaggtcaggaatttgggactagcctgacccacatcgtgaaactctgtctttgataaaatataaaaattagctgggcatggtggtgactcctgtaatctcggctatttgggaggctgaggcaggagaatcacttgagctggggaagcagaggctgcagtgagccgagatagtgccactgtactgcagtctgggtgacagagcgagactctgtctcaaaaaaataataataataaataaataaaataggtttaattgactcacagttccacatggctgtggcttcagaaaacttacaataatggcagaagcgggggcaggcacttcttcacaaggcagcaggagagagacaagtggatgaaggaggaacttccaaacacttataaaaccatcagatctcatgtgaactcactcactatcatgagaacagcatgggggaagccatccccatgatccaaccaccccccaccaggtctctgcctcaatatctggggattacaattcaagataagatgtgaatggtgtgagtggagacacaaagcctaactatatcaggtggcaagtatgtgcaataaatgatgtgaatgcaaaacagagcaatctcaagtgctccagctaccaatatctcctcagtcttctgatatcattcccttcttgtatttttgatagatttggaatagtttaatgtaattaagtcaaaatagatgtatattttttcaagttatgagaaaaatattgtatagtattcgttagttctacatgtcactattagtttatgccttatggtcagtctgggaagtgttcagtcatttttttgttttcagctcaatactttttctcttctctttctggattgcctctccttatttgttgttgtttgtcttattctaaagttctctaagctcagttcagctttctgttttcagtctattttcagactgggtaattaatattgctctgtattgaagttcatgaatttattcatctgtcatctcccagtgtgttattaagcctatccagaggatttttttaattattgttttactatttgggtttataattcctattggattttttaaagcatcatcaatttcaacatctgtgtcttcttagtgttgtcttttgttattaataattgtcttttcccttttgagagtttcctggtccttaatatgaagagtaatttttaaatttattctagatattttaggtgttatattttgagtactcgattgcaaaaatcttatttggcaggttccattgctgccatggtgggtataagcccaggtttcccatttggcttctgctgacatcaatcatgggaaaagggagcggtgtcttgttacttgaccatgtgggtagaagtctaggttcctcagttgacctctgtttatctagaagtgtggagggtggtcattggcttcttaggatctttcctacagtatgtaagttattgttaaaaatgatttttgtcttgtaaggctgctcttttcctgggcttttgggtatagaaagtaggctcttctggggattttctttttctgtctgaacctcatatcaatactgggttgcagtcttctccagtgtcctatccaggatacaaaggagtccaaaagaaaacccacatgacaccctgctgtgtcattccttgagtcctgaagtctccagcaacttcaaattctctacatctttcagagtctttttatgttcttttcctttttttttttttttactttgtgttcaaaatttgagttgtacttagcataaggaaaaggtagaaaagtttgttcctcattttgccaataccaagaatccagcaattcccttttagtttctattaatttgtattctttaaatttttccaggagttaatgtttcttttgtaaggcaaatgaaaataaagaatgaaatgactacagacccaataaactccaaagaatgttgaatttaaaataagaaactttctgtgttttgtcatagctttctatctgtttagcatgtattcatttagaaaaacatttcttaatcctggaatactacaaagtgtcatctttgttaatgctgtatgtgttcattcagtgaggagaaaagaactgaaaatttaactttcagtttgtaggataaattttactccgggaatcatttcattcagcacaaatcacaaaagccctgatagactataaagtgccttgtttgcatttgccttatttgaacttgtatttttatttactctcccagtaaatcaaatgatgtttttttagtttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttaggtaagtactttaatattctcatggattctggaaaaatcagtgtgatgagtctgatatttcactgtttgtaatagaattttcacagattaacaaacaagcattctgctgaatgcttgcctaccaaatgtctatatgatagaatgtaaagtttagaaatttttctctttatatttatattttatttaaaaacatttagttgataaataaaaagaatacatatttattttctacaacatgttgatttgatatatttataaagcaatgattactataaattaattaacacattcatcaccacctatggttaccattgtgtgtaagtgtgtgtgtgtgtgtgtgtgtgagagagagagagagagagagatgaggactcttaaaatctgctctcttttcaaatttcaagtaaataataccatattattagctattaatgtcattacatttctctatttgattcccagttcttgttcatcttattactgaaagtttggattctttcaccaatatcataatcaaacaaaaacagcaatgataggttctaaaatgcaactatcttaatatgacaattgatgttatgaatcttcagtgataacatctaattatcatccattaaacatagtacctcatttttacatcatttaccattttaaatttacttaaatctatattttgtttttacagcattagtttggaaaggattttgagaagtaattcctcaaccatcatataacattctacttgaaaacctgagtctatgaagatttgcatactacttaatgttttatgttcatttttttctactttcagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtgaaaatgcaattacaa

SEQ ID NO: 2432 - DNA, 19274 bp, Homo sapiens
  source 1..19274: mol_type = genomic DNA
acacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgt

SEQ ID NO: 2433 - DNA, 19274 bp, Homo sapiens; identical to SEQ ID NO: 2432
  source 1..19274: mol_type = genomic DNA

SEQ ID NO: 2434 - DNA, 30700 bp, Homo sapiens
  source 1..30700: mol_type = genomic DNA
aagtgaccttaaagccctagctttgtggtagtgcacttaaattcagaatcacacttggtaactaataatgaaagatttcaaaccccaaacagtgcaactgaaacttttgcattactatactactgagaatatctaacatgttgttactaatcaatgtcattctgaccttgtgggtttcctgtgctaatggacaaggtaagttgaaagagatctaaacactcagcttccctcttaaatgtaacttcgtgtaatatctaacttcatatgtctataatttttttataaatctgataggatatattcactatgctagcagaagtagcatattttgtgagagtataacagaaattaattttatgaaaaaatatctcataatttaaagaaaaaatgaataatattttctttgttttacaaattctacagtgtaaaaagcatctaatattcattatggagatatatgaatatactcataaaactttaagtaggaaacatgtcattagatagattctaaccttaaaatgttcagaattttcttattcataatacaagggaaactttgggagtgattgatactttcataatcttacatacagtgattttttattgattcatatatcaaaacagcaaataaaatattttaaattatgccatttcttatatttctattataccttaagaaagctgctacatctaattaacattaatatgaatttaatatttcaacaagattagcaatatgtaaatcacaacatatatgtaatcaaaaagcagaatatatacttaacttacattggaatgacagtaaattttaatttgcatttctgagttcactagcaaatgttcaataaataaatacataaataattttcatagctttatgtcattgttctctgatatgttttctcctcgatagtcatgtattttctatattaactatctctttgaatgcaggccttgcatattaaagaactatattgtatgtaacattagcagtggaaccacatgggtcaaaaatcatggacaatcaaaggtgtgtcaccattaatgaagaaaacaaattttataattatccaaaactttataatattccaacaaatgtaatggaggataatattggaaatcccactatcaattattgagagtatcttttccctcagcctctcctctcaaagctatgccactttatttgattctaagtaaacagctttaggttttacagtattatctatcacatgattcgctagttttaattgctgtgcaaaatcaaccttgatttgtgccaaaatgaaaaaaaaggaatttctcttgttattccctttgttaactaaactgctacaggcacattttttaaaataaggattacatagattaaagtagaatgcaaagcagaaaaatagagaaaaacagtactattttgaaatgactgaaattagattagaataagctctactttcttagttactttctcaaaagcagtataagaaaagaatgctgacaaattctttcttatttgatattccagttgaaaacttttctcctccaatgaactctttgtaagagtaaacttgagaaaaatgtcttgtaaatttgggtcacacctatatttctcaaaggagaaagtaactcatttagtggaataacatcttgggtagtgagaaacatctttgtgaattcagtagcattggctcaactgcatccctccaaaatttatttgtaaaagtccaaattcccaatacctgagaatgtgactgcatttgaagaaggagagcttaaagatgtaattaagttaaaggtcaatgattcaggtgggacctactccaatataactggtgtcaataagaagagaaaataaggacacaccatatagagaaagaccacgtaaggcatagagagaatacaaccatttacaaggcaaaggaagaggcctcagaagaatgcagccctgttgacagccacatctcaaagtattagcctccagaactgtaagaaaataaatttctatgaaatctgtggtactttcttatggtagcactagaagataaatacaatgattttacacaatttattaaaagaatattaacttaaaataattttttactctttactcatggatacgtatatacccaccatacatattttagagggtatttatcagaatttgataattatatcttggctgtattgtcttcgctgagttttgtctagttgaatactttatgtttatatatacctgtattcatatctattcagaatctggcaaagcaaacctgagaaatatttttcatatgattaatgaaggacatactttgtgagttgcctatgctaagaaactttgtttttaatggtagttgatgtttcagttctgaataataattcttttggaagccacgctatttgaaagataaacttgacagaaaattagtaattgtaacctattataatgttcattgaatttgtattgagcattatttcttccatcaacttgtaagttatttacatttaatttaaaataggttgtcaggaaaattattttaattatgaatatccttttaaaattgtataaatatttcattcatctattagagttgccataacaaagtatcaaaggtgacaattagtattttagagcaggattgcttctaaatctctttcaaactagatcattttcaatacccagtgcattacactctgttgccattgtacttctttgggatgctcaaattagtttcaaatctcactaagaagctggtttctgtgtgtatttcacgtgcccccattaagctttcgcataacaaaaggttccaggctttccttgacttttcctactacacacccagttctaataacttctctatgaaactccagtgccttctagtgggagaaacgatttttagaaatgaacctaaactatgaaaacctcacttcaggttcgaaaatgtcgtttattaagaaaaagaatttttggccagtcatggtggctgtaatcccagcaatttggaggccaagtcggggagatcacttgaggccaggagtttgggaccagcctggccaacatggtgaaacactgtctctactaaaaattcaaaaaattagccaggtgtggtggcaaacacgtgtaatttcagctactcaggagcctgaggcaggagaatcacttgaacccgggaggtggaggttgcagtgagccaagatcactctactgaactccagccttggcgacagagcaagactgtctcaataaataaataagtaaataaaatgatttcctttagtttacgtctctttcttccttggactaaatatcctgcaatcataagaaaatgtaagagtatctcaggatgttacacagagcagggatggttagattttccaatacggaggagacactcagcaaaaaactgtgcatccgtgcttgacggactgggtcagagaagctgtcatgcgtcacccaacaagcctctggagccagttctgtaactagcaaacgcctcccagaaagtaaagatgtcacttctctgaacttagtcttctcatctacacactaaagctgttgtgtcactagcctccttccagttctctctgatttatgatgattcaaacttaatttttctttagttatattcttaagatttcataacaaatagaacgtaaatattaatttctctcatgtttcagaattataaagaacttgatataaagaaacttgtttcaaaattataaagaaacataaattatttgctatttaaattgtggtagtgttcaatgttctctttgtatatacatatacatatataaatatacatatagaatgtatgaatatatatgtatattcgtgtgtggacctatatttttatatcaataatatgtctcacctgatacatgaattctaactatggtaagaatgtatgccatctaatacaaacaaaatgccacaaaactcaacaaaatgttttatttctggagataatttgctacatttcagattttttcttatgttatagtaatatttcttttctctattttccaaaaaacaattattgctaatgtgtgcacctgaactgacagctttagcataacttggtatagttttagataagctgagtttaaattaacgctgataaaatttccagaattgccgaagagaccatactacgtaggagaagtggataaagtggaatgaggttcttcttgtcttgttagctgatttgggagccactaaggattttaagtggagcaataaaatgaccagatgaaggatcactaatttatacacaggaaaatagattataaagatgagaggtcaggatcaggaaattagttatggttgctgtaatcccagaagaaaatggttgagagaagatgatatcaaagattattggcagggtttttttgtgcctgttgtgtttgtttgtttctttgttttgatagaaaaattgagtgaaagggaacaccacaaatgcagaagttcagttaattttgagagaggtaatgagaatgattaacatgaatttcccccaaaaaaagttctgtcaataattaccatattatgaataaatagggcatgggttatttttgcagctgactcagagaaaatagctatcacagcaaacctatgtctatattgaaattcatatatacatttaaagaatattattctataccatttatctcaagagaactaatcttcaaaggaaataaaatcagcaacatatttttaattaaaattttaacttctttcaaaaatgcctttattatttatctgttaagaacagataaatcattcatgaagcattcaagtcaaaaagaatttttatttttttgttggcagatttacctagtggaaacaacatgtgtatttagctttaaaaagaaaattccattaatatcagatgaggaaacattcaactaacaatgcagttaagtggaagaaaatgaagagtttcattaataaccctaatattaatggacaatggtggtactgagaggaacatctatctcttttaggcttcataaggaaatggtgtttttcagtgtcaacaaattaatctccactgcgtggttcacccaccaaatagcatatctgtaataatatattgtacttagtctaccacgttttaaaatgattggtttcaaactatcacagcatagaagacaatatatagatagttgaagagttaaagaaattgtagcgtaagaagcatgcaaaaagatagagttatagcgttataatgactgtcttgagatatttcaaaacacttacgaaggggagcaagttagcttttgatgaggactgtcacagtcagtgaagcaggtaacagtattatccaacatcgaatcagaggtcgagtgactttctaaaagggtgacctttacagatattgccatatgttgctgggatgggggttggtggtagaagagttgatctattctgagccttccacattttaagtggtatgattcaaaattacacatacaaactttgttttaattatactctattttaaaaactgcaattatcttttgagttgattttataatttatttttcttttaatttttgacttaagctcacaagcagttccttggaaaatatatttcactacacaattgagcgatcttcacttataagcactgttaagaaaatatgttagaaagaggttaatgaacacaagaaaatgataacccacattagatttatgtttggctgatggtatgtgtaataccattgtttgtcttcagatgtaaaagatttaccaacacaagaagcagatttgcttgttatttgggaataactgtattcccaaatctcagtagcttaataaaccaaagtttatgtcttgttcacactttgttttcaatgtagcttagaagggaattttgtttattacatgaattctaagactcaggtgacacagacctaatctctctatgtgcttccatgataactcttaacagctgggaagataacacaaaaatttctccaatggtttcttaaaattcctccgaagctgaatattaactctcatttacacctattatatattacaacactctcagttaaattgcacctgcttaacttcgctaatatagaaaaactgctctatccccccttttccgttgttaatgtcacagaatttcatctttacacatcatgtgcccaaaacttaataattcacttaaatgcattggtttcctaaattatgtagaaaatgaaatatggagttttaaaccaaagttacaacaataaaagcttttaggttaataattgtttttctaaacttcactggtctcttaaatcatatagaaaaacaaaaaatggagacaaaaaccattgttaccataatgctagcctttttaaattgcccatgtatttacctttattgaggtcattatttcttcctgcaatgtccagttactgtctagtattatttcactttacccttcaggactctattagacatttcttgaaaggcaagtctagtggtctcaaactccctcagcttttgtttatctgggaatgaattaatttctccttcacttttgaaggacacttttgacagatatgggattcttagttgaaagacgttttttttcttttagcgttttgaacatattggcccaatgcctctggcctataaacttctgatgagaaatctgctaataatctgactaagaaatacttacctgtgagaaattgcttctctcttgctgcatacaagactctctctgtgtctttgctatttaaaaatttgattatgaccaagtatagtggctcattcctgtaacgccagcactttggaagactgaatggggagagttgcttgaggccagaagtttgaggtcagcctggcaagcatggcaaaaccctgtctctaaaaacaacaacaacaacaacaaattattcaggtatggtgaaatgcacctgtagtcccagctactcaagaggctgaagtggaaggatcacttgagcccaggaggtcgaggctacagtaaggtgtgatcacatcattgcattctggcctgggtgccagagcatgaccctgtcaaaaaaaattatattaaagaaaaaagttagcctgatatagtagagcatgcctgtagtccttacaattcaagagactgaggcaggaggattgctttagactaggaatttgagattgcagtgagctatgatcacaccactgcactcctccctgggtgacagagcaagaccctatcactacaaattaaaaaacttaattaaattaaagtttgattataatgtatcttgatatctatctctttgagttaatctcattaagttcattaagtttattgagggtctctattaatgccattatttcttcaaacattctctattcatctttctcttctccttccgaaatccactttgtgtgtgttggtctgcttcctggtgtcccatgttccttagattcttttcactttatactttaatttctttttctgttattcagattcaataattttggtttttctaaaattgttaattctttcatctgcctgctctactatgcctctgaatctcttttttgatttttttccttttaattattgtactttcagaatttctttttgtttccttttcaggctttctatccctttattcatatttccattttgatcatacatcattttctttcttcacatctttctttacttctttcagtatctttaatacagttattttaaagtttctaatagacctaccatcagagctttttcagggaaactttcagtttattttttttcttttaataggccatactttcctatttctttgtatgacataatttttttgttgaaaactgaacattttagtctaataatgggtaacaactggaatcagattctcctccttctacatgtttgttgaggggcttcctgcattgttttcatttattgtttttgtctgaatgttgtaggctatgtctgtgtcacaaattagccggtagtatagactttaggttgtctccagtgttttccaagcctgcactttttgctaagtgttcatagtcattttctaattttccccattcatgcagttgctttggaacatcctagtgtttagtgtctggctgccaaaatattctttttgtggaaaactgaactttttaatctaataatgggtaacaatgggaatcagattctcctccttctacatgtttgttgaggggcttcctgcattgttttcatttattgtttttgtctgaatatagtaggctatgtctgtgtcaagaattagcctgtagcatagactttaggttgtctccagtgttttccaagcctgcactttttgctaagtgttcatagtcattttctaattttccccattcatgcggttgctttggaatatcctagtgtatctccccttggacaaattcacatcagccaaggggaggggcttgcaacaatggagaaagccgaaaaacaatggccgcctatctttctgtctgcatctctgtgatcaaagaacccagcaatcagagcacaaatctcaaatatttgaagaatcgagttgttttcgacactctggctccccgctgctatgtgcaggttgctccataaatacacatacagctgcctgccatgtggctaaggagcgtggtatgaacatatgacactgtgctaggagctaaaattgactgaatgtgagtgcaacttacgatccaagtcatccctagaagttgtagggcttcaatagactccaaaaatagtacaatcagacaaattctggccatgcaactgtaaaggtgaggagtcagattccaggtgtttcctcctccgccatcttcccagatttctttttctatatttcttagattgctttcagtaaatagaataacaagctaatgaatttaatcttttttattattattattatactttaagttctagggtacatgtgcacaacgtgcaggtttgttacatatgtataaatacgctgtgttggtttgctgcactcatcatttacattaggtatcaaacataaacactactagctccctccattgagtcgttctgagaagaaaaggcagggctctgaattccgatggaagggaacagaaagaaaaaaagaaaaggactgaactggtgaaagcacctttgtctttcaatcaagatgaaatgggggagttccctgattcccctcgcaggacgtgcgagaggggtgttatctgctttgtcgccccgcagctcaaacccctaggggcagcttgcagacgggcaggtgcagaggccggcatgagtgcttttgagctctggccccacggcagcgtctagggtaggcgtctgtgagtacagacgcccaagtggacgcgtgttacaaaactcagatttgctgtctgcagacggcttgtgtgttaatccgctcaatggaccctctgccttatctcaagagcctggggccagtgtgacagacttctgtatcctgagctcttgcccagtggtcctaaagaattggatcacatgcgggctcaaaggatgactgcaaggttttattgagtgatggcggtggttctcagcaagttggatagggagcccgaagtgggggatggagtgggaaggtggtcttcccctggagttaggccacccagcggccagatttttctccgacctcccctagcggaactcatttccctcggcatccagacattcctgctcttctctctttctctgctgccttgttccgctgtgattgttcagccgcgtatgtgtgcccgctaaggtgttgggtttatatgggggctggatgaggagcatggagggccaaaaggcaacattttggacaggaaaacagacatgcctgtcctcatttagggtcggggtggggcctttgacagggaatcgccctcttctaaccagtatttgcctgtctcctttccgtatcaaagactctcactaaatcaaccagagctaagatatgtgtactcaaggagaaaagctgaaagacttctgtgtggaatacatggatggttaacactgtaagtccttactcaggccttccttatttgcatttttactgtgtttctagcaagaatgtactttattttaatgggtagtgatttctacatagtccacacagccgttttcttttcagaaaaaaaaaaatgtaatcctccttatattcaaaatgatgtctacacacctgaaaagacaaaacacagaattgaagatttaatcatatgtgagtttatagatggcttttatcctacaacccagggaaacagggcaaatgcactagtagtgggtgggtacctacgtgctccaggatgtagcagtaagttccagtccatatactgacttacatttaaaatctgaaattactttctcttaaacacaaaaaaaggggagacaataaatttcaatattttagtatatggagttttgagaagtctttgctttccaaagtagataattctaagtagaatttaaaacaattattgtaaactaaaattctctttaatgtttgctactcagaattatacagatggatgtgtgtatatgaatagatatttctctattcttccaatgtccaaaataatacactgggtgagactagcaccctctaaagcctagtatattagttatgtatggttgtgaaacatattttgctaaaaacatatttgcttaaaacaataaacctttattttctcacagattttgtgggtcaggcatttgggagtgactttactgtttagttctgtgtcagatgctctcctgtgtcgttgccaaggatgttggcctgggctgcagtgacctgacaacttggctgggctgcaggatctgcttccaacatggctcactcacacagattttggtaggaggtcccagtaccttaccacattgtcccctccacaggttgcttgaatggcaactacatttctccagagctaaagattcaagacagagagagtgaggagtaggaggaagccttcatgtcatttatcacctagtcacacactctcacctgagccatatttattcttcagaaatgagtcactaagtccagcacacaacaagtggaggagaattaggctccactattttgaggaaggagtattgaagaatttgtggaatttccacaatcatcaaatgtagcaaaatgtctctcacgtcaatagggtgttttatttctatgatggttcctttgcctttttcaagattttttctgtctctacaaacatattcttttttttttctatcttgcagtgcattgtaaaggtgaaccatacttaaagtggatagtccatgacagaaaaatgttctttcctcttctttttaaaacaaggtcttcctctgttgcccaggctggagtgcagcagcgcagtatacgtcgctgcaatcttgacctccttggctcaaatgatcttcccactgcaacctcctaagcagttgggaatataggcatgtgccaccatgcccagttacttttttatttttattctgtagacacaaggtcttgctgtgatgcttaggctgatctcaaactgggcctcaagcagtcctcccaccttggcctcccaaggtgttcggattatcgtgcccaaacccagatgaattgtcaaaagcatgagttcttaagaaaggtagctattgtaactgtgaaaccaatttcactgtgcataaaaactataaggtaaataaataattattctatagttggcttatgaaaatgctagatcagcccaaatgcttctggaccaactgaatgccagctatatctggttttctgcaaaagtatttcgcaagtgaccttctgaaatttgtgtggaaaagatggagaaattgactggtttgatgatttatcaagtagtttgcagttttattaaatgttttacctgattatcagatacagcattttattctcaggcttcattactcttttgtgtctgcccatagtttaacggtttaggagaaatgcagtataaattcacaaatgaaatgctacagcagatggtgacagtgaatctgcattagtatagattcataattccagaagaatcctacgtgcaaagctaaatctaaaaaaattaaatttagtagtggtaactgtaagatcctggtcttgggtcaaaggaatcagcagtactagtacaaacagattagcaaccactataaaaattagtgagtattttaatcaacgttaaggtcagtttgagttaacattgtgatagaaccatcataactgcttgtgagtctacaattcacatggtagaagactaagaaatagaatgaggctgctctaagttctgctgacttcagtgccaatcagatcataggtggaattttttttttttttttttgctttagagaactaccatatgagaaagataaaaatggtttaaattttctcagtaaaaaagaaaagtcatgaagtggctcaagcttgtggtattaatgataatgatagctacttttaattatacttcctttttgattttttgaaaagaaatctcagcagactatgttatttacattctatgaaacaccatcatgagatagataactatacttgttctgaaatcagaaaactaaagtttaaatctctgctctaccacttaatggaaattttaattgagttttttaaggctcacttcctgcaaatccaaagactcaagcttgtccaaggtggaattagtgttaaatgatctatgttgaagtatcataatgtatcatgatgaaatttgcaaagttcaaaggtaaagagaaaataatacaaatatccaaacagtggtcggggggaaacaacagaatgtaacatagaaggaatgaaactaaatgaggcattttaagctcaactttggaagttcaaaaaatggggggcaaaatctatcaacaatgagagatatggatataggccaagaaactatacaaagacaagttattgttcccaggtctttgttaaagacatttacaacatgcaaggattcaaagttataatcggcataactaatctgtagaaaccggttgaaaaatttttctaatcaaacaaaaagaaatagattgatgaacgccagatgtgttaaagacaaattattcatctgacacttgttaatatgacaagacagattttatttgactattgcaataggggaaagaagtcttgagctaagcttcaaaaacagcacagctgaggatttataccctaaaatcagagtaattaagatgctatttataagcaatgaaactgaatgaatatttgaacttccacattggaagtttcaaaaatgtggcaaaaaaaaaatggtgaagagaaatatggactgtaggccaagaatctatacctagagaagttactcacgtatcttttaaatgaagatacttaagagatgcaagaattcaacatttataatccacaaaacaagactgtagaaactgcctgaaaatctcgctaatgaaaaaataagaaagaaagacaataaaccagtggactaaagaataatggagataataaacaatattgtgcgtgtgtgtgtggtgcatatgttggaattttttataatgtgtagtataaggtttcttgaacaatgatcatatttcatagaaaaaatgaatattcttctggtattacaagtagtaaattatctccgaatcatcccatggaaatggaaactttttttggaaatatcaagtataagccttataataacatagtgcttaaacatatatgtcaaatattcaatatacacaaattcctcaataaactgtaaatatactgtaaaaaatattgtatataaaacattaaaaacatcttattttctaatcaaaattaaaaattaataaaaatgcttattacactcttagatatttagatattaagaaatattcctagttcattttcctggttaaataaaggatagaaatcttgtcttaataactggtttgagacatgaattagcaatattattttgttgtgtgatgtgatcaatgagaaattcctgtttctctgtagtttttacattccttccagtcaattttttaaaatcctcaaaaaactactatctcccactctagagttggtctgagaagaacaggcagggctctgatttctgatgggatggaacagaaagaaaaagaagacagatgagctgaatggtaaaataagcgccttcatctctcaaccaggaagctcactaatcaaccagggctacgatatatgtactcatggagggtacattaaataggtctgcacagttttcttcaatcttcattagcaaacagctcttcacatatctaggtcattggatttctgtaacttttcttgccctaaaacccctaattcattacactaagaagagaatataatttattgatcaaaaatgtcatatatgattatctgttatagaaaaacattatttatactgttttttgttttttattacaagaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcattgcacacaagatggttggtcaccaacggtcccatgcctcagtaagtaaacctctttacaagaatatgtgcataaaacttgaaaagagtgagagaacagcaaataaatgattatattgtcttatataacagaaataggaccaaaggaagagttgttcaagcaaaaagaccaaaatggatcttttttgttatgagatcttcgtgaaaattacatgagaaataaatgtggcaactttatgagaataccgatataatttaaacatattttatcataaaaactaaggttaagtaacattgaatactgacttttttgtaaaaacatttagtagtagctttagtttttcttgagtcatacatcattttcagtattgatgcagtcttatttaaatgttccaaaaattattttaatatactattttgatcaaattcatgtctctaatttacctttaaatcattttatggtccttaggacaatgtattttcaattatttggagaatggatataataaaaaatatggaagaacgtatttacagctggtctcctcctcccagatgcattcgtgtcagttagtgcactcatttgagatcccagtatgtccgtaactgtctaagatctagatatttaactggaaaattttgtacatcaactctgaagccgaatttatgtctttttattttaaaacagaagcctatctagtttccagttccaaatgtgtctgaatacatttaaaatttctggataattagtggattctgtcacttaatagggccaagcagcaatagaaatataagtcaggggccaggcgcagtggctcagtcctgtaatcccaggactgtgggagaccgagacgggcagatcactttaggtgaggagttcaagaccagcctggtcaacatggtgaaaccctgtctctactaaaaatacaaaaattagccgtgtgcagtggcacatgcctgtaatcccagctacccaggaggctgaggctggagaatggcttgaaccagggaggcggaggttgcagtgagctgagattagaccactgcactccagactcggtgatagagcaagactctgtctcaagaaaagaaaaaaacacatatatatatatatgtatatatatacacacacacacatatgtcatgaagatcacaaaatacactaaatacacattaaagtaacactgcttcagtatttatatcaaagtgaatgcattgatttaagtagattataaaattatagcattaattaacaatgcttgcccaaaggtcacttgtacatctctcacaattatatgacatctattcttatagctaatgctcatgctctgtcgctttaaatgaagacacattcagttatagctgactttcactttttaggtaaaggggtctctgaaagttgtttgtgtgtattgtttgcaatttacaaaacattccattatagaaactatatgataattaggatacaatagagataaaggacaatggtaatcttcttacacattcatagaagcactgccctcaacaacagcctaagcctctggaagggaagtcccttttgctcctgccataggcaccaactctgtcattaatccacttaacaaatattgttgtgtgtcaagtgcctttataggtatcgaaaataaaattgtttacgagagaaactgaatactgtagtttagagactggaggagattaatcgaaaagttgacaagaatagatcagaaaactcatgattatgacaaatgctttattataaacatgtatcatctttaacatgatttattttcctttcagatagtaaaattggtccatttacatttttttctaattactaaccaaaaaagaacatacacattattaataagttagaacatacgcattactaaaataattactaccttatacatatacccattagtaatgtatagaacacatacattgataatatataaagaacatatacattactaatatattagaacttatttttgctatcttgtttgttttttcctgcttacatttccacatttctctcaaacaccatggctatatgggtttaagcatccacttaagatgacaactattttaaattcctggagacaaaagatttacaaatttatttccttgcctgtggtagcagtgtgtactgtatctttgcctgggaaatggcatttgactaaatgaagtctaagacctcttaatagcaccagaaaggttcaggttattgcaaagtagccagaaactcttccaaataattatagggaattgagagtctgctagatctgcattcctcaaggcctgccagagctctgttgacagtctcaaagattctttgcttttattctgcccttccctgtgttttcactattttctttcaaaattcacagatgtctaggaaacttccagttttgctgttttcaattcattaacagatgtttcattgtttcaccatactgccatgtttttacttgttcccttctataaaagaagtattcaacaaatatttacttttttctctactttttctattttaggaacatgctcaaaatcagatgtagaaattgaaaatggattcatttctgaatcttcctctatttatattttaaatgaagaaacacaatataattgtaaaccaggatatgcaacagcagagggaaattcttcaggatcaattacatgtttgcaaaatggatggtcaacacaaccaatttgcattagtaagttatttacatattcccactcagtttctgtcaacttctttcctctctttgaggtgatagtgttttacagaaaaagatagaaaacacttttaggagtaaagagatataaatacttctaacatcatctaacattctgtgccaaactaagtcttttttgcctttttagagtaatggctacttgggaagatgatcattccatctctctcaattcaatttgcctttacgtaaaagcaatcccatcaggtacagactagttagggagctgcatgggaatatcagcacaatgtattacttgtcaataaaaactttgttcttttccctttctttgtatttcaaaattatcaactgcttgtattgtattccttgctcacactcttaagatgtacatgttagggaagggatgagtgcttaattctgagtttctgctagcatcaggaaaatgagacttcaataatttgtatcaatgatgcaactgaggagaaccaactcaaaaaattatttccagcttattgtctagtacagagaaaacaagtaaagaaaaagagtaagtgggtgggctgaatgtttacaaacctcatacttggcaatggattccttacaactaaagttctctaaaacattcccaacttgtaattatttattaataaagagattgcataatgaacaatggaaaccttgcagtggcaaaagtttatcttttttgtctttcctctttaggcattcaccaagatttgtaaagataaatcatttaatgtatttttaacacacatattgatatataatttacatactgcaaaatccacttcattttcaagggtacaattcaactatttttagccatgagacgaaatggaaaggactactgatatgtaattgaacatggatgaatctcaaaaatattaatctaagtgagaaaaaagaaaatgctacacttagaaagtgattatctcaaagttactctgaggtttgggagctataaaatatcaattcgtacatttctagaatactgttttcaatttctatgcttatcacgggctctgcaaaagacaaagctgtacacttcaatctgatttgaccagctttgataaatgatctaagatttgtaaaataaaagatgctttaaaatttttatagaacgtatatccaatgaatataattttaatccaacttataaaccctgtcagtaaactgagtacataaatatgtacattaacttttaaattcacaaaattttatcttctttaaaataatacattatagtgataaaggtagactgtaataacagtcaatgaggtgttcacaaataaaaatagatctgactaaatagtcttaatatgtttttcatagggtttgaataatgagaaggatcattatagggaaatgtatttttctcttgtaattaactgttatagcacaaaaaaaacactgattgtcggactatttttaatagtactcaatttattagcacacactgattggtaaattttattcctacaatgggactttcttagtcgagttgtacatcatatggcatagaaaagcaatcctcaattttattttgtttcagaattttgtgatatgcctgtttttgagaattccagagccaagagtaatggcatgtggtttaagctccatgacacattggactatgaatgctatgatggatatgaaagcagttatggaaacaccacagattccatagtgtgtggtgaagatggctggtcccatttgccaacatgctatagtaagtattttattcaagtatttctttttactagaattaaacaaatagaaacatacatatgtatatgtacacatatgtgtatgaatacatatgtgtacatatacatgtagtcctcatttgagtgtgaattaccttgaaacttaaaaaaaaaggttgaaaatacaaatgtcttcctaagaaatcaaataagatacatttaagagtatataaaaagctttattcagaaagtttccaataaaactgttgatttttccccaatgtaaagtattttttttcagattcttcagaaaactgtgggcctcctccacctattagcaatggagataccacgtccttcccgcaaaaagtgtatctgccatggtcaagagtcgagtaccagtgccagtcctactatgaacttcagggttctaaatatgtaacatgtagtaatggagactggtcagaaccaccaagatgcatatgtaagttcttaatattctggatctgagaaaattagagtaataactttgatccttgtttatttatactaaaatttttatgggttattaccctagaactgtgttcacaaacagctattctgctgaatatttgcctttcagatcttaatatataagtgtataagcttggaaaattttatgtaaacaatgacaaagtttccttttaaaaacaggaatgttcagagacctcaatttgttaatggacacaatgagtcttcaagaatgatatccatttattgcacacatatgaaatacagcatctcaccttaacatcaataaccattttcacattattaatacttaggtaaacagttttcaaagagttttgaaaacactgttttaaaaaccatggatgtggaaccaacccaaatgtccagacccaaatgacagactagataaagaaaatgtggcacatgtacaccatggaatactatgcagccataaaaatggatacgttcatgtccatgtcaaaagtgacatggaggaagctggaaaccatccttctcagcaaactatcacaagaacagaaaacctagcaccacatgttctcactcagatgtgggaactgaacaaggagaacaggtggactcagggaggggaacatcacacaccagggtctgtcacaggatggggagctaggggagggatagcattaagagaaacacctaatgtaggtgatgggttgatgggtgcagcaaaccaccatggcacatgtattcctatgtaaaaaaactgcatgtcctgcacatgtaccccgaacttaaagtataataaaaaccatgcactattaactaaaatcctacttgaaaacctgaaatgcttcctgatagagcacatagctagttaacactgagaagttctttctctgattattgtttttttcttacactttaccagtatttctagcaagaaagaaagaaattaacagaaagctcagccatttccaaatgccaatgctttctgttttcaccttcatctcctctcccctcgtcccagaatgaaaatgaatacactaaaaagccctcaagtctgtaatacaggtatactcttagaattttgtcccacaaatcctatgaacttgaagaaacacaattcaaaaaatatgagccaaaataattatggcagcaaaaagaaaacctaaaagaaaatttgccacaaatttctactagcctatgaggtagagaactgagatacccatcaggccttgcatatcagataacttattcctgtcacagctcttaaactgtaaactcacgagttttccaaatgctcaagttcctaagtacaggatgatacaagcagttcttttctgtgatatgactcatttcttttattttgatgctatgctaccttttaccttttatattgactgatgatgctgatattttggctgatcctatgatgggctaaaccttaattattgtccctatttatgtatccacttctgtagatgatcatgtgtaagtccgggctccaaaccatgcaagtggcaagactgcagaggaaaattcgtatcctcaaatcaaaatagtttacaagtatctttgaacatgatttcataggaaaaatttagtattaggtttcagagataaattctgagtcttaaatttgattgactgaggagatggacactcctaagatggatttcacagcaaaatcattacctcttctcataatcaagaacaggaaaggattataattatctgaggacataagatcagttccatgatacaagcaagactttcagtcttaaaatctaaagaagcaaagagcattcaagcagggaattctagggaaaaaggcaaccttatgaaaaatattacatatacatatggcatattaaagtaataaggaaaacattccagaacagcagaaaactttagaaacttttgaaaaatatgtttggagaagtatgtagtgctcaaataatatttatttttgaattgtaaacagcccctgaatgtattgaagagatcttaaaaatttttggatttcaaaagtgatatgtactatgttaagaaatttatttaagtgcttgaaagatggattaaaatatgatttggggaaatttctaaagaaatactaatgttaataagggctagacttgagtgcagaatacttgcatcaaaaggagagaagaggagtgaatgatatcatcaaaaatgaaaagtttaccatggaagaactgggcttaatacctagcgtatgggttgataggtggagctaaccaccatggcacacatttacctatgtaacaaaccttcacatcctacacatgtatccagggaacttaaaaaataattataaaatttaaaaaaaaatctaaaagaaaaccagccaggcgcggtggctcacacctgtaatcccaggactttgggaagccaaagcaggtcgatcacctgaggtcaggagttcgagaccagcctgaccaatatggtaaaactctgtgtctactaaaattacaaaaattagatgggcgtggtggtgtgtgcccatagtgccggccactcaggagactgaggcaggagaatcacttgaacctgggagacggaggtcacagtgagcagtgatcgcaccactgcactccagcctgggagacagagcgaaatttcatctaaaaaaaaaaaaaaagtaaagaaaaaaaaaaacattatttggaaggtaacataatcaaaacagtcatctcttatatcattgtctgttacagtgaaacattatttatactatttttgttttttgttacaagcaatgaaaccttgtgagtttccagaaattcaacatggacatctatattatgagaatacgcgtagaccatactttccagtagctacaggacaatcttactcctattactgtgaccaaaattttgtgactccttcaggaagttactgggattacattcactgcacacaagatgggtggttgccaacagtcccatgcctcagtaagcaaacctctttacaacaatatgtgcataaaacttgcaaagaatggagagagaagagcaaacaaatgattacattgtcttatatgacagagatggtaccaaaggaagagttgttcatgcaaaaacaccaaactagatcttttctgttatgagaccttcatgaaaatcacatgagaaataaatataggaaccttatgagaatacctatataatttaaacatattttatcataaaaactaaagataagtaacattgaatactgacctttttgtacaaacatttagtagtagctttagttttccttcagtgatacgtcatttttgtgtactgatgcagtcttatttaaatattcaaaaaattattttaatatactattttgatcaaattcatgttcctaatctaccttttaatcattttatggtctttaggacaatgtattctcagttatttggagaatggatataacacaaaatatgaaggaatatctttacagagtcaatctgtaaaagttgaggatatcctggctacagtctttcaaatgtgcagaccacagttccatgtacagaggatgaatggtctcctcctcccagatgcattcgtgtcagttagtccacttgtttgagaccccagtatgtccttaactgtctaagatctacacctttaactggaaaattttgtatatcaactctcaagctgaatatatgtcttttttatttttaaatagaagcctagctagctttcagttccaaatgtgtctgaatacatttataatttctggataatgagtggattctgtcacttagtagtcaagtaacaatagaaatataaatcatgaatagcacaaaataaatagactacggattaaagtaacattgcttcagtatttatattgaaatcatgctaaatgcattgatttaagtagattataaaattatagcattaatttaaaaataaatataatgcttgcccaaaggtcactgctacatctctcacaactatgtcatatctatttttatagttaatgctctgttgctttaaattaaggctgatcttcagttatagctgactttcactttttaggtaaaggggtctctgaaagttgtttgtgtgtattgcttgcaatttaccaaacattccattatagaaaccatatgaatattatgatataattgagatgaaagacaatgggaatcttcttacccctttgtaagagcaactgtcctcaacaataggcctaagccactgaaagaaaagtccctttttctcctgccataggcaccaactctatcattaatccacctaataaatattgttgtgtgtcaagcactttataggtattgaaaataaaactgtttacaatagaaactgaacactgtagtttagaggctggaggagattaataggaaagtaggcaagaatagatcagaaaactcatgattatgacaaatgctatattataaatatgcatcatctttaacatgatttttctttcagatagtaaaattagtccatttacatttgttttctaattactaattagaaaagaacatatacattactaatatcttaaaacatatacattactaaaataattactaccttatacatatacccattagtaatgtatagaacacatacattactaatatataaagaacaaatacattgctaatatattagaacttatttttgctatcttatttgctttcttttttctgcttacatttccacatgcctctcaaacaccacgtctatatgggtttaagcacccacttaagatgacgaccactttaaattcttggagacaacggatttacaaaattactttcttgcctatggtagcagtgtgtaccgtatctttgcctgggaaatggcatttgacttaaggaggtttaagaccccttaatagtaccaaaaatactcaggttgttgcaaagtagccagaaagtcttccaaaatatcattagggacttgagagtctgctagatgtgcattccttaaggcccgccagagctctgttgacagtctcaaggattctttgcttttattctgcccttccctgtgtcttcaacatttccttcagaaattcgtggtttcctttaagaacacggatgtctaggaaacttccagttttgctgttttcaattcattaacaaatgtttcattgttttgccatattgccatgtttttacttgttccctcctataaaagaagtattcaacaaatatttacttttttctctactttttctattttaggaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattagtaagtgatttacatattcccattcagtttctgtcaacttcgttcctctctttgagatgatagtgttttacttaaaaatatagaaaacacttttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagaataacagcaaaatgtgttagttgccattaaaaacttcgttgttttccctttctttgtatttcaaaattatcaactgcttgtattgcattccttgctcacactcagaaaagttgtacatgtcgggggagaaatgagtgcttaattctgaatttctgctagcatcaggagaatcagaccgtaataatttgtatcaatgatgctactgaggatatccaatcaaaaaattatctctaccctattgtttactacagagaaaacaagtaaaggaaaagggtaggtgggtgggctgaatgtttacaaacctcctacctgccaatggattctttacatgtaaagttctctgaacatgctcgacctttacttattatgataaagagattgcataatgaacaaaggaaatctttcagtggcaaaagttgattttttttctttcctctttatatattcacaaagatttttaaagataaattgcctaatgtatttttaacccagatactgttgtataatttacatactcccaaatccacttcattatcaagggtacaattcaactatttttagccatgagataatatggaaccttgatacataatacaacatggatgactctcaaaaatactaggctaagtgagaaaaaagaaagacacatttacaaagtgattatctcaatgttaccatgagttttgggggctatatcaattcctacatttctagaatactgttttcaatttctatgcttatcatgggctctgtgtaaagaaaaaggtgtatacttcaattttactcagctttgataaatgatctactttaaaacttgtaaaataaaagacaggatgcttcataaatttttatagaacttatatccaattaatataatttttatctaatatatacacccttactgttagtaaatcgttacataactacataaatggtttcgttaacttttaaattcacaaaattttatcatctttaaaataatagattgtagtatcatagtagtagactttaataacagccaatgagatttttcacaaataaaaataggtctgaccaaatgtttctaatatattttcacaggatttgaatgataagaaagaatatacagagagaaatatatttaactattgtaattaactattatagcacaaaaagcactgattgtcagactatttttaatagtactcaatttattagcacacactgattggtaaattttatccctacaatgggactttcttagttgagttgtgcatcgtatggcatagaaaagcaatcctcaattttattttgtttcagaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttatagtaagtattttattcaagtattttttattagaattaaataaaataatagacacctacatatgtatatgtacacatatgtgtgtacatatatgtacatatatatgtagtcctcctatgagtgtgaattatcttgagacttaaaaaaaaaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagatcacgaggtcaggagttcgagatcagcctgaccaacatggtgaaccctgtctctacaaaaaatacaaaaattagccaggcatgctggcatatgcctgtaatcctagctactcaggagggtgaggcaggagaatcatctgaacccgggaggcagaggttgcagtgagcggagattgcaccattgccctccagcctgggcgacagagggagactccgtctccaaaaataaaaaaataaaaaataaaaaataaataaataaaacagaagaagaagaaaagaaaaagagaaaaagaaaaaaccaagaatgttcagagtcttcaatttgttaatggatacaatgagtcttcaagaatgacatccatttattgcgcacatatgaaatatggcatctcagcttaacaccagtaatcattttcacattattaacactgaggtagagttttcaaacagttatgaaaacactgtttcaaaaaaccacgaactattaaatcctccttgaaaacatgaaatttttccggatagaatacatagctggttaacactgagaagttctttctctgattattattcttacttatattttatcagtattcctagcaagcaacaaagaaattaacgaaacttcagccatttccacaacccattgcttttccatttttaccttattctcctcttcccttataccataatcaaaatgaatacactaaaaacccctcaagccagtaatataggtatacttctagaattttgtcccccaagtactatgaacttgaagcaacacaattcaaaaaaatataagccacaataattatggcaacaacaagaaaacctaaaagaaaacttgccacaagtttctactagcctatgaggtagagccctgggatacccatcagtccttgcatgtcagataacctattcctatcacagctcttaaactataagttcatgagtttttcaagtgctcaagttcctaagtaaaggatgatacaagccgttcttttctgtgatgtgactcatttcctttattttgatgctatgctaccttttacctttcatattgactgatgacgctgatattttggctgatcttacaatgggctaaaccttaattattgtcccctacttaggtatccacttctgtagatgatcatgtccaagtttgagctccaaactatgcaagtggcaagactgaagaagaaattagtatcctcaaatcaaaatagtttacaagtatcttcaaacttgatttcatagaaaagtgttaggtttcagagataaattctgagtctcaaatttgattgaatggggagatggacactcctaagatgggtttcacagcaaaagcattacctcttctcacaatcaagaacaggaaaggattataattatctgaagatacaagatcagttccatgatacaagcaagactttcagtcttcaaaactaaagaagcaaagagcattcaagcacagaattctagggaaaaaggcaaccttatggaaaagattacatatacatatggcatattaaagcaatgaggaaaactttcccaggcagcaggaaactttagaaagttttggaaaatatgtttggagaagtatttagagttcaaataatatttatttttgaattgtaaacagcctctgaatgtattgaagagctcttaaaattttttggatctcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaaatgaaaagcttgctatgtaagaactgacatttttatcatgtaagaattaggcttaatacctagggtatgggttgataggtacagcaaaccaccatggcacacatttacctatggaacaaacctgcacatcctgcacatgtaccctggaacttaaaaaaaaattataaatttttttacaaaagaattttataaaagaaaacccatatgtggaagtaacattatcttactgattttacagatgaaggcatagtgagatagagtaatttgtccataatcatgtagggattcacattaactcctgtgtgcttatccttgcctctttaaaatagaaaatgaagatgacagggatagatgatggtgatagagagagagataattgacagatattgaggtgtatgtatgtatgtatgtatgtatgtatatatagagagttttattttaatagatgactattagaaagattatacctttctacagttctttttctacactgtgggcataagagaaaaatataaacatagaattaaattagcaaaatgtgagtacatttggagtgcttgtagtcacggcttgtcaaatgggggaaaggaggataagtaaccatgactccagtggaacatgttagcataatcctttttgatatgaagtcactagggtggacacaacatgttttagggaagaagagttcaggctctagagaaagactgccagggttcacgtttatcacctcacctgatgatctctgctgtgacgttggggaagtgcaactgaacttattatatttttgaaatgctaaagtcagtatgtagcacaaattaataactattaactatttggattattttataattttattttatcctaaactactcattaggatgcattttatttgctcatgaaaggcaagattatgattgttaattgtttctttttctgctttcagatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattggacttcctatcaatgaattagtaagtatagaaacagataactgaatggctttctgcatattgtacagtatacctagacatag

SEQ ID NO: 2435 - DNA, 30700 bp, Homo sapiens; identical to SEQ ID NO: 2434
  source 1..30700: mol_type = genomic DNA

SEQ ID NO: 2436 - DNA, 30700 bp, Homo sapiens; identical to SEQ ID NO: 2434
  source 1..30700: mol_type = genomic DNA

SEQ ID NO: 2437 - DNA, 32137 bp, Homo sapiens
  source 1..32137: mol_type = genomic DNA
actaaactagcttccccttagtacattgaaattcaaagtcatgcttgtaactgttaatgaaagcagatttaaagcaacaccaccatcactggagtatttttagttatatacgattgagactaccaagcatgttgctcttattcagtgtaatcctaatctcatgggtatccactgttgggggagaaggtaagttgaaaacagatccgaatattttagttccttttcaaatgtatttattgattgtgtgtgtgtatgcatacaaatatttttaaatgaataaatagctgaggataatttgaaggggtatcacaatattcatctattttctggaaatattttccaacatgcaattagcaggaaaattgaatgaaattaattctctccgttctctagtttgctaagggtaaatggtcaccaaatagataatgtaaagagaaatcaaaggagagaaaatctgctataataaagatgacaaggtgaaatattagtgtaattctgcataaactctgcaatgccactgactagaaaaatcaaccccaaaagatttggccaccttcattatgttttgagaattttattttcatagatttgataatttacattttaaatgttattaaaatgaaggaattctcatttcagcctaattatcattcaacagggaaatatattttaatgaaacaatagaaaatattatttttatatataaaccagtgaactgccaaaaaattgtttcttctgagctcttccacaaatttcaaaagtgaaataatatatcacttctttattaatactataaactgattcttataacattataaactatcccattttatttcatgtggaaattaaagccactatatcaaaaggattgcaaacaaaatctctaacaaggtctaggatactgattaaactatgtgtgtacgtgaagtttcaatcattgtgctatatactctttgatttccagaaagtttttattttactgctttactgctttctaatgtttacagatctttaaattttttgaacactttcttctcagtcctgacataagagaaaaatatgaaccataaaatgctttctttttaagatatgcccttacaaatgttgcaaaacattatttctatgggcctaaaattcattttattttgttttcacttttagtactgagctataatcacaagagtgcgattgcatgagtgtatttgatttttcttaagtctgtgtttatgatatttattaagtggcttaaacatctgttacaaatggcattacacaaggatttctaaaggggggtggaagcagaggaagataagtgaaaattatgaggataatatgtagaattttgacaattcctaaccccacaaaactttcaagcttcagtccagtcccaggataaactttagtgaaattctattaaaagttgtctaggtgttaaatgacctgtaagtgtgcattacacttttgttttggtgtctatttagaaactggccaaacagcagaaataacagacgaaagcaacacttttgtacaaatagaaaactgcatgcttccagtagcaaaacatgaatcaagcaatatattgtgcttcatgctgtagcaaagaagctggaaagaatatgacaacgccacccacccctcactactacttagagtgtcctaaaagaaaagcaaaatgtaaataggcaaataaattgcaaggttttatatataggtaattgtctgtgtgtgtgtgtgtgtgtgtgtgtgtgtgtacactcatacatcacttaatgataggaaaacgttctgagaagtgtgtctataggcaatttcgtcctcctgcaaacatcatagagtgtacttacacaaacctagattgtatagcctactacctaactaagctatacggcctgtcactcctagactgcaaacctgtacagcatgttactgtactgaatactgtgggcaactgtagcacaaatgtaagaatgtgtttacctaaacatataaaaggtacaataaaaatacaatataaaatattaagaatggcagacttgtatagggctcttaccgtcaatagggtttgcaggactgaaagttgttctgggtaagtcactgagtgagtggtgtgcaaatatgaaggcttagcacattaccatacactactgtaaacttcatgaacactgaatacttgagctaggtaaatttattttatttatatatttatttcaatattttggggggagcaggtggtttttggttacatggataagttctttagtgctaattactgagcttctggtgcacccaggatagactaaatttatttttaaaacttttcttcaataataaattaatttatgataagctttctactttatcaactgaaaatcttttaacttgtaactcttttgttttagcttaaaacacaccttgtatagatgtacaaaatattttttctttctatccttattctgtaagatttttatcttttaaattatttatttatttaccttctacacctttttgttaaaagcagacacaaacacacacattaacctcggcctacggagggtcaggatcatcagtatcactgtcttcctcctcactcttgttccactagaaggtctttagggcagtaacatgcatggagctgtcctctcctatgataacaaagccttcttctggaatagttcctgaaggacccgcctgaggatgttttacagttatttttttttaataagtagaagaagtgaactataaaataatgataacaactatagtacattaaatacattaaccagtaccatggtcatttattatcattatcaagtattgtgtactatacataattgtgtgtgctattgtttatatgactggcaatgctgtaagtttgtttataccagcactgccacaaacatgtgagtaatacattggattatgatgttgtggtggtcatcagttgataggaatttttcagctacattataatcttatgggaccactgtgatataagtgatcagtcattgaccaaaacgtcattatgtggtaaatgactgtatgtctgtatatatacgtgtgtgtgtgtgtgtgtgtgtgtgtgtgtgtgtgtgtatcccagaagaaatatattcacagtattctatcagaatgtcgagacaaggaaaattattttctgcttttggagtgggttgttgtgtaacggcaggcttgccaaaggacgataacactcctagcaccattgcggatgtgcacaatggttatacgatgaatgttgtagagcaagttctaaaggataggtagaatacaactggatggtgagaactaagttattctggatagcgaagaatatgtaagtacatatgcatgaaaatcaagtactataattttgcaattttcaaaaagtaaatgatatttaaaaggagttatgataggttaatactatcaagacacgagggagtctttccctcagtatcttctccaaaactatctaatgtcaatttttaaacagttaggtaataaatttaaggtttcacaaggttaaataccacaagaattatttcaaatattgtgcaacattaaatattacttctaggtagttaaaaaagagaaatttcccttgatttgtcagctgaatttctgcatgctttttctaaataaggtgaaaaacaaaacaatttcttatgcagcaatgctatattcaggaaatatcttgagctaaaaaatgagcacactatattgaggaaatatctcgagctaaaacagcattcaaagataaagtacatcaaatccatagaatgtacaatatcaagagtaaaccctaatgtaaactatgggctttaatgacaataatactgatagtgaagggggctattcatgtggcagggaagaggaagtggtatataggaaatctctgtaccttccactcaattttacagtaaaaaaactgtaaataaaaaattaagtctaataaaaaatatgtgtatatataaatatatatatacacaagaaaaaatagagtcaaaacatgaatatttcacccattttctacattgttttaccatatcttgcaccatagtgcatatggatgtatgtgtgagtgtctatataaatatatccagtagtatcctcagtatcattagtatccttaaggaattgttccaggactcttttcacccccagcagataccaaaatccacagatgctcaagtctctaagagagaatggcgtagtatttgcatataacatatgcacatcctctcatataatttaaatcatctctagattatttataatatctaacataatgtaaatactatataaataattgttatattgtatttttaattgcattgtttttattgttttattatctttttattgttttttctttttcagatattttggacttgcagtataataaacatttatgtatacagcatttaccagaatttagctctaattttatctcggttgagttgttcttagtgattttcttatactctttaaattatttccactgaaaccacataaactttgtaaccagaaagtaatcagaatattaataaacaaaaaatcaaattacctacccaacatttttactgcaccagaaaaaaaaataggacagatttttctggtggaaatacctatgacagttgatgagaatagaaaaagaaataaatctgagagctgagaacaatcctatcactcctctactgtacactacatagaccagggagatttgctactcttacagtctgccttcattcttaaattgttgtgtgaggatattgttcttgaagacattgcagaagagttcatatttcatatcattccaaaatataaattttatattcattaacaatgacctcgtcggtccggcatggtggttcatgcctgtaatcccggcagtttgggaggccgaggcgcatggatcacctgaggtcaggagtttgacaccagtctggccaatatggtgaaaccttgtctctaccaaaaatacaaaaaattagtcaggtgtggtggcaggcacctgtaatctcaggtactcaggaggctgaggcaggagaatcacttgaacccagtggaggctgcagtgagccaagatttgcgtgattgtacttcagcctgggcaacaagagtaaaacctgaaactccctctcaaaaaaaaaaagatctcctcaaatactcttctattcttatttagggatctttcttcattccaaattagtacactggaaagcatttaagctaaaggcatttaagctgaatgaaaaacaaaactataaatgagatgactaaaatataatctagtgattcatcgatgtagctctttatttaattcttcagttttgtgttatttttcccaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagtgagtaaatgccctgttcattaaatggatgtcattcagtgaatagagaaggatgtgccggacaagatcataaggtcttgataatcacaagggcaatgaccagaggagctggaaaaatgggagatgtagtcctcctattttgagacccctcctatgagaatcaatgaagaataaatatatcaactgtcttgcattacctggaaatgccctacatgttgaaatacattaatttttttaaactgatgattaatatatttgactgctaatagttctttactaatattcattcggtagcagcctgatcatagttttcctttaaaataagtcattttatatagatattctgttttgaatttaccgttctcttgcatattgcgaggtaaggtttggtattttaacttttatattttcaataaatcatttatttggtccttcaaagtgtagctatattaatcctccaataaatgtagagaccagactccaatgataacaggtgcattaaaaaagaaaaacaatgggagagagaatagatgaggcaacaaaggagatagtaatggtctttctccttttgtaagaaacatttatgagaattgcgagaaatatttatatgaagatattgttttggtgctagaagagtttataaacacaagatttttattataaaaaccatacagcaacaacatgaaatattaactttcgtatatatatatataggaacaaaaaatatatttcatcatttatacggtagcatgacccaaattcttttgaaaatatttacacatgatgtcagttttcaaagttttcctttcttaatgaaatatttttaaatgcactttttttgctacttccatcttgtacattaatcaatttttgttccttaggaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactagtaagcaaaataccactctctcagttttgctaattatttaaagaaataaatctatagtttatagattaaatataggttaaatataggtttcaccactacttctatcattatttatttgattttcggttccaattgtgtctaagtagatgtgcaataacatagtttgcctacctatataaatcaaatgtacgtaataagaagaaatattagagaagaatacactttgaagataatccattaatgtaacaactgtttgttgtttatattgtcaggttagttgacaataaatggttacaaaactgaggtattaaagtgcaaattagtccaattacagttaaaatgtcttataaggaagtttttaatatttatctttatttaaattaatatgcttgagtcaataaatcattttctaagttgtaaaaagtccatacttctgagaggtatgtgtatttgtgagcggcttagaatttggaaaacgattcttttggaagcctgtggtataaatgatggcacctcacagtcctgtgtgaactcttgtaattcttcatctttatagctcttcagtaattgttctttgcccagcccaatgcgattccatcctatgcttacacacctcagtattcaaccaaacactcaaggaaacttccatagtctttctcttcataccactttctctctgctactatgtccagtaacttctggccaccatagtcaccaagactgaccttactagtctcaactaaagaagaccactgagttcttcctgggttctccctccttgcacagtctagaaaaggcttcccaataaacagctgggctttcattgactttgctttattattttgaagtattgagggttttttccttttttcagtcatcacagttctgtactgggtgatttccagcattctgaaaataaattttgtaaaattttctaaattttttttcagtgggatgctatgttgatagcagctactccatcctatcaagaaatagaatctgtggtaggtttttcaaaagatgttatgttatcaaatattattccacatcttcaactcttaatttaaacctctagagccaggcacagtgatgtgcacctgtagtccccgccactggcaaggctgaaataggagttcaaagcttcagtgagttatgactgcaccagtgcactccaacccaggcaacaaagtgagacccttccccactagaaaaacaaaacaaagtaaagcaaaatgaaatttaaacctctagaaatggagtctttttaaaacagctggaactgcgatagtttttcagtaaacagttacgtcatggtctctttcaattacaaggggttaaaacattattaacatttgcaaaaaaaaaaaataacaaatgttactaacactagaaaattccagtgattgaaaagggttcaaaatgtataggcttcagttatggtataaatatttccatgctttctcttatccatacctgttcatgtcatgaacaagctctcttcattttgagagatgatggctattgtcagaccaacaattatattttagaagcttgacaaattaagtttggccagcgtaacccatacaagctggctctgtgtacagtctgtaagattttgttagtctttgaacaattcggttgctttgtgacacaaaaaatatcccaggcttaactcatgtttccactgccccagaactagaatcagccatacctccaataagtcctggttccatttagtgggcaatgacatttagaaactaagttgtcaaaataaacttgtttcaaaatttagcacattttatttaatcagaaaaagcacatatcttattgttcaagttctcagaatattgctgcctttccctttctgcccgttgcttattccaaaagcacaagacaacatattgaggttatcagagtagatggacagatggaccaagtcagagtctccaaagtgaaagaattcagcagaacactctgtgcctaaggttgaatggtagctcacgaacactgtggaaagttaataaagtttcagggcaactagactcctaatgatagcggcacagtctgtttattcatgtaaggtaacatcttgcaagttatggtaatccatgttgcagggattagtatggcgtcatctctgggggccgttattccatttacaacaccatgcaataaccatatatgaataaagcagctggaaaaccctacattggccaagatcgattattttctttttatatatatatatatactttaagttctagggtacatgcgcacaacatgcaggtttgttacataggtatacatgtgtcatattggtttgctgcacccattaactcgtgatttacattatgtattttgcctaatgctacccctcccctacctcccaccctacaacaggccccagtgtgtgatgttccccaccctgtgtccaagtgttcccattgttcaattcccacctgtgagtgagaacatgcagtgtttggttttctgtccttgtgatagttttctcagaatgatggtttccaggttcatccatgaccctgcaaaggacaagaactcatccttttttatggctgcatagtattccatggtgtatgtgtgccgcattttcttaatccagtctatcacttacggacatttgggctagttccaggtctttgctattgtgaatactgccacaataaacctatgtgtgcatgtatctttatagcagcatgatttataatcttatgggtatatacccagtaatgagatcactgggtcaaatggtatttctggttctagatccttgaggaattgccacactgtctaccacaatggttgaactagtttacactcccaacaacagtgtaaaagagttcctatttctccacatcctctctagaatctgttgttccctgactttttaatgatcgccattctaactggtgtgagatggtatctcattgtggttttgatttgcatttctctgatgaccagtgatgatcagcattttttcatgtgtctgttggctgaataaatgtcttcttttaagaagtgtctgttcatatcctttgcccactttttgatggggttttttcttgtagatttgtttaagttctttgtagattctggctatcagccctttatcagatgggtagattgcaaagattttctcccattctgtacgttgcctgttcactctgatggtagtttcttttgctgtgcagaagctctttagtttaattagattccatttgtctattttggcttttgttgccattgctttttgtgttttagtcatgaagtacttgcccatgcctttgtcctgaatgctaaggcctaggttttcttctagggtttttatggtttttaggtctaacatttaagtctttaatccatcttgaattaatttttgtataaggtgtaagtaagggatccagtttcagctttctacatatggccaggcagttttcccagcaccatttattaaatagggaatcctttccccatttcttgtttttctcaggtttgtcaaagatcaaatggttgtagatgtgtggtgttatttctgaggcctctgttctgttccattggtctatatctctgttttggtaccagtaccatgctgttttggttacttgtagtatagccttgtagtatagtttgaagttaggtagcctgatgcctccagctttgttctttttgcttaggattgtcttggcaatgcagccccttttttgattccatatgaactttaaagtagttttgtcctattctgtgaagaaagttagtggtaacttgatgcggatggcattgactctataaattaccttgggcagtatggccattttcacgatattgattcttcctctccatgagcatggaaagttcttccatttgtttgtgtcctcttttatttcgctgagcagtggtttgtagttctccttgaagagattcttcacatcccttgtaaataggattcctaggtattttattctctttgaagtaattgagaaggggagttcactcatgatttggctctctgtctgtctgttattggtgtataggaatgcttgtgatttttgcacattgattttgtatcctgagactttgctgaagttgcttatcagcttaaggagattttgggctgagacgatggggttttctaaatatacaatcatgtcatctgcaaacagcaacaatttgacttcctcttttcctaattgaatacccttgatttctttctcctgcctgattgccctggccagaacttccaacactatgttgaataggagtggtaagagagggcatccctgtcttgtgctgattttcaaagggaatgcttccagtttttgcccattcagtatgatattggctgtgggtttgtcatgagtagctcttattattttgccatatgttccatcaatacctagtttactgagagtttttagcatgaagcgctgttgaattttgtcaaaggccttttctgcatctattgagataatcacgtgtttttgtcattggttctgtttatgtgatggattacatttattagtttgtatatgttgaaccagccttgcatcccaaggatgaagccaacttgattgtggtggataagctttttgatgtgctgctggatttggtttgccagtattttattgaggattttcacatcgatgttcatcagggatatgggtctaaaattctcttttttttgttgtgtctctgccagtctttggtaccaggatgatgctggcctcataaaatgagttagggagtattcactctttttctattgattggaatagtttcagaaggaatgtgaccagctcctctttgaacctctggtagaattctgctgtgaatctgtctggtcctgaacttttttgggtggtaggcaattaattattgcctcaatttcagagcctgttattggtctattcagagattcaacttcttcttggtttagtcttgggaggatgtatgtgtcgaggaatttatccatttcttctagattttctagtttatttgcgtagaggtgtttatagtattctctgatggtagtttgtatttctgtgggatcggtggtgatatcccctttatcattttttattgcatctgcttgattcatctctcttttcttctttattagtcttgctagcagtctgtctattttgttaatcttttcaaaaaaccagctcctggattcattgattttctgaagggcttttgttgtctctatctccttcagttctgttctgatcttagttatttcttgccttctgctagcttttgaatgtgtttgctcttgcttctctagttctttcaattgtgatcttagagtgttgactttagatctttccttctttctcttgtggtcatttagtactataaatttccctctacacactgctttaaatgtgtcccagagattctggtaagttgtggctttgttctccttggtttcaaagaacatcgttatttctgccttcattttgttatttacctggtagtcattcaggagcagggtgttcagtttccatgtagtggtgcggttttgagtgagtttcttaatcctgggttctaacttgcttgcactgtggtatgagagacagtttgttgtgatttctgttcttttacatttgctgaggagtgctttacttccaactatgtggtcaattttgggataagtgctatgtgatgctgagaagaatgtatattctgttgatttgaagtggagagttctgtagatgtctattaggtccgcttggtgcagagctgatttcaagtcctggataaccttgttaaccttttgtctcattaatctgtctaataatgacagtggggtgttaaagtctcccattattattgtgcaggagtctaagtctcttcgtaggtctctaaggactggctttattaatctgggttctcctgttgggtgcatatatatttcggatagttagctcttcttgttgaattgatccctttaccattatgtaatggccttctttgtctcttttcatccttgttggtttaaattctgttttatcagaggctaggattacaacccctgcttttttttttcctttccatttgcttggtagatattcctccatccctttattttgagcctatgtgtgtctctgcacgtgagataggtctccggaatacagcacactgatgggtcttgactctttatacaatttgccagtctgtgtcttttaattggagcacttagcccatttacatttaaggttaatattgttatgtgtgaatttgatcctgttattgtgatgttagctagttattttgcccgttagttgatgcagtttctacctagcatagatggtctttacaatttggcatgtttttgcaggggctggtaccggttgttctttttcatgtttagtgcttccttcaggagctcttgtaaggcagacctggtggtgacaaaatctctcagcatttgcttgtctgtaaaggattttaattcttcttcacttatgaagcttagtttggctggatatgagattctgggttgaaaattcttgtctttaggaatgtcgaatattggcccccactctcttctggcttgtagagtttctgccgagagatccactattagtctgatgggcttccctttgtgggtaacccaacctttctctctggctgccattaacatattttccttcatttcaaccttggtgaatctgacaattatgtgtcctgctcttctcgaggagtatttttttggtgttctctgcatttcttgaaattgaatgttgacctgccttgctaggttaaggaagttcccctggataatatcctgaagagtgttttccaacttgattccattatcgccctcactttcaggtacagcaatcaaacgtagatttggtttttcacatagtcccatatttctcggaggctttgttcatttctttttactcttttttctctaaactttcttctctctttatttcattaatttgatcttcaatcactgataccatttcttccacatgatcaaatcggctattgaagcttgtacatgcatcacgtagttctcgtgccatggttttcagctccatcaggtcatttaaggtcttctctacactgtttattctagttagccatccatctaatcttttttcaaggtttttagcttccttgcgatgggttcaaacatcctcctttagcttggagaagtttgttattaccaatcttctgaagcctacttccgtcagcttatcaaagtcattctctgtccagctttcttctattgctggtgaggagctatgatcctttggaggagaagagacactctggtttttagaattttcagtttttctgctctggtttctccccatctttgtggttttatctacctttggtctttgatgttggtgacctacagatggggttttgttgtggatgtcctttttgtggatgttgatgctatttctttcgttttttagttttccttctaacaatcaggtccctcagctgcaggtctgttggattttgctggaggtccagtccagaccctgtttgcctgggtatcaccagcagaggctgcagaacagcaaatattgcagaacagcaaatattgctgcctgctccttcctctggaagcttcatcccagcggggcacccacctgtatgaggtgtcagttttccccctactgggaggtgtctcccagttaggctacacgtgggacggggacccacttgaggaggcaatctgtccgttctcagagctcaaacaccatgctgggagaaccactgctctcttcagagctgtcagacagggacatttatgtctacagaagtttctgctgccttttgttcagctatgccctgcccccagaggtggagtttacagaagcagcaggccttgctgagctgcagtggtctctgcccagttcaagcttttccagctgctttgtttacctactcaagcctcagcattggcggacgcccctccccctgccaggctgctgcctcacaggtcgatctcagactgccacactagcagtgagcaaggctctgtgggcgtggtaactgccaagccaggcacaggatacagtctcctggtgtgtcctggagactggacacaccactaagaccactggaaaagtgcagtatttgtgtgtgagtgtcccgattttccaggtacagtctgtcacgggtttccttggctaggaaagggaaatcccccaaccccttgcacttctattttttctaagaccactggaaaagtgcagtatttgtgtgtgagtgtcccgattttccaggtacagtctgtcagggcctcccttggctaggaaaggaaaatcccccaaccccttgcacttcccagggaggcaatgccctgctttgctttggctccccctccatggactgcacccgctgtccaaccagtcccagtgagatgaaccagatacctcagttggaaatgtagaaatcacccatcttctgcatcgatcacgctgggagctgcagaccagagctgttcctattcggccatcttggaacagaatcaagatcaattattttcaatggcattttgtttttaacaattagttaaaaaaagactataaacaaccaataaagaactgtcatgcaaaatactggaataacaaacagagatttagagatacacattttattttagtgaattaagacacattctcttgggatttgctcaagtaaactgtgatcaatacattaaagtgccaataacagtatataaaactagctagtttgaaaatatttatgagattattagttagaacatatttcaattttatttttgtgtatgcttgatttattcagattatttttgtcttgaatgtcaattatttattttacacaagaattaatatataattttataaactaaccattaatgaaagattattaaatgagaaaaacacacatattcatatacatatctatttctaattgaatcagaatatattcataatgagttagtttttacaaacatattagtgatagagttgagtataagggaaagattcaaaaaacctagatgggttttttaaaagtctttgatatttagttacccttttgtaaaactgggaataatctgcttttaaatattcccttcaacttaacatttattagttgtatcctgtttgggtgtttcacatatctactgttttttgagacagtgtctcactctgtcacccaggctggagtgtagtggtgcgatctcggctcactgcaacctccgcctcctgggttcaagtgattcacctgcctcagcctccctagtagttgggactataggcgcccaccaccccatgcctggctaatttttgtattttcagtagaggcagggtttcaccatgttggccaggctagtcttgaactcctgacctcaggtgatctgcccaccttggcctcccaaagtgctgggattacagacatgacccaccatgtcaggcccacatatctactttttatacatcattttttttatttgacaaaaagtaattaaatatgttgcaattttattttgttacttgaaggaattttttgtgatttagtgagaaaaaaatattcctattctgtattataaacaaataatgttattaaacttatttattaaacaataaaattagaactaatattgctaattaaacaaattaaataatttactgtatgagtaacttcacaggacattcttactacaatcctgaaaagattctcatagaaaatgttaccttgctatatacagtttcccaatttgcctgaggggtcttagatatatttattgggtataaataattagtctatatgttttctcgaaggcaagaatatattttatactctgtatatgaagccccttgcatcttatttttatatagcacacattaaatttgtttctgcaatgaaaattcacatatgttcatttaattttatttttagaaggagaatgtcatgttccaattttagaagccaatgtagatgctcagccaaaaaaagaaagctacaaagttggagacgtgttgaaattctcctgcagaaaaaatcttataagagttggatcagactcagttcaatgttaccaatttgggtggtcacctaactttccaacatgcaaaggtcagtatttattttagaagtgatgaaacaagaatttgatttttataataatgcccatatatttttattggagcttatattacatctataatctgacaaagtggtaaaatggcaaaggagaaaggatgcagttctatagtaattgagctgcatagattatttaggtgtccgtaatcaaggagtaattctacttctgtgttttacaatacataataggattttataggtcaaaatatagtagctggaattgagacgtcttaggatttttccatctagctcaataaaaaatttatactttttagaaatattgtacgaacaatgttatattttattaagtaattaagaaaataagtcattgcatatacgaattattcattagaaaacagtgatgatttatacctgcttcagatggcactatttttatcaaaaatggcttatcacattatttgaagtatgtattagtcccttttcacaatgctgataaacacatacccaagactgggcaatttacaaaagaaagagttttaatggactcacagtttcacgtggctggggagacctcacaatcatggcagaaggtgaaaggcacatctcgaatgatggcagacaagagaagagagtttgtgcagggaaacctccctttataaaaccatcagagctcgtgagacttattcactatcatgagaatagcacaggaaagatccgccccataattcaattacctcccaccaggttcttcccacaacacataggaattgtgggagctacaattcaagatgagatttgggtgaggacacagccaatccatatcaaagtatttatagatattaataaaagttataactatacattgcatatgtatattatatcacatatttgataactatttacttttatataactttcagattattgacctacttaaaaatcttcaagggtacaacttaatatcctgattataataaacagcctacaaaatattgggaaagatggacaatcaggatgtttaaatatagagaggatataagattgtactaagaaaatattattaatttggtgaaatgtaaaagatattttgtatatgtaggcaaatgtctttatgagatagcattctgaagaatttaggactaaaatttcactgtcatttactttcaattacttcacaaaaaataagtaaatagggcaaagtgtaacatttttatatctaggtaatcagtttataagtgttcattatgcattctttctcctttcatttgctcaaaattgttcatcatgaaaagtgtcaatatttgaggaaacgaatgcagtcaatacactatgtacactgcaaaaaacacatgtccccaaaaatagaagtgcaatataaaggcaattaatttctaagtcaaaaatttagtaactccacatttttctatacttataagaccatttaagcattatttatggtttctttataataggacaagtacgatcatgtggtccacctcctcaactctccaatggtgaagttaaggagataagaaaagaggaatatggacacaatgaagtagtggaatatgattgcaatcctaattttataataaacgggcctaagaaaatacaatgtgtggatggagaatggacaactttacccacttgtgttggtaaataaatattaacatttaaacaggacagttactattactttgcacttatatataaatacacatgtaaacagatttaaaatattttcagagtaagcactcattttattacattttcttagaacaagtgaaaacatgtggatacatacctgaactcgagtacggttatgttcagccgtctgtccctccctatcaacatggagtttcagtcgaggtgaattgcagaaatgaatatgcaatgattggaaataacatgattacctgtattaatggaatatggacagagcttcctatgtgtgttggtgagaaaacattcctaaactttatatttgattatttatcattttgattgggattgtataaagtgtataaatctggctagaattacaattttattgatactgactcttccttccacaagtaaaatatgtcaatccatttattcaggtcttacattaaactttaccatatggttttatgaatttcttgttattactgcacagatttcttcaccaatttatttgggatttttctggcatgatgaatggaaacttttattaatgtatatgcttgaatagttatactttctatatgcaagaatgtgatttaattgcatacattatttttgtttccagtaaccttgttgaatttctgtattagttctaatatttaattgggatattgtatttctacaaatgatggcgatttaatttcttttatttcattgctttaacttagtctttacctcagcatgttccagatagaacaacctaaaaaatagcaatgtagcttgagttctattaaattccagagtgtttggaatcccttcatagaagaagagtaggggactaggacccaggaactaggcatgatccttgctctttctggtcccataattctcttatttctattcctaattatctacttagtttgtcggtttcctccacagaagtagtaagtagtaagtagtaagtaagtagtaagtagtaagtagtagtagtctatcagcctgtgtgctctactcttaccttgcagcctcaggacttccagccttgacacttaagtacttgcaggtattttttttcccgacaccctcagatcctggcctcttttgtcctatctctagcaacctcaatacattaaagcctctaattttgaactttaaagacaagcagactttccgccgctgttctcctccttacagaaactgaaacagaaccgcctctctctccatctcctggacttttggataatcaactggcccactcattgctgggaaaaattactgtaggtgttgccagccgttgtcccagcaaatacctggtcagtggccatccgtgatgacctattgtgagggaatgttttccactaccaggagccagaacgctgttatgggaagatgtagatcatatatcttcatggtcatcaacttttatgcaaggagtacataaatatcaacctctagccccatatggggtgaattaaaaatagaaactattgcagaaaacacctgtaagcatagaagtagcagagcacactccatgtctcattatcccatccttttacacactaaggaaaaggctccataactatctacatgtttatgggaaacgggaaaaaaatgtaacaatgagaactacttagacaagcaagaggcttagtaggaatttatgttctgaagctcagttgtgttattatcagtgagttcttcccctgagaatactctgacttactgagtcagagtttttgctgagcttttgaaatgtgagtcattgaacctcaagggggacccagatctatctcttactgatgctttgcttcctgcagacttacccatgtattgcctctttttattatttaaatgttttgaagatatttaagatagtttagtgcaaaacaatcatacatgtgtacattttcagagcctctaacaattcatttgtagcttcctaagaactatctttcagtcaaaactcccactaggaaaacctatcttgcactttcatttcccagaaaactttctgacctactttcctgtcattcaaagatgggatacagttttttgttttattttttctttttccaacagcattgtctattttgtgcaatgagattaagaataagttttgtgatgttgcttaaaagcatcaaacataattatgctattaatattgcagatattttattgacataattgtttagtttctatttaatattattttttatagcaacacaccaacttaagaggtgcaaaatagcaggagttaatataaaaacattactcaagctatctgggaaagaatttaatcataattctagaatacgttacagatgttcagacatcttcagatacaggcactcagtctgtataaacgggaaatggaatcctgaagtagactgcacaggtaagatttgtttaaaacattttgttgatcttgttgcttctttacaagaaaaattattttgaaattagaatgtttttaaattaaatatttattgtggcatataatttctatgctaatagtaaagtagaaactagttataatactctttccagacaaatgttattctttaaaagccttggctttctggtaaagatgagagagtaaagctgtttttactctattacagtctcacaaaaccttgaaagaaaaaaagaaataaagaactgtaaaaaaagaacaaaacttaatcttcaatgacattaagaaacaattaaaaccccaattatgcactgtgaaacaaaactaacagatattgccaattctggaccagacagtaggctgagtaaaaagtaggctgagaaagaaaatatatttgagtaatcaattatttccctaagaaaaagtctcacattcctcgaaggcttatattcaaatcatttactttgagtaataggattataaattacaagtaattataaaatggggcaccatattagattaaaataaaccagaactagagaaaacaaagtgcttataaaggaatgacaataaaagagagaagatagactgcagacttctcatcagcaacgtcaaaagccgaagaaaataaggtaatctcttcaaagtgcttagtgaaagtaactggcaaccagtcattctatgtaccaatataattcactaatgattccaaaataaagaaatttgcaaccacaggaaggataggagtttacacacaaggtcatagtttgaaagaaatcatataaaatacacattaatgatataaaatactaatttatagcaaaaagtgtgatgtcattagaaattgtgaggaaaaatactggaatatattcttaaacttaaatacataaggatttcaaaaagataagataactacaatttgtttaaagcaactggaacatttttatgtttataaaatatttgatttcattatatattttttctatttgaggaagagaaatattctgatagttgaaagaagtttgaagccttttatgtgtccatgaaatgtttacttaaattggccagtcattctgcccaaaataattctcacaacttcaaatattaaagccctatagatgactttttgtaaccacaaacaaataacattaaaagtgtataaaaagttatccacttccttacctttcattttgggtaagcaaataatttacttccaaataacctagtgatgtaatgtttaaaatattaagaactatgttataattacaaggatacgtagtaaaacctatgagatgcaacctaagcaaaatttagaatgatgtggcattcatagtcttaaacttatctattttgggaaaaagtatatatatatatatatatatatatatatatatatatatacacacacacacatatatatacacacacatatgtatatacacacacacatatatgtatatatgtatatatgtgtgtatatatatgtgtgtgtgtgtgtgtgtgtgtatatatataatatatatgtatatcctaaaaagctagggggaaaatgaattcagatattaggaggaaaaggaaataataaaagtaaaagcagaagaaaatgaaatagaaccttgtatttccaactaatccaagatatgaaactaatgttttgaaaagattaataagcagagctgtctaaatgagttgactctaatcaagaatggtgtgcatacacaaataaacatttctacaaccaaagagtagatgaaaactgaaatacagggaataataatatgagttcaattttttaaataaataaattacaagcataaagagaaggaaaatactatgagtcataggtatcaaaataaggaagaagccttatttaaagttttgagaagagctggtagctagtagtctggaaattaggtaagaacgttattaggtggcaaatatttgttacacaccttgcttgttcttgagaaaaataataaaatttctcattttatgcatcagaaatacatggcttcaagaagttatttggtcaaaatcaagactggaacttgtttccagatttttatatcagtgctgtttcaactagactctgtctttactagacagaaatttctaaacagatgtccaattctaaaaggaaagtaaggtgggcaactgagatcattatgtgtaatgttctttttacctaaaatataaaaacaatagtatatgtgtgatatttgaatatctaactcacttagttgggactttgttgatgaaattctcattattatttgtacatttgagattacagacaccttcagcttccctatttcctggcactgggacatctaggaggctcatagcaggtaactgctgagtccctagattggcagcacaggccttgaggctcattcaaaagagtcttgatgatactcaataagtattcatctttgtgactatgtatttaaataaaaatacttaaaccaccaaacagaaattcataaacaacaaaaatgtttagtttccaaaatgtttacaaaatacctaaacaaagaggtaataagacattaagtagaagagcttctaaataataaataatattgaaaactgacccatctatctatcaaatgtgcctgatatcctcttttcatgtgcttctcatagactttcttcaaactcatgaccaaactttgctaatcaaaaatgtatactaacaataataatatcaggctaattttattttcttttgcagttaattactgaaacaacactgatcacaaaagactggtcttgttaatggttgactagaataagatgcatctggaactaagtactttaagttcacgcttttcttaaaccagtaaataagtaggacgagtcatataaaacataaaatacgcatcagtgggccccagtcccagatatctatctagatttccacaggaacagtttctgtttagatttgcactattttgcctttctgaccttgaaaaaataaggaaaaatccagtataaaattcctattttagacaatatgtatgttttggcttattttatactgacctcaggttctgttcaaataatttattaaagatctgttgtatataattattatattttttaatctagctaaaccaggaaagagtagatatgcactcttctgtcttgatttttaaatgaaaatagtatagcgaggaaaaaaaatagcactttcaatgcaataattttttttttcactgaatatgttttttttaattattgttatactttaagttttagggtacatgtgcacaacgtgcaggtttgttacaaatgtatacatgtgtcatgttggtgtgctgcacccattaactcgtcatttagcattagatatatctcctaatgctatccctcccccctccccccaccccacaacagcccccggtgtgtgatgttccccttcctgtgtccatgtgttctcattgttcaattcccaccattttgaagggaagtgttagtagacagtagccaccactctggaaaaacatgagatgaaggagatcactgtaagggcatgagcccaggtcaggaggtttagaaaacgctttggcatccaagttgaccatttaaaacttttccctaagaataagccaagcaaccaaaaaagaatttaattcctagtccaacggaggcattccagttatgttcattaccagccattctcatgtttacaagaaaatgcaagtcatggaaatcctttattgagatctagggttcagttattaggggaagtcatagttatttctgattgttgtcatttttatttttaaattgtttaaattcaatgtacataactttttgaatcatatgggttagttagaaaaaaattaaagaaatttatttgtaaattatacaagagaattgacaggaataatgaataggagatacaagagagcatctgaaaaattttaaactaatggttataacaaaaagaatcgctttttaaactgtaaactatagtgacacaaaaaatatttgttattataacatttatatatagggagagagaaagagaaagtgatagagagacatagtgtgtgtgtgtcattgaatcttccattttcctgaaacactaccctattgagctgtttttacttaacttttattaatcatataatttaattccaatattttgtagaaaaaagggaacaattctgcccaccgccacctcagatacctaatgctcagaatatgacaaccacagtgaattatcaggatggagaaaaagtagctgttctctgtaaagaaaactatctacttccagaagcaaaagaaattgtatgtaaagatggacgatggcaatcattaccacgctgtgttggttagtagtttatttctaagtaatttcacttaaaaagaggttattaatcccctttgctttatctaaagaaagaaacaagaacttatgactaatctgttgcactgtaccccaaagccttaaattgctaagtaaccaattctgtcatttaaaaaagtttctctaagagttatctccaacagtgttcatagaagaaacaagtttgaaatttctacatcttcttaaaaatcttttctatcatatttttactgtaccttttctatgtttaaatatgtttagatatgcaaatacttaccatcatgtcacaatggcctatagtattcagtatggtagcatgctgtacaggtttgtggcctaggacagcaatacccaacctttttagcatcagggacatgttttgtggaagacaatttttccatggactgaggaggttgggggatggtttcaggatgaaactcctgtgcctcagatcatcaggcattagattctcataaggagcatgcaacctaggtcccttgcatgtgcagttcacaatagggttcaagatcctatgagaatctagtgccctggttgatctgacaggaggtagtaatgctggcagtaatgctcattcgcctgcctctcacttcctgtcatgcagcccggttcctaagaggccacagagggtactggtctgcagccaggggtttggggacaataggagcaataggctgcaccatatagcctaggtgtgtagtaggcaacattatctaggtttgtgtaggctcactccatgatgctcacacaaggaaaaaagagcctaatgacacatttctcagaatatcttcttgtcattaagtgctacatggctgcatttcaaaagcacatatttcaaaatattacttgacaaaacatcagatatggcaaagagtgcttagagctggacaagatgcctgataattgaacaatctatttatctaaataaaaaccattggtaattttgcctagagatatttccatagggggtaagtaattgcagtgtgttcaagaaagaatgtggggtgataaagtaagatcatggaggatgagaaacaagtaaatgtgttcaaaagggaatagagaaatgaggcagttaccggatagaagatatggagaaagtgaaattttaccttattgaattgtgacattttcagcatgtttgtaggttggtgaatgattaagtggaaagggagacattgatgttacagaagaaaggagataattcatgaagaaggatcttttacaagtttaaaggtgaaagaatctagtgtcatcatgaagaagtcaatctgagaaagcaaggacagtaactcaatgaaactagaggatgtacaagcaatttgggataggattacttagtgatttcatatttatgttcttggtgatatataaagggagatcagtcagtacaattgaacgtattccagccaatcttagcatgaagttgttactttttttagttttccccaaaatctcttcattagcatgaagttgaaacatttattgatagggaaagatgcctacaatattatttggtatcaaaaaagtaaatgcagaagagtgtgtctgcaattcattttcagtaaaactacaagtttatgatcatatactagttggtatatgctatttgcataaagtaataattaccctgagactagaaacagtaagaaagttatttacttttacctttcctctttaagtgacaattgaatattaaggggtggaggaggaacctagaccagaagtttactcacctgtctctcctgccttcaataaaaagtattcccggtattttatatgaatttcactttaacatgaaaggagctacaatatgttttgaatcagactttatgacagaaatactgtaattaattatttgaatttccagacaccttatattaaagatatgatacatgatgcttcattatattattttgtttaaactaacataatgtctcaacaaataaatgctgttttccagagtctactgcatattgtgggccccctccatctattaacaatggagataccacctcattcccattatcagtatatcctccagggtcaacagtgacgtaccgttgccagtccttctataaactccagggctctgtaactgtaacatgcagaaataaacagtggtcagaaccaccaagatgcctaggtgagttcttaatattctcttggaatctgagatttaatatttatagtgtaatttttttggactaatttcatagaataacccttacttaagtttcattcagtcaaaatctttcctgtcaaatgtaaatacatacaaggaaacatttgaaaaatttgctttatgcaaagtgagaaaaatttatttaaaaactataaataaaattttaaagacctacatgtgataaggtgcattatgaaattctgtagagtccagagctatttatggggcctattcgcactccattaaattgtttcatgttataagcatctacctgagaacttctcacagagaccctttgaaaaacactggtctaggaaaactgtcatttaatactatataaggttctacttgtaaacctgaaagctttccctagtagaacacctagttgactaatactgacatggctttttacttgcatgttggcagaatttctagcaggagagatagaaaatctggaagagttactgagccactttctaaatcttcactatcccttcttttcaccctatttttttctactacaaaataatgccaatatacatattaagtttccacaaattcatgtgcactttgtggcattaaaaaaattaacatcgtagactccttatgaaaatttggagattcacttttagggcttaaaaggagattcttttatcggtcatgacaaactaaaagggacaaaatacaaagatatggggcgaattaataacaccaattatgggaaaagcatgaacgtcagtttactctataataagtggaagaaaactggaatttccataaacccctctgttttctggtgtccaaaagagacaccatggtaataaggatctgttcctgcaacagttctcactgttgcccaatacctcacagggctagaccagaagtttgttatagtcttgaaaattcatccttctgacgatgtctctttcttccaccttctgtagtaacaaattaccccaatgccactatggcctatacagtgcttcaaaccactactctgtgtgagcccctctcccaggatatcattaaaattgtgtgggaactgaactcagaaagtgttgagttagtataaggcagaagtatcatctgaacaattttgctagaatgaagaaaaactaggtttcaaagataacttctaggatttaacttggagtgattgatggatagacaaaaatgccattatctaatattttaagtacagccaagttttagatggtccaataatttaaaattcgcagaaattatcatggccagtgatcataaaataaatttccaaaagaaaagtaagaacaaaatttgtaacctaaaaagtgtgtaccatgttgacaatcagagtttgtgggaagggcattctagcaaaaagaaacagtattttgaacaataacaaacacaaacacacaatcacgaaaacaaacaagcaaaaaaacccatcatagatatctggaaaattcaaggaaacatgatctaactatgaaatgtaaaataattttatttcccatgagataggagattaagattagacagctctgaagaaataattttttccagccaggcatggtggctcacgcctgtattcccagcactttgggaggccaaggcaggaagaatcacctgaggtcgggagttcgagactagcctgaccaatatggagaaaccccatctctactaaaaatacaaaattagacaggcatgggtggcacgtgcctgtaatctcagctactcgggaggctgaggcaggagaatcatttgaacctgggaggtggaggttgcagtgagccgagattgcaccattgcactccagcctgggcaacaagagtgaaactccgtcaaaaaaaaaaaaagatataattttttccaaaaccagacataaatttatttggatggttcatgggtattgaatgaagtagggagccattacatatttttaatagcagttttttgacatagcatctttttttatttttattttttcaagacaaagtcttgctctgtcacccaggctggagcgcagtggcgtgatctcggctcattgcaacctccgcctcctgggttcaagcgattctcctgcctcagcctcccgagtagttgggattacaggcacatgccaccatgcccggctaatttttgtattcttagtagagacagggtttcaccctgttggccaggctggtcttgaactcttgacctcatgatccacccgcctcggcctcccaaagtgctgtgattacaggcgtgagccaccacgcccggcccaatgtagtatttttaaattatcagttgactaagaacatgtggttattttacaccgagaaaacatgcaatatggggaaattgtttaaggccctggcagagatagattagagtcttgactagtaggtaaaaaacaggaaccaaatgaaagaggggttaaagataacttcaaaatttctcgatttatggagaatattctcaggtgcttaacacataagaatttttacaaatcaatcaaaattcagtataaaaattatgtaaggtacataaacagaaaatgaaaaacatatggcaaacatgaaagaatgcttgtctacacgaacataaaatttcagtgaagtgtcaatgttcaactaggagatcggcaaaaagaaaaaagtatataacataaagacttggcaaggatgtggagagttaagcactctaatatacatacaagtgtataattacatatacatgtgtgtatatgtaatataaatatattacatattacatatatttttaacatatatgtatacacatatacatatgtaacatatctaaatatacataagtatgtatgtataatatatgtatacttatatacacatgatacatatacatacaatatatgtatacatataatatacatataatatgttatgtataatatattatattatacattatatataatccatatattatacataatataccgatatatatttatacattagatataaattgattacattacattagatataaattgtatgtaacatgtatacaattaacgtacatatattacaattaacatacatataaatgtatgttatatatacacattatattatgtattatgtattatatattatatataagatatatataaatatatatataaagtgctgattttaagaaagagtgagtgatatctggggtcagggaagaagataacattgttttttctacagaaatcaaggtttcacaaagttaagattcacaaataattacattataaaaagggatatctaaacaaacaacattcatgctggtagaatttttagtaaagtatagcaattaagagctcaggttctgaactcatactggcaggatgcatattctggctcaaaacactcactaaactgtgtagccttgagaaaatctcttagcatttatttcctcatatgtagcccatacacagtgctaagaacagtaccaagaataactcaataaatattattttttaaataaatattaatatttttcatcattttaattccaaaatattcttaaatgcaatttcactattctatgaaaggtaaagatgtattattatttatttattttattttaccatttcttctttcagatccatgtgtggtatctgaagaaaacatgaacaaaaataacatacagttaaaatggagaaacgatggaaaactctatgcaaaaacaggggatgctgttgaattccagtgtaaattcccacataaagcgatgatatcatcaccaccatttcgagcaatctgtcaggaagggaaatttgaatatcctatatgtgaatgaagcaagcataattttcctgaatatattcttcaaacatccatctatgctaaaagtagccattatgtagccaattctgtagttacttcttttattctttcaggtgttgtttaactcagttttatttagaactctggatttttagagctttagaaatttgtaagctgagagaacaatgtttcacttaataggagggtgtcttagtccatattacattgttataacagagtatcacagactggataacttctaaccaatagtttatttgtttcataaatctaaaagctgagaagtccaagatggtggggctgcctctggtgagggtcttctcgaagcatcataatatgctggaaggcatcacaacatggtggaagggatcacgtggcaaaagagcatgtacatgggagtgagagaaaaagagagagagagacagagtggcgggggcggggaggagcgcaaactcatcctttataaagacaccactcctgagataacaatccaatcccatgataatgacattaatccattcaagaagatagagctctcgtgacttaatcaccttctaaagatctcacctgacaacactgttgcattggcagttaagtttccacgtaaactttcggggacacattcaaaccacaggagaaactcaaattgttcctgggcaaatcacaacatggggaattttattcataaatgtccacagaaacagtaaatgttctcgcttcagtacttaattcatctaatccctcctgtttgtctcaaattataggataactttgaaactttctgaattaacgttatttaaaaggaaatgtagatgttattttagtctctatcttcatgttattatcacttaaaaacctgcgaaagctgtcaacttttgtggttgtagcaagtattaataaatatttataaatcctctaatgtaagtctagctacctatccaatactaaataccccttaaagtattaaatgcactatctgctgtaa

SEQ ID NO: 2438 - DNA, 61488 bp, Homo sapiens
  source 1..61488: mol_type = genomic DNA
ttgtatgcttcaccaaaatatttatttgagaattatacaacaaaattccaatatggcataaactctgtggagacctttaaaaatatccagtgagatttgcttcatttttcccccctagagaattattaattataccgttttatttccattaaatggaactcttgagagaaaaagaatagaatgaagagagagatcacaattttatacattgtactgagaaataaaaggccttcctacatggtagctaatccagtcaaaataattggccactttggtgtaaacacctgggaactctggttttccacagttttccccccaactcacaacaccccagacataagtcacattgttggcatccatacagactaaggggcctccagagtcccctttacaggcatcgatggaaccatcatatgtacctaagaaagaaatgtgaaagagaaaatcacacatttccttccatttttcaaggctgccatgcctcctccatggcatttaacaactttggcttttttacagtttcctgacagcaatagcatgggctctccttagagtccctggctgggcttgcagagttgcagagatgcagcttggaaaattctttacgagtcttctatttattcccccaattcagcatgttcttcctgtgttctctactttatacgactgagtactgagatgagattgcaacctgaaagttgcatcaaatgctgagtaggaaaatgatgggactgcctagtgcttactgagtgctaaatatttattagtcattcattgtcttcattcttaccacaaccctatgaggcaaatatcattattgcccctattttatacataagacaactatgacacggagtttaacttgtctaaggtcacacagctaacaaacgacagggcctggacttgaacccaggcaaccacacctcagagcttgtcctcttgaccatgatactcccttttgggagattttgtgctattcacctattttgtccactgtaatcctgaactccatttcaagatgggaggacactttcttcttactcatgattttctgagatttttaaatcactgtaaccagtaagttataggatgtcaataactgccttttcagtaatacaccatttagaaatggtttcaataaagcacctaaatgcactacactggctggtactttgcctgcctctgtatcacctccaaaagtaggagctgctattgttgtattgggcagtagaattagcttaaccatgttatcaaaggagtccgtggcgtaagaaatgcgctgtgatttccatggagggaaaaatttacttccaaatggaagtaaatctcatctcatttgagatgagataacttgaatttgtatttaaaagtaatttagttttgatcctgggtgtaccacctcttgtctgtaagactttggacaaattatgtaactgctctgcatctcagatgccttatctatgatcttcaattttacaaatgaagaaacctgctcaaggtcacatgactagcaattagtaaaagctgggatataaatctaggtctggttccagaggccgtgctcttagtcaccttgctgtgctgctatagaatcgcttaaggaggatttttcctcatagtattagaggaagaaacctgagctacagggaagggactgaaagagtttgagagtgctacagccagaaggccaaatggagggaattagggcccaaagcatgggggctgatgtggtgggaggagatgtttgataggggaaatacatacatcttgacatcttggataaaccacttggcacttacctgcacattccatttctttttcatagaaacgatttccgtaaaacttagagcagttgcttattagtttaacttcaccccactgaagtgaaaagactctttcgttatctaaacaaagtgagaaagcaaacatttagaagtcacaaatgagaaatctaaatacatactctcataacttaaaccattgggattatgaaagggtgtatagttttcaatatatataaatttttgagaactcttccttagcgtgtttaatcatatcatatgtctatttctaaaattggatggatagtcaagggggactattgaacatatggtctgaagtcacattcatttaataaagagctggtaccttaagttgaatgagataaatctttcccttttggttgcagaactcagtcaggcaattggataggaatcagtgataaggtcttttcacataaatacctcctatcttctcacagtcccttatttccttgagaatgtttgttaaagcaaaaacaatgttttaatataagaacttcaaataaaggaaatacatacgaagttatcaatgtttgtgtgtttttgtgtgtctgagaagaaaaatccatctcctaagtgatttgaagttatttaaaaggggatttaagattttcttcctcaagtgatctgccccactcagcctcccaaagtgctgggattacaggcatgagccatcgtgcccagccaggaaggagtttattttttttttcctttaagctctacttcaagttagtctcaagacacctgccttccttagaacaagagcttttttaaaaatagtaatttcttatttcctctaatttgggaaaagcctttaaaactgtgagcaattcttaatggcccaggagatagtttgtgccttggcactcttgtaagcttcttgaggcagctctccgacggtagctgaggcagcgaaagggcagaattttaactactagactttaaggtggtcagtaaacaccttgagagctggacttcatctttcagccatggaacttattcatccccttgtttgttgactgggtccatattttccatcagtgaaatcctagcactttagcattgctatcttgcagacatagtaaatcctcaataaatgtgttaaaccattattaataaatgtgttaaacctttgatcattgattaaggacatatctaactatcagtttatatgaagtacatggaataagggaacatgttaaatgctagatcaggctgggcacagtggctcatcccaggactttgggaggccagggtgggaggatcacttgagctcaggagtttgagaccatcctgggcaacatggcaaaatcccatctctacaaaaaatacaaaaattagccaggcatggtggtcccagctgctttggtggttgaggtgggaggatcgcttgagccccagagctcaaggttgcagtgagctaggtttgtgccactgcagtttagcctggacaacagagcaagaccctgtctcaaaaaaaaaaatccagataaagaatgtgattagccaaattcaaggtatgggaattccaaaataagaattacccattctctttaatgattaaattttaaataaaaggaaggggtaactattctagattaaaacatttaagaaaaataaccaccaaatgcaatgtgtggactttgtttggatcttgattcaaataacctgattataaaaatatttttaaaaataaatgaggaatattaaacatgggctttattttattgggtatgaaaatggtgttgtgtccttatctggtgaagatatatactggagtattcatgggtgaaattatatgacatctgggatatggtttaatatactccaggaaaaatatgtgggggaatatgttgaatagctcctgaatgtgcctcagaccattctccacccttcaatgccgtgcatcctgccctaagagcctgacctgtggcctctggttcccaggtggttttagacaaagaggaccctagcaggagggagggaaggaaagaggtaggctagtgagattgggactggctatacccttcagctcaagatccttgcttctctcaaggcagcctgctctacctgagactttttctccatctagtaacttctcctactcttccgctttcagatccaggagttaagacagctctggtacctctagtcctgggtacctgcgtagcccctgtgattccccaaccccctacgtatatctttgtaatgaacccttttataaataaatcttcctaattgctccattgagaccccaattaatatggggagatacaacaagaatgacagaatgctgataactgtgaaaattggatgatggataagtaagggtttattatactttaatctctatttttgtgtatacttgtaaatgcacataataaaagatttaaaaaaacagaacaagtataaggacacaatactctcttgatgaattaattcctaatacaatttggtgttttagaagttttaggtattcagacataccacaaatccagattaatttctacatatattttacaccttccaatgtggcaattataatgaatgtgttggaatatgagtctaaaagaccaatgcaatgaaggtacttagagtttctgctatcaaagagaatttaagatgttgaaaggaagctaaattttaaggttaaatcttcctttttttctgttatgcttgtggttgttttgagacagagtctcgctctgtcactcaggctagactgcagtagcacaatcatggctcactgcaacctcaacctcccgggctcaagtgatcctcccacttcagcccccctcaacctccaggagctgggactacaggtacacaccatcacatccagctaatttctaaatttttggtagagacagtgtctcaaactcctgggctcaagtgatcacctgcctcggcctcccaaagtgctaggattagagacatgagctactatgcccagcccaaggttaaatcttcaagatgaagggaaaggtgttgactagtttaattctaatctaatctctaattcagcagatctttctaagaatttgtctctgagtgtccacatcttttattcgtatgaagtgttcaccacaagtcttcttagaagttcaaaaaatgaattccttatgttctttttttctttgtagagagggtaggtgctggggaatagggaaagagggaggaggggagtgagaaggagggttgtgggcatcagcgattcaacatacaccaaggctatccctttgtaaacctttttatcttttacccacatctccccaacaaatccaaacagtccatgctgtatgtctccctgtctctatatttttttcttggtgaatggctacccttcaaagtttgccacaggatcatagagagaatatatatgacctttgaaagcctagataaggactggttccataatttgcagagtccagtgaaaaatggaaatgtggaatggggccatttcaaaaattatgaagaatttcatgctggtgacaacacagcaataaatcaagcctcagggccttctgagcatggggtgctgggcagctgcacatgctgcaaacccatgaagccagccatggctggatgtttacttttctggatatgatgttatgcttctctctgagtgctaggaaattagctcctatacatttctattctctttcatttccaactcatggcttctgattaacaaactgtaaaacatatacctttttctcgtccccagccagaaacgatgcatgtatcattaggttggaataggtaaggagaccaggggacacaggcagggatggaacgaggcagctcacaatcttttttgtttccgtcttttttcatttcaatcaaagcgatgtcattttggtaagtgcctgcattgtagttttcatggaaaataattctatccacgtattcaattactatacgtttaaggtcggggtgtatccagtctactactgttgtccatatttggtaacgatgagttttactggctctataacagaaaaaaaaaggaaataaaatatattgagaaaaaatataaataggaattctgacacttcacttttatatttttcccttttaaaaacctttttcatttccccagaattttgtaaatgcttgctgtcatgaagcaatgagattaaatttacttagtgcagaattaggtcaatggtaaatgataaagctaggaataatccatgtaactgctcaatatgaggaacataaagaacacattaacaactagagatgcccaaaagtggaatgagtttgctgcctctggagtgagtgtgccgtcgctgcaggtgtttaagcagagaccagacagcatcttgccataaatgtagttaaggaactagggagttggaccacacacactcattactctgccaaccctagaggttcccagggcaaaggccacagcagtcattatcctgacccttaagactaactttatcctaacattgcattgtatttatttgttcacatgcctttcctcacactagactgtgctgcttgaagccagagatggggtctgattcatctgtgcagccctggtgcctactattatatctggatcatagtagctgttttaaaatcctgttgaaatggtgaatgagctaaatattgcctattcttatgcttcactacattttcatatcaagtttctttcttcccttctttctttttaaaacagagacagggtctcactcttttgcctaagctggagtacagtggtgtgaacatagctcactgcagccttgactcctgagctcaggagacactcccacctcagcctccctagtaactagaactacaggcatgtgccaccacattaagctaatttaaaaaaatttttttgtagaaatggggtcttgctatgttccccaggctggtctcaaacctaccaaagtgctgggattataggcgtgagccaccgcacctggcctcttatcaattttcaactcatagtttcaagcaaatcaggcatctaccatcatcttctcatggaacagtatagagtcacttcggcaaagtattatagcttagtttttttggtttgattagaagtagggtgctaaattatgacctcatagtctaacatttccaaacaataaattattttacagaatggatttttcttaagcaataaaacttatttttaaacaatttaatggaaatcttttcaaaaaatgtattatttatatcagtgttcctcaacctttttggcaccagggacaggttttgtggaagacaatttttccatggaactgtggaaaactcgggggaggaggggatgatttccggatgaaacgctttcacttcagatcaccaggcattagattctcataaggattgcacagcctagatccttcacatgtgcaattcacaatagggtttgcactcctatgagaatctaatgctgctgctgatctgacaggaggtggagctcaggtggtaatgctcgcccaccactcacctcagttcctaacaggccacagatcagtacttgtctgcagctcaggggtagagtatccctgatctatataacttctgctttctcaaacagcattaactgaacagaatttatctttacataagggtgattcaggtaaccaccttaaaaggtggtgtcctaggaaataatgagatgttcaggaagcttttgtttatagtgttccaagaatactgtccttcatattaattttgattgtttttcaggatcacaggttgtaaatattatttatttagtcaatttattcaacaaatacttagtgtgaacctatatgtaccaggcactgtgttaggcactgagatgcagaaatgagcaaaatcagaaacagttcctgctttcatggagttcacgatctagggaaagatgcagcagtaaatggatcatcacactgatgaaaataatatgttctaccatgaaaagtgagaggaatgaacagtatgtgggcttttaagaacttatcaagagggctttgacttaagggagtcagggaaggttccctaaggaagtgaagattgagctgagatctgaacaaagggtacgactaagtagggaaaagggtaaggaagatcatttctggcaggggaaacaatatatgaaggtccctttgcaggagggggcaaatgcacttgagtagcagaaagcaatccagagtagaggtggtggaacagggagcaggaggtggctctgtggggcaagatgagattggcaaaggttagcagaggtcagattacatggggcctcatgggccatgttaaaatttttgtttcaattcttatcctaagaggaatgcaaagtcattgcattttaggtgacaagtaatcaaaactaggtatggcaacatgactcttgagccacacagtaaagaaaatataggtaggccacagtggagaacaaaatgtaagtagtacctacccactctcccactttgcaaataagccaggtgaagtaatttggcagctatgggtttgatctgcctttgccagtgagatcagcaattttggtctgtggaggacacagtagattctacgggattagcctctggaattccagtcgcgaataccagaggatactttgcaattaatatagtggagtttgtcagtacctttttcagatatgctttatcatctgccacaatctctattactcactttcattgtttcgggaaatctaaaatttactgaagacatcttttacctgagacaatgtgcagcagtcagaatccaacagccaccaatataaattcccccacaggtgattccactggcatccttaattgccacctgccatgggaggtctccctgtaaaagacatttgtgtggtcactgccattctaacagatagcgatacaaacagccctaagatatttccatggcaagactcccagtctcttataattacatcatcctcctgcccctttccccccaaatttaggctgtttctgggcagttgcattgtgacttttcatgcgactttaccagttgtgctcgctttcctcccacaattcgtttccttcgaatgtgcattctgtttttaactccacaagatagtttaggtaataatgattttatccgtcttctttcttcaagaaaggaagagattacatcattattatcttgaacccattagcgtttttaacacacttcttgattatctatgccacaaaaacaggagagtcacagccagtacaagacaggctggaatcattagtaaattattttgaatgctaaaccatactattcatcttatttaaaaattctggcttgatattaaaattggcttgattctctgaagttctgcctaaagatagactagtggcagaaaagggctggccaagaggttaaacatttaccagcctctagctgataaaggatgccacatgtccaggcactgtggcagtggcagctcagaagggaatcacattctgaaatcatcagggtaaactaacaacatggcaaactgtgtcttttcttttctttctttcttttttttttgagatggagtctcagtcttgtgcccaggctggagtgcaatggcacgatctcagctcactgcaacctccgcctcccgggttcaagggattctcctgcctcagcctcccaagtagctgggattacaggcgcccacccccacgcccagctaatttttgtttttttagtagagatggggtttcaccatgttggccaggctggtctcgaactcctgacctaatgtgatctgcccacctcagcctcccaaagtgctgagattacagggtgaaccaccacgcccagccatagtttttattttctagaggctgtttatatggaactcttatattaatatcaatgttaacatagtgatactcttattaagtactttctatatgtcaggccccatactgagtctttgtatatagtttatctcatttaatcatcctattaaccctgagagatgatgtgccagtgaccccgggacaagtgggttagcgggctggggagtgttttttagccatttgacatgtgacaatgtttccttcctctgtctgtgagcatgcagacgtctggcgcatttgtcatgagaaaacacggtagagcaaagtttatgacctgaattttccaaagaatttatgatgactgaagaaagtaaaatatatccctttatttcctctctatattttaacatgtcatgaaaatttttgtaaacttgcttcttagccccagatgagaaaggaaaatgaatattgctgttaataattttgggcataccgaaaggagttaggcccccaagaaagagccgttgttgtatggaggctaaagcaacttcatcttggatactaatctgccatgttagcttctgattaaccccaattccgggaaggcctctgagatttccagtttatctattattccttgtataagagcatgtacttactataaatcctggccttatggcaaattcctacccattagctctgaagcctgtgtgcccctcccctacagtatataatctctgagtcgggagagaactagcacaaggatccaccatcttgtctcactgttgtccaggacacagacctggcttccattagtaagtccctattaaatgtttctttctaaggaactggacatgtcagcctctttgtttggcctctcagcttccttagactttgggggctgatttgtgtgaacctgcccactgtgaaacacatggatagaagatggttttttttggtctcacccatcctaagaactggggtgggggaagagtgtgatggtaagtttttgcttacacttttgaaggaagagggatctcatgctctgaggactgtgaaaccaacttaggtagtatctgaaaatgaatgttattctgagtaaaaataaagggccattgttgaaaatgccttttgactaacatctatagcttcgagagctaaatctttttttttttttttttttttgagatggagtctcactctgttgcccaggctggagggcagtggcacaatcttggttcactgcaacctccacctcccgggttcaagcgattctcctgcctcagcctcctgagcacctgggattacaggcacctgctaccatgtctggctaatttttatatttttgtagagatggggtttcaccatgttggccaggctggtcttgaactcctgacctgaagtaatccgcctgctttggcctcccaaagtgctgggattacaggcctgagccactgtgcccagccttaaatcttttactcattgcctgatttttaaagattgttacttaattttggttactgacaattagaaagaagtctacatgaacttcatttaaaaatcccactgaaacagggagctattttattcccaatttgtatttgaggttgagttactctcttaagtttttatagctaatacataactgagtcagaatttaacgtaagtctgtctgactagaaatctctaatcaattgctatcttcccaggaacttaatactttaatttaatttggcttttagcgcacaactggccaaggtacagatcttcaaaggtctcctattaccgtgatttaaaacattgtgaaagaatggttaattcaattaacatctattattttttctatttcaaaaaattatgtcatgagtcatgcttgagagctgcttgttttttcacaaaactgacctgacaaagttcgttttaaatagaaaaagcttatgtatgattggagtattgttttcatttcaaaattagccatatgaattaatccagttttaaaagcaattctcaagaatcatttaagcttgcttttcttaaaagtgacagagaaaggagaataataatgttatattttttaatttaaattgataccaaaactacttgttgcttgaatcaattatatatatgcaaatgacactgaaattacagcctaaaccagtgagccaccaataaaaaagtataacgttagcttacctgcatccatgtcagcagtcaaaatttctgtttcttctatgataaaacaaaagattccaatgtttaaagttgttaattatagtcaaaatgaaatcattaaaatcatttaaacactgattataattttctgccttaaaacttatcctcccttttataaagaactgtacaaaatccccaaggcatgtcatcttatttcctttctataattaggtaattgtaaaggctcaagatgcactgtatagaaattcttgctggcacaaactagagatatctgttggtactagtgaatgttgagactcatggtgtcacagtttccagtagttagagcacgcaaaatgcacagcccagaagaggaaggcttctatttcaactctctgcatccccagggtgttttgtatatatatataaaatattatataatatatatttattatataaataaatatttataatatatatttattatataaataaatatttataatacatatttattatatatttattatatgaataaatatttataatatatatttattatatatttattatataaataaatatttataatatatatttattatatatttatatataaataaatatttataatatatatttattatataaacaaatatttataatatatatttattatataaataaatatttataatatatatttattatataaataaatatttataatatatttattatataaataaatatttataatatatatttataatatatttataatataaataaatatttataatatatatttattatataataaatatttataatatatatttattatataataaatatttataatatatatttattatataaatatttataatatatatttattatataataaatatttataatatatatttattatataaatatttataatatatatttattatataaataaatatttataatatatttattatataataaatatttatatatatatttatattaataaatatttataataaatatttataatatatttattatataaataaatatttataataaatatttataatatatttattatataaataaatatttataatatatatttattatataaataaatatttataatatatatttattatatatttattataatatgtataattttatattatatattatataatgtataattttatattatatattatataatgtataattttatattatatattatataatgtataattttatattatatattatctaatgtataattttatattatatattatctaatgtataattttatattatatattatctaatgtataattttatattatatattatataatgtataatcttatattatatattatataatgtataattttatattatatattatataatgtataattttatattatatattatctaatgtataattttatattatatattatatatttgatatttttatcaaatatgtattttaaaatatatatatatatattttgagacggagtctcactctgttgcccagactggagtgcggtggcacgatctcggctcactgcaacatccgcctcccaggttcaagcgattctcctgcctcagcctcccgagtagctgggattacaggtgtgcgtcaccatgcccggctaatttttgtatttttagtagaaacagggttttaccatattggtcaggctggtcttgaactcctgacctcgtgatccacccgccttggcctcccaaagtgctggaattacaggtgtgagctactgtgcctggcctcccaaggtgttaacataaggtagggagcagtcatcagcactagccaagggagtcctgagctgacatgaaaaaggctcctctcagtttgtacaggtatgggttagcattaggcatctgggatgcagaagttaaaaaaaaaaaaaagaatcttcttttttttttttagatttttttcttgaagttataccagatgttttcatctttgctctgccattctagaacatttctgtgttctagatttctttgacctggggatctgaaggtgaattcccaccaacatgttgctctgtcatggatgaggatatggctggggatcacatagcccagaatggcagcgtcactttgctgcaatcctgtgtcttctcactgaatttgctaagttctctttgggacaggcatatgagtgtttgttatgccacacacctaagttgttttctggggtagagagaggctctgctcagatgcattcacaaaagcacgcttgtgaatcagagaagactcaaatattcacattcaatgcccaacaaaggaagatgagaaagtccagtgtagctgaggtgtactaggtattagaagaacagcactaacttgatttaatataatcaaagctgaggtgtactaggtattagaagaacagctagtacacctttgattatataaaaattatggatttctattcaacaaatctcacatggatagagttcacagatgagagacagcatggaagaaggtatctgtaatgtttaaaactgacaatggactaatttgtagactgtaaaaggaacccttgcaaatcagtaagaaagattacaatgaaagaaatataaaattgagcaaaggatgtgaaccagtgaaagaacagagaaaaggaagatgaaactaaaaagctagtatgcacatgaagagaaactcagaatcattggttaatataaaaattgaagttaataaacaatgccatcacttgacagctggagaaacacgcttgatgttggtggggttgaagaaaacccgcaggcattattggtggaagtaaggactggtatataacagcactgccaaagaacatacaggcactagtaatcaaattaaggatatgcatactctaagattcaacttgctactatggtttgagtgtgttccccaaagttcatgtgttggaaacttaatccccaacacaacagtgttgggaagtggggcctaataagaagggattaggtcatgagggctcttccctcattaatagattaatgtcgttatctcaggagtgggttagctgtagtgagagtgggcttgttatatacaaaagtgagttcggactcctcttgttccgttgctctcttgcccttcaacctcctgccatgggtgatggagcaagaaaacccttgacagatgtgggacctgcgaccttggacctcacaacctccaaaactgtaagaaataaatgtattttcttcataaattaccccgtctgtggtattgtgttatagcaagacaaaagaagacacttgcccagctagatgcctcgaagaaatcctcccacacatacttaaggagaggatattcatcacagtatgattgtgggctgaaagtccattactgagaaagtggagagtaaattgtgcaagataaacacagtggagtattttatacagcagttagaagcaacaaattagatgaacacacagtaacatggacaggtctttaaaatgtaatgagttgtgaaaagaaaaaaaggaaatagagatctacaacacaatactatgtgagtaaaaaatgtatgcttgcaaaataacaatacacattggataagaatgcatgcaaacaaaaaaacgtacatattaaaccactgaaaaatggttgcctattggggaagaggaatgggagtaaggtatagtgataaagagggataaatgagtcaaacaagacaggggccttgcttgacccctgatgatcatgtataaggagctgaggagtatcattaactcatcactttgcctctgagatctgaaactagggagggaggaggaaggaaaagaggagggagggagggaaaaaaggaatagagaagaagcagcaggaggaggaggaggacgagggaagagatggaagaagaaggagaaaagaagaagagaaaagaggaacaagaagaagaggaagaaggaggaggaggaggaagaggaggaggaggaacagcagcttcagagggcaaaatgacaagtgagagaatgcaatgaaataataggcatttagagcaaagggtggtcttgagctagccagtccctcaggaatcctaagaaatcctgaggaggtggctcacgcctgtaatcccagcactttgggaggccgaggcaggtggatcacgagggcaggagttcaagatcagcctggccaagatggtgaaaccccatctccactaaaaatacaaaaattagccaggtgtggtggcacgtgcctgtaatctcagctactcgggaggttgaggcagagaattgcttaaacccgggaggtggaggttgcagtgagccgagatcaggccactgcactccagcctgggctacaagaccgagtacaagaccgagactccgtctcgaaagaaagaaagaaaggaaagaaagaaagaaagaaagaaagaaagaaagaaagaaagaaagaaagaaagaaagaaagaaagaaagaaagaaagaaagaaagaaagaaattctgaggaggatcatgaactttgacgttatatgaactggggatatgagtcattttacatttacatttacatgactccagctctgtcgcccaggctggagtgcagtgacgcggtctcggctcactgcaagctccgcctcccgggttcacgccattctcctgcctcagcctcccaagtagctgggactataggctcccgccaccacgccaggataattttttttttttgtatttttagtagagatggggtttcaccgtgttagccaggatggtctcaatctcctgacctcgtgatccacccgccttggcatcccaaagtgctgggattacaggcttaagccaccgcgcccggcagtttacatgaatatttttaaaaagggtggtcccaaagagctagagcatttggggacatctgactgatagaagtaaataagaaaatgcctatcatgaaaagatgttatctttattcaggtggcaatttcttgaggagctaccttgattttgagagaaaatgaagagaaaggtattcggcaaaggtgaaatgtgcagggaagagtccactctggatggtgttttggtcagcaggctgtggatggggtgtgtgagagtgaaagtttatcacactgagaaaaggcctctacgcctaaactaatgttcaggctgggttattactaaaatgtggtcatatcatgctccattaacagttacattaaaatataagaccaaagaacctgagttttgtttcaattttttaatatccccaaattttaataaaaattttaccttgagtcacagatgcaaagcctgaagaaaacaaaaacaaaaaatttatcaaaggataatttttggaaaaaatgcacactatagcaatatactatacatatatcatgaaaaccattgcaccttatttctgttttcttcggtaatataatttttctattataaaaatgatttaccttgaattgtaggatgtctagctgctaaaacaaaaaacaaaaaactcactatagcaaagagatcattttgatttgaataaaatatgcacaaattattaaatttcagactagtacaacttaatagttagaagcattactaaaatgcaaaggcagagctcatccctaaataagagtaaactgaagtaacaatgatagttggctaaatgtgtttttgaaacagattttaaaaagataaaaggaggtcaggtgcagtggctcatgcctgtaatcccagcaacacgccttctaaagtgttgggattacaggcgtgagccactgcacttggctggggcagggatttttgaaatgttattcactaatggaaccccaccacctagagcagggactggcacacacagtagcagctgaataaatattcatcaagtaaatgaataaatataacttaaagagatttttcctccagaaagcactgatggaagcaaagagtcagtctgtatagtctagaataggtacataaggaatatttttcaccattggaggttatccagagcaccaactcattgctttgaaacttggtaagtaaaaggaaaaaatgaagcattattctgcctctctatagatttctagttaataagtgcaataggcatgataaaattagaaattgccattttacagccctattgacaaaatggacataggcaacaatttaaaaggctgctaaaaccattaggcaaaagattgtggggcactttgaaatggacacaccaagctgatcaagtaatcatcttagcatcactagaggagggacaaccagacaagaagacattatgtgtaacaggaaatacatgcaagactcatcaagaattcttgcctaaggccgggcacagtggctcatgcctgtaatgccagcactttgggaggccgaggcaggcagatcacttgaggccaagagttcgagacgagcctggccaatgtggcgaaactctgtctcttctaaaaacagaaaaattagccaagcgtgatggcacatgcctataatcccagctactcaggaggctgaggtgggagaatcccttgaacccaggaggcagaggttgcagtgagcctacattgtgccactgcactctagcctaggcaataaagcaagactctgtctcaaaaaaagaaaataaaaagaattcttgcctaaaatattaaaccttgctcttaaaaaaaagtgttcatttgtcattgactcgaagctcaaaaccttggttataatcaagtctctctaaatctagaatagacgtatactataggcaaacgactcagtttctctaaaaaaaaaaaaaataataatagtatgaaaaaaattggggtagggaggtggggaagataactcttgatgaataaagaagactttaaaaacgtaataaccaaacagaacattcagattcttttagatcctgatttgaatctattcattcaaaaaagacatttttgagatagttgagaaaatttgaacatggctgttattaaatgacgttagtgaattactattatagtgaattattatatctaacatagattttagatatacaaatgagagaatgaatggttttatatatatatagtgtttttatcactggagatgcatataaatgatgtgatatgatatctaaaatttactttaaaatactgcaacaggccaggtgtggtggcttatgcctgtaaccccagcactttgggaggccaagatcatctgaggtcaggagtttgagaccagcctggccaacatggtgaaaccctgtctctactaaaatacaaaaattagccaggcatggtggcaggtgcctgtaatcccagctacttgggaggctgaggcaggagaatcacttgaactcaggaggttgaggttgcaatgagccaagattgtgccacagcactccagcctgggcaacagagcaagacttcatcacaaaaaaagtaatagtaaataaaataaaatactccaacaaacatacaaacaaacaaactggaagagagataagcaagattggcaaactatcaataacttgcaggtggaaaatgggtacttaaggattggttctaatggtctattttttgtatgtgcagtgagaccgtcttttaatagaaagttctgaaataacaagtagatatttagcggatgaaaatatgaggagatgaacattccatagttctgcaaatgcccactcagtgttcttactgctacacccatctatgttccccttaagattatactttacctaaagaaaagtttcagaatccctggattcaataatgaaaaaaagtcaccccaagtctttcaattacctgcacagccaacttcatcttcccctgtaatgcagtccacctcaccattgcattgatactggcttggaatgcaaacacccgatttgcaatggaagcctttgccttggcatgctgtgcaaacataagcaggagaggtttttttcattccttaaagttgaatgaggtacaatataaaattcaatagtaaagttgcttttcctcttttagtcagaaaaatgaatttagaggatttagaggctagatttatgtctacctttacaacacagttcatcactttggtctccacaatcattgataccatcacaggctttcatctgagaaatgtatttcccattcacacactgaaagaagtcatccattggagaatctgtaaagcaggaattatctttgtgaaatttatttatggagtggtggcatgacatccttatcagatttttgggataatggagtcattaagagaaagttaaacttcaaaaaaatgtataaaacgtattggtattatcaacatagtacatatgactcatacagaaaataaaggtcaaacctggcttatggaggctcttctattatctctgaaagtcagtattaattgtgaaagtctatatttgctgagatggggaggaatcaagagtacgtgctgacattgacaaacactggtttccacccatttctttcatgctgctatactcatcctcacccctactcccaagacttgcttggttagtgccatttgtttacattttggtggtacttttttttagcactgaaaaggagtgggtataggtttggtctttaaaactacatgtatgactaaaatattccagtgtcaggaaggaggagaaaagtctcaatgaatgcctgaaaactgaggcaccaatgtggtcacttaaaggttttaaataaattcatatatgctggccctcttaaaggagatgctgagctttcttcttatgtttgattgacttgtgtttgctacagtaactttaatccagatgttcaaatgaagcaaggggagtcaggcaactttgcttcccatatgtgaacctgtagagaggcaatgtttgaatggcaaaatggtacaataggggaaaggtaccaatttagactctaaagcccaaaacttgacagaatctatattattgcctctgtgactggcaacgaggcatcaatcatttgtttactataggcttggtgtaaaataaacaaccttcaaggaagggaaaataacaggcaaatactccaccaacctgctttctgtgtataacaaaccacatcagcgaaatcctggtaacccatagttcttctcttagtaaaagtacattcagccaaactggtctctaatcctcggcaatgcacatgtagacattcagtggaatttatagagagatcagacaacttaaaccttctttgagtatcagcacctctgcaaatagaataaaggaaacattatggtagaataattagtactttgcatttataaccctactgtagcaggtaagaaactagagtaatgtcctctcattctctatataggagttacagcttgggcaagataccgaaactctgagcctcagtaccttcatctataaaagggaatataactacctcactgggttttgtaaagattaactaaaacttggctgggggtggtggctcacgcctgtaatcccagcactttgggaggccaaggagggtggattacctgaggtcaagagttcgagaccagcctggccaatatggtgaaaatcctatctctaccaaaaatacaaaaattagctgggtgtggtggcctacacctgtagtctcagctattcgggaggctgaggcaggagaatcacttgaacccaggaggtggaggttgcaatgagctgagatcgtgccactgcactccagcctgggcaacagagtgagactctgtctaaaaaaaaaaaaaaaaaaaatttccatcttttccttttgggaatctctctgcctgccccatgctgtaaactttagctggttggttcaattattgcctaagacttggaaggttaggttagtttaattcctgtaggtcaattttgcttttacagtaagctacatcttcacttcagccttgacagtattaaggtgatattttggcatctgtgtgccattgcttggacttctcaatttgctcagaatttgtgagaagagacttcctcagtgacgtattatcctagagatgatgatttacagtgaactattcttctaggacattcaattgttccttgcttctctctagaagtaaatggggaaaataggttaaaaataaaaaattgagcaaagatgcatcaggtaaatggaaacaaaaatagaacagtaatgacaatataaatattagactaactaggataaaaagcaaaaataaaacaaggtgaagccaagatttgtaattatttcagatcatgaggctgtgccatgagaacaaacaagagccatttgaggcaatcttataggttaataatctgaaaaacgtaccaacctaaaaatatctaaaaatactatataaaatgccatcttcttcctcaatgagttcttaaggaagtaagggaaatctgcactggttaaaattagagatgtctgttcatgagcttatgcaaaatataagagcaaaatactgagaaataaaatactgagagaatctaccagtaggttgaaccataagttgtaggtaacaaactgctgaaactcagaaatagcctatggcttaatttaacaatataagagactctcactaatgaactactagcagatgtggtttaagaagaagaaaattgaattcagaaagaaggggtgagatacaagaaagaacaaaccaagaagttggtaaacatgaagtaaatctgagtaagcattgccttaatagtagtgataatggcttattatatcatcatagtgattaacttctgggatatagaaaaataaggtggaactaaatattagaaacttgatgggttaattacatttttttctattattactgaaggtgaggacttcctaaatcaatgatttatggtataagttcaaaggtaactaaagaagtagaaatataatgcataattttcaaaccaactagaggtggaaaagaggaaagatttttaaaaatctttaatttagtagaaattataaaaggaaaaaggacaaaagcacacaaaaagcagggtaaataataagcctaaaaacaagaggaaaaataaattcaacaatgtaagtaagtataataaggtaaatggactaaactctttagttaacagtgattgtaatattgaattaaaacaaatctagatatgtgctgtttataaggaacatgcttaaaatctaaagatataggaagactgaaagtaaagaaatagagaaagatctaaacagagcagctaattctattaataatgagtaacatatctattatctagaaccctgcacgtggagcatttgaaaaatactcagccacaaagcaagtctcaacaaatatttgaaaaaattgttatcatacagggatattctctaaccacacagaataagaaaatcaataacacaaagttaaccaaaagcaaactaacgtattaattaaaactaatattataataaagaaaacttctaaattacatatggggcaaagaagaaattatattgaaagttagaagatattctgaaccaaacaataaataaaatatcacttatatataagtatatatactataattatagtatataagctatatataaattatagtttgtacactatactcatagtatatatacttatatactataattatagtaaactatactataaaactataaactataatttatcctaactatatagtttatactataactgtatagtttatactcactgtatagtttatagtataaactatattatataactataaactatactcacacacagtatataaactatactaagtgtgaaaaagtgtacataattgtagacgagtaggagacagacagaaatgaatgtgtttgtgactctcagaatcactaaaggattcacatccagatacttcaacagacttattatccatgctttgttgtcagcagggttccaagtgttgggtaaacatgaatgcatatcatcctcataacaatgctatgatgcacatagttaattttcttaggttacacatatggaaattaatacacagaaaggttaggtaatcaaaaagcaaacagaacaattaaatcagccatgagaaaatccactgatacaagcgctcactgttgaaacccaaggtcaaggcaggccacgttggcttccctcatgctccagctgcttttgcatatgaacattgtcttatcttggtccacaagttttacttcaactattccctctgaatctgtatttccatgcttcaaggaaacactaaactttcctaaaataaaaaaacaaaataatgtgcaatatgtagccattcacttttttctcttaattaaaagtctttaaaaataataatgtacttaatgtcaagtgagctttgaacatcatgacgattttaacaagtaatagtaagcaatcattttacgagtatttattatgtgtcagcggcagtgctattcagctgtatagaggatcattaaatactcacatcaaccctatgaggataaagcctatttattcccatttttacacaaggaacctctaggggaagttaagttcctggcccaagtgatgaagccaggatttggaacttgctcagttgatctcactccaaagtccatgctctcaaaagtaagcccaaccgtgaaaatgtaaaatgtagaaagggtttatgtattctcgtgtatttaaggcatttaatgcctcaagagaagaaaagtctgacactgatgaaataacctccactattgccttctgcctttccaacagggatgatagatgagctcaaacagggagcttttcccctccttttccacagtatctcaacatcttaactcagcatctcaaaaacatacaggctgctgtgagctgatatatgtcatggtgcctttaaaaagaatgttttaagcattccttaggtaatgaagtgtctgtaataacttgctatcagaagacaatgaacctaagctttgctgtcagacataaaatgtaacaagcactttctgcatgccaagcactgtgtgaagagccctgcatacattgttttatttaattttcacaagaattgtacaacttagaaacttcacattttacagatgagggaactggggtccagtgaggtccagcttgtcaacaaccaaggtggggtttggagggacttgaaactcaattggactgacagcgaaatccctaatcataactacccactagtctgaatgctagggccccagcctcctcagcacatgaagcacctggaagggactgtagacaagatctctgggtctgacgtctgggtttgctaggttggagtatgtcccaggtcagcagtggctcaagcggcccttggatatttaggaacaatggggtcagggctgggggagagggttgggggggacggctgttgaaagaaattattggggtaggccacgcatggtggctcatgcctgtaatcccagcactttgggaggccgaggcgggcggatcacaaggtcaggagatcgagaccatcctggctaacacggtgaaactccatctctactaaaaacacaaaaaattagctgggcatggtggcaggcacctgtagtcccagctactcaggaggctgaggcaggagaatggcatgaacccgggaggcagaggttggaatgagccaagatcacaccactgcactccagcctgggcaacagagccagactccgtctcaaaaaaacaaaacaaacaaaaacagaaattactggggccacaggaggacctgaggcctgactagactacatgtgagtaccaaccttactggaagacttttcactgggttctgaaccaactcaatggccctgggaataatccctttaaccaagtagaagtgagggtggggacaattctaaagggctgggcagcagggagtggcaccggcactgaaggaaggtctggactcagcatcccacgctctgcactcaaaggctggctggattctggcaacccctgatttgtttagtgattactccaattattattgagagtctagaaaaaaattttgagttgtcatcataacatacacaagagaattattttctgatagaaagtatggcatacaaatacccttttatatcatagaatgacttgaaaactagtctcttgctaccttcggctgtgcatgttccgttatttaaaaactttgtccctggatgaagacattccaaactcttttgttgacagtatgttgggaagcttctcctgttagttgcacacactgcagtgccattctttgggcactgatacggtagtttacaaacacaggtgccctcaatgcatctctgccatggctggcagaagactttatcgcaggagaggtgagtatatttttttgctaagcactttttctccaccagatcctcttgagatgtataagtgacctgtaaaatgcaaaataaacattaacttagcaacaaattaaagactcctgtttgaagatgagtaagtgaaggaaaagagcaaaacagatacagcccacagtacagatgaggatggtgttgtctggtggcttcaagaatcagaaataatgccgcatatctacaaccatctgatctttgacaaacttgacaaaaacaagaaatggggaaaggattccctatttgataaatggtgctgggaaaactggctagacatatggagaaagctgaaactggatcccttccttacaccttatacagaaattaattcaagatggattaaagacttacatgttagacctaaaaccataaaaaccctagaagaaaacctaggcaataccattcaggacataggcatgggcaaggacttcatgtctaaaataccaaaagcaatggcaacaaaagccaaaattgacaaatgggatctaattaaactaaagagcttctgcacagcaaaagaaaccaccatcagagtgaataggcaacccacagaatgggagaaaatttttgcaatctactcatctgacaaagggctaatatccagaatctacaatgaactcaaacaaatttacaagaaaaaaacaaacaaccccatcaaaaagtgggcaaaggatatgaacagacatttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcgggaaataacaggtgctggagaggatgtggagcaataggaacacttttacactgttggtgggactgtaaactagttcaaccattgtggaagtcagtgtggcgattcctcagggatctagaactagaaataccatttgacccagccatcccattactgggcatatacccaaaggattataaatcatgctgctataaagacacatgcacacgtatgtttattgcggcactattcacaatagcaaagacttggaaccaacccaaatgtccatcaatgatagaccagattaagaaaatgtggcatatatacaccatggaatactatgcagccataaaaaatgatgagttcatgtcctttgtagggacatggatgaagctggaaaccatcattctcagcaaactattgcaaggacaaaaaaccaaacaccacatcgtctcactcataggtgggaattgaacaatgagaacacatggacacaggaaggggaacatcacacactggggcctgttgtggggtggggggaggggggaaggatagcatttggagatatacctaatgttaaatgacgagttactgggtgcagcacaccaacatggcacgtgtatgcatatgtaactaacctgcacattgtgcacatgcacctaaaacttaaagtacaaaaaaaaaaaaaaaaaagaatggtatgactgccatcttgaccatgaagaaatcctaaaaaaaaaaaaaaaaaaagaaaaaaagaatcagacaaacctggcttctagacccagttttggcacttactgttacatgatgcagggcaagtgaccctcctgaaacgtgaatttcctcatcgtaaaatgagataatatctcctattttgcaagattagaaatactatgtttgtaatggttgacaggtactaggcataaaattaatgagagctattattaccctgcaggactccagtagaaataatatgagggctgggaacaggccaattgggccaaaagccaatctgcgaagaaaagccaatgctgtctccctgtcccccagagcttcctcctgaggatgcgcctcctgtcctctagtctcccctgctgcccgcagtgagccccgctccttcctcagtgccctgtagctgtgaagcatcaagctggggcagacaaaaatcatagtctttaaatgccgttaagaaggcaaataagctaattaaaaccatgcaaaaccttgcaaggattgtcaaagtcattctccataatttgcttttcaataaactgtacaaatagctttacacacacacacacacaaatgacaaattggtcattctggaaactggcttttgacacagtgatctagaatgaaatatgccagttacgcacttttcatggttccacgtatctctttttggcacttattagagttggaatttttgtaataatttctctcctgtatcttccactgaccagcttgcaagtgtcctgacagcaggttttatttatcacctttatattgaaacaatgatgctctcattggatgagaaatccaagcaacttgatttttttctacctttattcctttaaatcatttctgaaatctcattcctccttgatctttggatagaaactttggcaagtgtcataactttctcagtcactcttagatttaaacaaaaacaaaaaattaaaggatgtttagttccaggaatagtcactaaatagcaatgacaatgtctagtgctgtggaaccactgaagctctgaccttcatgtcagatgaaagcctctccttcctctcagctcagacttgcttccagggtgtgtgatgggtcctttctgagctctcctccattccacagctttcaggtcatgctttccacctctcaggagaggaagagagggacagcagccgggtctcacctgattcttacggctgagaactagccttggcaaggtgggggttagagccaactctctcatgcggggtactatgaggttctctagagattgcactactggggacatttgatgtcaattcactcaatgctggcagtacctctcctccagctggctgctcatggtccatgtcttctcagctccagtatccaacagtactagcccgtttctgctgaggttgcttacctttggcagggagcctcttgggcaggagtcctgtttccctcctgaggacccacacctgtctgttgcctgccctgctgcctaccattgaaacagggcttgctccaacacagccacctcttttatctctgccaccaggcacctccagccttgggtccttattcctttcaggtatgggtcaagtactagttcttttttctcctcagacttcagggaacacatgtcaagcactccaagggaacctgtgggaagccctttcacaatgaagagaagcggcagcaccttccatcctctttgcctggggtgcaggtgggagatggaagggaaaacgctacctcactctgttacataaaattacgggaagccatttttttaaactgtactcctgcaccaagccccaaagaccaaaccaaaatggagtcacttatgctaagtggcatgtaattaaactgaaactttaaggaaatgggaaaccacacattggtgagttgaggctggaatgggaggtgaggaagtggaagtagaagcttgactggttttgactaggcacagtggctcacgcctgtaatcccagcactttgggaggctgaggtgggaggatcagttgaggtcgggagtttgagaccaacctggctaacatggcaaaaccccatctctactaaaaatacaaaaattagccaggcatgatggcacctgtaatcccagctcctcaggaggctgaggtaggagaatcacttgaacccgggaggtggagtttgcagtgagcggagaccgcaccactgcactccaacctggatgacagagcgagactccatctctaaaaaaaaaaaaagaaaaaaaaagaaaccgctttactggttttgccatttagacatgaaaatatgaacacagaccagaaaaaaaaaaaaaaaaaagaaagtctctgtctcctctccaagctctgttaaattgagaatacaggaatttttttaaagggcataaaccataaggtcaaagagagtggggagaggactgcaggatataagatatcaaaatgttggaagctggaaaacagatgggctagtgctaatggatttagcagatcaaggagaactgaaagctaagccccacagaaccccagaaaagcttaggaactgggggacctagtacctctgaagaaggagtggctaacaaacagggaactggttgaaagagatggttgtatgaacatgttactgaggaatctgttgtaaacagcagaagaaacagcaaagatttgaaagtgcttgcccctggagagagagttaggggtgggagacgggtgataggagtgcttttcattttaagtaagatctgatgtccttatgctttcagtagggaagtagaagattagggccaggcgcagtggctcattcctgtaatcccagcactttgggaggctgaggccagcggatcatgaggtcaggagttcgagaccagccaggccagcatggtgaaaccccaactctactcaaaatacaaaaaaaataaaaaataaataaaaaaaattagccaggcaggctgtgcatggtggctcatgcctatcatcccagcactttgggatgctgaggcaggcagattgcctgaggtcagcagttcgagaccattctggccaacatgatgaaaccccatctctactaaaaataaaaaaaaaaatcagctaggcaggctgtgcacagtggctcatgcctataatcccagcactttgggatgctgaggcaggcagattgcctgaggtcagcagtttgagaccattctggccaacatgatgaaaccccatctctactaaaaatacaaaaaaaaaaaaaattagccgggcgtagtggtgtgtgcctgtaatcccagctactcaggaggctgaggcaggggaattgcttgaaccaaggaggtggaggttgcagtgagccgagatcgcaccagtgcactccagcctgggcaacacagcaagactccatcaccaaaaaaaaaaaaaaaaaaaaaaaaaaaaaagtagaagattaagtgctaggctctgaagcaggagaacatttgatgggatagtagcataaagggccacggagtaaagagagatttttgttttcattaggataaaagggatttcatcatggttataggctaaggggaggaatttaacaaaacaggagagattgcattttcaagaaggagagagagggggaaattgttgaaacaaggttgaggaggggataggagaagcaatcagagcacggtgaagttcaccttagaaattaagcagtttgctatacttataatttcctattgtaaattggaagcaactttatgataacattaccattttaaatttcagatggatggtaaaggataacacgaacacagtggctgttaacaagggcaacattaatcaacggagagacagaaaatcactgttgaaaaatagctgggcatagtaagaatatggtttatttatacactgtctaaaacgtgatgacagtagctttaatttaaaagaattggtaagtcacatgtatctcaacgtctagaacagtggttgccaaaatatgagctgatgatctttgaggatgttattaaagaggtttgtaaatgcatgtgtacaccaggctttgcctgaagacaaaatataaacgatgtgagtatgcctcatatgtctatgtacacctgtgttttgaatatatgtaaatgctattatggttaataagaaaaattatttaaatcaccattgaaactatagttactgtcatttctgtgtctcccagaataacagattaaaataacaactactattatgtgtgtttttggtggtataagatggagtggtgaatttgatcgttttttttttttcttgagacagagtctcactgtgttgcctaagctggagtgcagtggtatgatcacagctcactgtaatcctaaactcataggctcaagtgatcatcctgcctcagtctcctgagtagctaggacagacacatgctaccatgcccagttaatttttattttaaaaatatttttgtagagatggggcctcactatgttgcccaggctggtcttaaactcttggccttaaacaatcctcccatctcagcctcccaacatgctgggattacagatgtgtgccaccctgcctaacctgagagtcttttaatgtttagttttgtggtaaacattaatactgcttactaaaatcgtattttcctctacttctgggaaaatagaaagattgcattttccccttgaggttgggcatggtgatttcctttggccagtgaaatgtaagctgaaataatttgttgggttcagagagaagcatttaattgccagtgctcaacaacccaactttctcttcctgtgtcatgtgatcatgggaacacaaattgtagcgataccatagaatcaaagtagcctagaatgcagggccaacacatgtaacatgggttccctacagagtcacccagacccacagtaggctttgcatgaacaaaacataaacttttgccaggcgcagtggcttacgcctgtaatcccagcactttgggaggctgaggcaggtggatcacaaagtcaggagatagagaccatcctggccaacatggtctctactaaaaatacaaaaattagcggggcatggtggcgtgtgcatgtaatcccagctactcaggaggctgaggcaggagaatcgcttgaacctgggaggcagaggttgcagtgagccgagatcgcgccactgcactccagcctggcgacagagtaagattccgtctcaaaaacaaacaaacataaattgttgtgttttagccactgagagttggggattggttcttactggtgcacaacatagcctatatggatgatacactctttataattcaaaccctcgagaactactggtgtagggagtatgggacttaaatcattctgtgggtgggaggtatgttaaataagttttttctcatttttactgggttggctgttaagagctgaaataggagactatcaaacacatggatcaggtattcctgactgtggccccagactagttgcaccaaaaccacctgaggcgcatcatcctacaaatgcagatttttggacccgaacaatagaccttcttaatcggaatctctgggacagatcttggattctgcactgtaaacaagctccataaatattcttatgtgtccccaaaactgaaaaccactattgtagcccagtaatttccaaagtggcttattcacatcttgggatatatgaaagaatcagtggaatgtggaaaaaatatcagaaattttattgatttatatgttttatttagaaagtagtaagaaaaaaatctttactaatatttaaacatagattatcacttgggcctatattcatacaatatttattgagagcctactatggccagtcactgttgtaagtcctggagatacaagagtgagcaggacaaagtcatagagtttacattctagtaggcaagacagacaaaaatgaataaacagtaaatatataagatgacataaggtgataaatgctatgtagggtaagaaagatacagaatatggagagtgaggggagaattgctgtttttatagggttgtcagagaagattttggagaaaaccttcccttggactaggaacctgaaggtgagggagcaagctatgcagctctctaggggtgatgtatcatggtcagaggagatagcaagggcaagagctctggggaagtgtatgtggtacattcttggtcaaaggggccagtgtgggtggatgggaataagtaacagggggaataggaggagatcaggtcacagaattggaggagtgggtgacagatcttgtaggaacctgttggctactgtaaagactggcttatactctgaatgaatcataaagcccttggagggtgtaaaccctccagtgtgtagaggttgagcagatgctgcagaactagtaaaggagactgagaatatgtggtcagtgaagcaaaaggcaaataaattgcagatggcacaaaagcaataaaaaaggaatgacagtttcatttagttctgctctgatcttggttacttcctttcttctgctgggtttgcatatagtttgttcttatttctctagttccttgaggtgtgatcttagaatgtcaatttgtgctctttcagtctttttgatgtaggcatttagggttatgaactttcttcttagcactgcctttcctgtatcccagaggttttggtgggttgtgtcattattgtcattcagttcaaagaatttttaaatttccaacttgaggaggttccaatatggccaaataggaacagctccagtctgcagctcccagtgtgagcgacgcagaagacgggtgatttctgcatttccaactaaggtaccaagttcatctcactggggcttgtcagacagtgggtacagcccatggagcagggtggggcatcgcctcacccgggaagtgcaaggggtcagggaattcccttttccagcaaagggaagcagtgacagatggtacctggaaaattgggacactcccaccctaatgctgcacttttccaatggcctaagcaaacggcacaccaggagattatatcccgtgcctggctcggagggtcccacacccacggagccccactcattgctagcacagcagtctgagatcaaactgcaaggtggcagcaaggctgggggaggggcgtctgccattgctgaggcttgagtaggtaaacaaagcatcctggaagctctaactgggtggagcccaccacagctcaaggaggcctgcctgcctctgtagactccacctctgggggcagggcatagctgaacaaaaggcagcagaaacttctgcagacttaaatgtccctgtctgacagctttgaagagagtagtggttctcccagcatggagtttgagatctgagaatggacagactgcctcaagtgggttcatgacccccgagtagcctaaatgggagacacctcccagtaggagctgactgacacctcatacagccgagtgcccctctgagacgaagcttccagaggaagcaacatttgctgttctgaaatatttgctggtctgtagcctccactggtgatacccaggcaaacagggtctgtagtggacctccagcaaactccaacacacctgcagctgagggtcctgactgttagaaggaaaactaacaaacaaggacatccacaccaaaaccccatctgtacgtcaccatcatcaaagaccaaaggcagataaaaccacaaagatggggagaaaccagagaagaaaagctgaaaattctaaaaatcagagcacctcttctccttgccagcaacggaacaaagctggatggagaatgattttgacaagttgagagaagaaggcttcagacaatcagtaataacaaacttctccaagctaaaggaggatgttcgaacccatcgcaaagaagctaaaaaccttgaaaaaagattagatgaatggctaactagaataaccagtgtagagaagtccttaaatgacctgatggagctgaaaaccatggcacaagaactatttgatgcatgcacaagcttcagtagccaatttgatcaagtggaagaaagggtatcaatgattgaagatcaaatgaatgaaatgaagcgagaagagacgtttagagaaaaaagagtaaaaagaaatgaacaaagcctccaagaaatatgggactatgtgaaaagaacaaatctacatctgattgatgtacctgaaagtgacgaggagaatggaaccaagctggaaaacactcttcaggatattacccaggagaacttccccaacctagcaaggcaggccaacattcaaattcaggaaatacagagaatgccacaaagatactcctcgagaagagcaacagcaagacatataattgtcagattcaccaaagttgaaatgaaggaaaaaatattaagggcagccagagagaaaggtggggttacccacaaagggaagcccatcagactaacagcggatctctccgcagaaactctacaagccagaagagagtgggagccaatattcaacattcttaaagaaaagaattttcaacccagaatttcatatcaagacaaactaagcttcataagtgaaggagaaataaaatcctttacagacaaacaaatgctgagagattttgtcaccatcaggcctgccttacaagagctcctgaaggaaacactaaacatggaaaggaacaaccagtaccagccactgcaaaaacatgccaaattgtaaagaccatcaaggctaggaagaaactgcatcaactaacgagcaaaataaccagctaacatcataatgacaggatcagattcacacataacaatactaaccttaaaggtaaatgggctaaatgctcgaattaaaagacacagactggcaaattggataaagagtcaagacccatcagtgtgctgtattcgggaaacgcatctatgtgtgcagagacacacataggctcaaaataaagggatggaggaagatctaccaagaaaatggaaaacaaaacaaaacaaaaaggcaggggttgcaatcctagtctcggataaaacagactttaaaccaacaaagatcaaaagagacaaagaaagtcattacatattggtaaagggatcgattcaacaagaagagctaactatcctgaatatatatgtacccaatacaggaacacccagattcataaagcaagtccttagagacctacaaagagacttagactcccacacaataataatgggagactttaacaccccactgtcaacattagacagatcaatgagacagaaagttaacaaggatatccaggaattgaactcagctctgcaccaagcagacctaatagacatcgacagaactctccataccaaatcaacagaatatacattcttctcagcaccacatcacacttattccaaaactgaccacatagttggaagtaaagcactcctcagcaaatgtaaaagaacagaaattataacaaactgtctctcagaccacagtgcaatcaaactagaactcaggattaagaaactcactcaaaaccactcaactacacggaaactgaacaacctgctcccgaatgactactgggtacataacgaaatgaaggcagaaataaagatgttctttgaaaccaatgagaacaaagacacaacataccagaatctctgggacacatttaaagcagtgtgtagagcgaaatttatagcactaaatgcccacaagagaaagcaggaaagatctaaaattgacaccctaaaatcacaattaaaagaactagagaagcaagagcaaacacattcaaaagctagcagaaggcaagaaataactaagatcagagcagaactgaaggagatacggacacaaaaaacccttcaaaaaatcaatgaatccaggagatggttttttgaaaagatcaacaaaattgctagactgctagcaagactaataaagaagaaaagagaagaatcaaatagatgcaataaaaaatgataaaggggatatcaccaccgatcccacagaaatacaaactaccatcagagaatactataaacacctctatgcaaataaactagaaaatctagaagaaatggataaattcctggacacatacaccctcccaagactaaactacaaagaggttgaatccctgaatagaccaataagaggttctgaaattgaggcaataattaatagcctaccaaccaaaaagagtccaggaccagacagattcacagccaaattctaccagaggtacaaagaagagctggtaccattccttctgaaactattctaatcaatagaaaaagagggaatcctccctaattcattttatgaggccaacatcatcctgataccaaagcctggcagagacacaacaaaaaaaaagaatcttagaccaatatccctgaggaatactgatgcaaaaatcctcaataaaatactggcaaaccgaatccagcagcacatcaaaaagcttatccattatgatcaagttggcttcatccctgggatgcaaggctggtttaacatatgcaaatcaataaacgtaatccatcatataaacagaaccaaagacaaaaaactacatgattatctcaatagatgcagaaaaggccttcgacaaaattcaacagcccttcatgataaaaactctcaataaactaggtattgatgggacgtatctcaaaataataagagctatttatgacaaacccacagccaatatcatactgaatgagcaaaaactggaagcattccctttgaaaactggcacaagacagggatgccctctctcaccactcctattcaacatagtgttggaagttctgaacagggcaatcaggcaagagaaagaaataaagggtattcaattaggaaaagagtaagtcaaattgtccctgtttgcagatgacatgattgtatatttagaaaaccccatcgtctcagcccgaaatctccttaagctgataagcaatttcagcaaagtctcaggatacaaaatcaatgtgcaaaaatcaccagcattcctatacaccaagaacagacgcacagagagccaaatcatgagtgaactcccattcacaattgcttcaaagagaataaaatacctaggaatccaacttacaagggatgtcaaggacctcttcaaggagaactacaaaccactgctcaacgaaataaaagaggacaaaaacaaatggaggaacattccatgctcatggagaggaagaatcaatattgtgaaaatggccatactacccaaggtaatttatagattcaatgccatccccatcaagctaccaatgactttcttcacagaattggaaaaaactactttaaagttcatatggaaccaaaaaagagcccacattgccaagacaatcctaagccaaaagaagaaagctggaggcatcatgtgacctgacttcaaactatactacaagtctacagtaaccaaaacagcacagtactggtaccaaaacagagacatagaccaatccaacagaacagaggcctcagaaataatactacacatcaacaaccatctgatctttgacaaacctgacaacaagaaatggggaaaggattccctatttaataaatggtgctgggaaaactggctagccataagtagaaagctgaaactggatcccttccttataaggtgtatatttacaccttataaaaaattaattcaagatggattaaagatttaaatgttagacctaaaaccataaaaaccctagaagaaaacgcaggcaacaccattcaggccataggcatgggcaaggacttcatgactaaaacaccaaaaagcaatggcaacaaaagccaaaattgacaaatgggatctaattaaattaaagagcttctgcacaggaaaagaaactaccatcagagtgaacaggcaacctacagaatgggagaaaatttttgcaatctacccatctgacgacaggctaatatctggactctacaaagaactcaaacaaatttacaagaaaaaataaaaaaaccccatcaaaaagtggtcgaaggatatgaagagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaagcaacaggtgctggagaggatatggagaaataggaacgcttttacattgttggtgggactataaagtagttcaaccattgtggaagacagtgtggcgattcctcacagatctagaactggaaataccatttgacccagccatcccattactgggcatatacccaaagaattataaatcatgctgatataaagacacatgcacacgtatgtttattgcggcactattcacaatagcaaagacttggaatcaacccaactgtccatcaatgatagactggattaagaaaacgtggaacatatacaccatggaatactatgcagccataaaaattgatgagttcatgtcctttgtagggacatggatgaagctagaaaccatcattctgagcaaactatcacaaggacagaaaaccaaacaccgcatgttctcactcacaggtgggaattgaacaatgaaaacacttggacacagggtggggaacatcacacactggggcctgtcatggggtcaggggagcggggagggatagcattaggagatatacctaatgtacatgacaagttaacgtgtgcagcacaccaacatggcacatgtatacatatgtaacaaaactgcacgttgtgcacatgcagcctagaacttaaagtataaaaaaaaatttccaacttgattttctttttgacccaatgaaattggaaaaaaaagttaaagataaatgaaacaagaagctggttctttaaaaatataaataaaattgatagaccattagcaagattaaccaagaaaagaagagaaaaaaattcaaataagctcgataagaaaggaaacaggagatactacaactgacaccactgaaatacaaaagatcattcaaggctactatgaacatctttacgcacataaactagactagaagagatggataaattcctggaaaaatacaacccttctagcttaaatgaggaagaattagataccctgaacagaccaataacaatcagccatattgaaatggtaattaaaaaattaccaatgaacaaaaggtccaggaccagacagattcacagcagaattctaccagacactcaaagaagaatttgtacctatccttttgacactattccacaagatagagaaagaaggaaccctccccaattcattctgtgaagccagcatcacccttataccaaacccaggaaaggacataaccaaaaaagaaaactacagactgatatctttgaagaacacagaagctaaaatccttaacaaaatactagctaaccaaatcgaacaacatatcaaaaagataatctaccatgatcaagtaggcttcataccagggatgcaggggtggtttaacatacacaagtcaataaatgtgatacacaacataagcagaatgaaaaaccaaagtcacatgatcacctcagtagatgcagaaaaagcattcgacaaaatctaacatcgctttaggattaaaactctcagcaaaatcggcatacaaggggcataccttaatgtaataaaagctatctatgacaaacccacagccaacatagtactgaatggggaaaagttgaaagcattccctctgagaactggaacaagacaaggatgcccactctcaccattcctcttcaacacagtattggaagtcctagccagagtaaacagacaagagaaataattttatttctttctctttatgggcatccaaaccggtaaagaggaagtcaaatggtcactttttgctgacataatgattgtttaccctgaaaaccctaaagactcctccagaaagctctagaactgatacaagaatttagtaaagtttctggatacaagattaatgtacacaaatcaatagctcttctatacaccaacagcgaccaagcacagaatcaaatcaagaactcaaccccttttacaatagctgcaaaaaaaaaaaaaatacttaggaatatacctaaccaaggagttgaaaaacttctacaaggaaaactacaaaacagtgctgaaagaaatcatagatgacaaaaacaaatggaaacacatcccatgctcatggatggatagaatcaatattgtgaaaatgcccataccgccaaaagaaatctacaaattcaatgcaatccaaataccaaaataccaccatcacttttcacagaattagaaaaaaaaattctaaaattcatatggaaccaaaaaaagagcccacatagccaaagcaagactaagcaaaaagagcaaatctggaagcatcacactacctgatttcaaactatactataaggccatagtcaccaaaacagtgtcgtactggtataaaaataggcacataaaccaatgaaacagaataagaacccagaaataaacccaaatacttacagccaactgatcttcgacaaagcaagcaaaaacataaagtggcgaaaggacacccttttcaacaaatggtactgggataattggctagccacatgtaggagaatgaaagtggattctcatctctcaccttatacaaaaatcaactcaagatggattaaggacttaaacctaagacctgaaagtataaaaattctagaagataacattggaaaaacccttctagacataggcttaggcaaggatttcatgaccaagaacccaaaagcaaatgcaataaaaacaaagataaatagctgggacttaattaaactaaagaacctttgcacagcaaaaggaacagtcagcagagtaaacagacaacccatagggtgtgagaaaatcttcacaatctttacatctgaaaaaagactaacatccataatctacaatgaactcatacaaatcagtaagaaaaaacaatcccatcaaaaaatgggctagggacatggatagacaattttcaaaagaagatatacaaatggccaacaaacatatgaaaaaatgctcaacatcactaatgaccagggaaatgcaaatcaaaaccacaatgtgataccaccttactcctgcaagaatggccataataaaaaaataaaaaaatagtagatgttggtgtggatgtggtgatcagggaacacttctacactgctggtgggaatgtaaagtagtgcagccactgtggaaaacagtgtggagattccttaaaggactaaaagtagaactaccatcagattcagcaatcccgctactgggtatctactcagaggaaaataagttattattctgaaaagatacttgcacatgcatgtttatggccgcacaatttacaattgcaaaatcgcagagccaatccaaatgcccaccattcaatgagtggataaagaaactgtgatatatatatatatatatatatgatggaatactactcagccataaaaaggaatgaattaacagcatttgcagtgacctggatgagattggagactattgttctaagtgaagtaactcaggaatggaaaaccaaatatcgtacgttctcactgatatgtggaagctaagttatgagaacccaaagacataagaataataaaatgaactttggagacttggagggaagagtgggagggaggcaagggataaaagactacaaatatggtgcagtgtatactgctcgggtgatgggtgcaccaaaatctcacaaatcaccactaaagaacttgctcatgtaaccaaataccacctgtaccctaataactaatggaaaaataaaaaaataaataaaaagaagtgatgaacaactgtgttaaatacttccccattgtgactttgacaaatgtaattttagtggaatggggaaaaccaagcctaattacattcaagaaagaatagaaagagggaaataagcataacaaatttttaagagtttagatgtgaaggggcacagtttagagaaatggggtgatagttggaggagggtatagggttaaaggagagtttttcttttaagatagagaatcatatacatgcgcttgattaaggaattttatgtgatctagttttagctaaattaatcctcacaaactgacaagtgatttaaagagattcttgttgatagatgaatcctggattaaaaacaatgccaaaatacaacaccaatgaaaaacaaaaaatgtcagagtctacacttctagcatcagtagaagctgttcattagccacattatgagaagaaaaaataatgaaaagctaatcagatatgacaagaagtcagttctttctctccatcagcagtactaaaaagactacttgaaatacagacttacatctaacacattaatgatgaacctcctcctatgtatttactgtgcatgttgctctttctcaagtatcttttgtcaggcctctgagcccaagctaagccatcatatctcctgtgacctgcacgtatacatccagatggcctgaagcaactgaaagaaccacaaaagatgacattccaccattgtgatctgttcctgccccactctaaccggtcaattgaccttatgacaatacaccctccccacccttgcgataatgtactttgtgatattcacccccgcaagaagctactttgtaatattctccccacccttgagaatgtactttgtgagatccaccccctgcccacaaattgctcctaactccactgtctgtcccaaacctataagaactaatgataatctcaccaccctttgctgactctcttttcggactcagcccgcctgcacccaggtgattaaaaagctttattgctcacacaaagcctgtttggtggtctcttcacacagacacacgtgacatctttcccagccaatatgttattaaaataaagtgaaaaattttaaaaataatgaagtgtgattaatggcattattccatgaaagagtagtagtcaaaattgttgttaaaatattatctttgtgttgaaaattttgtttgttttaagatgcatttctttgtacagcagtgcacttattatttatatataaatacattcacatatattaggagcacatattcagaaatttatttacttatatttttgctccccacccacacttttttgctctccacccgccctccccaaaatctttttaacaattattaatcagcctggtgatctacaaaacatgattccatctcctctagctgctgctgcttctctgtgtatatgggtgatatggttaggctttgtgtccccacccaaatctcatcttgaattataatccccataatccccataattctgtgtcaagggagagaccaagtggaggtaattaaatcatgggggcggtttcacctatgctgttcttgtaatagcgagtgaattcttacaagacctgatggtttcataaggggctcttcctccttcacttaatacttcctcctgccgctttgtgagaaggtgccttgcttcctcttcatcttccatcatgattgtgagtttcctgaggcctccccagccatgctgaactgtgagtcaattaaacctctttcctttataaattacctagtcttgggcagttctttatagcagtatgaaaatggactaatacaatgggcttttaaaaaattctttaaaaaaaaaacaaaaaaaaccaaagtctagctctgagagtgagtgcagtgacaatttcagctcactgcaacttctgtctcctgggttcaagcaattcttctgcctcaacctcctgtgtagctgggattacaagtgcctgccaccatgcccggctaatttttgtgtttttagtagagatgctgtttcaccataatggccaggctggtctcgaactcctgacctccattaatccactcgcctcagcctcccaaaatgctgggattacaggcatgagccaccacatccagcctaaaaattatttctttggtatttgcagtgacatagcaattatttttatgtaaactttatcttttttttctctaggcaggagaccagtgaaacaattttagatggtcgttcattagaacacaaacaagaaataaaacaacctcctttttctagaccttattaacccagtatatagctatatgccttatcctcaagtttcttcattgccctgttttgcctgtcttttccatatttaacctataaacaagaaaaacacatgatcagttatgattaaagcaaggaaaagtccacccctttccctttcttctgggtactattggaatgttccccttctattgctaattagctgtgtgatcttggataagtgactttatccttctgatcctgttcctcttctataaaatgtggaaaataaaaataatgttcacacagagatagtgtgaggatcagatgaaaaatacatgggaaacacaaataaacattgaagatctgtataaatgtgaatatgataatgattttggtagactgcctatagcccctccttgttctatcctcatttcaccctagttctttactgtatgctttaccgggcacagggtgtattaccctgttctttgaaagatgcttggaaagtacttgtgcaactgggtttgtccttgtgtttctctgaatagctaggagaagagcatgaccaggctagcacagacataaaaagaagaaccagcccttctgagcccagtataggccagctgactccccactgacctacagacttgtatacctaataaagttgtataccactgagattatgtagtgcttttattattatggcattaaccaactggtacaatgatgatttccctggaaatcactgagaaaaacaattggaaaactttcaaaaacagccaactatataactgttgtctttcttccagaagtgaataagcaacttggatcccaagagttaacaaccacatcagaaacctttccattgaaagagttttaggccccctgtggccttagttattcccatcatggtctttactagcaatttttcttccacttttttctctccttggagctgcccgttttgcattgtacctgggagcagccctgcttttgacataaagtgatgccacagatgccccacaaactccttaacagcaaccattctattcagattaaaaaatagggagagaatgtttctctggtaatacctaacaatgaattgttccaattcacataagaaatttgataaggtcttttgttttttttttaattttaaaaataaatattcatcttttttccagaatcagaatgttgttgggaattgtgggaagatgactgtatgctgtggtcaggtaggatggcttcttgtgtgctaatttttagtctctctaaaaaactggaaatattgttttggggtcaactccattatttttgtcttagagattaaaaagaaaatcatctgtctagttttctggtcttgtttttttcataatgaatgtaagatggctaaaattttgtctattttttaaatttttaatagatttttttgaataggaaacagagagaattgttcaaacaggttcaaaaatgtgcctgtaaaagttatgtttccttcctttccttatcctctcaatccactcaggccccacttcagaggcaaccacttaacagctctttgtgagtctttccagagatcatgaatgtatacatgagcccatgttactctccaatctgtgccccaacatcagtgcatttgtaactagtggccctataatcagcccgcaaagggcagttagatagtttctaatgttttactattataaataatgctatgatgaatctccttatataatacacatcatttctcacatatgctaagtatatctgccagatacttccctggaagtgaaattgctgaatcaaaggaatgagtaattttaatatccagaaagatattggctaattttgctctacagaggttgttttaaattgcattcccatcatcaatatatgagaatatctagtttccatactcttgattacagagtatatattatgtttccacagcacacttttacttgcatttttttctgagtgaagttgagcatcttccgtatgctcaaattttaagagagatttttacttctttctttacatcctaaccatatctttcagtgatatagattttttcttgttttttgtagtaactctttatatattaaagaaaccagcactttatctggaatatgaattgcaaaactaatggcaagtttagtgtatttgtcccacagcacagacacttttaaaacacccccatataagaaaattatttttagtaaaaatcatgaaatgaaaggaataatgaattatgaagaaaatgcaaagtgaacatttttaaatggaaattcagatatataatcaaatctgtaaaaaatttaaaaagtaaatttaaaatacatattacagtacaaacagcatccaacaaggcaaaattaataatatttgacatttaatacaaaatagtaggcatcagagaagtcataaaatatgacccatgatgaggagaaaaaacaggcaattgaaacttacccagaattctaaaacaggtgttaacattactaggcaaggagatttaaaaagttattttaactgtattccacatgttcaaaaataaagacacagatgatatgaaaaggatccaaattgaacttctagggataaaaactacaatacacttgatggaaccaaagccaaaccagatatgcagaagaaaagactgggaaacttaaagacatatcaatggaaactacaataaaattttaaaaaataaaaaaattaaagaatagagtataaatgaactgtggggcaacttcaagtagcctagtacatatgtaattggagcctccaaaaaagaggacaaaatgagggaacaaaaaacatatttgaagaaataatggctgaaatttatccaaatttgagaacaaatgaggaatgaaccccaagcaggagaatcatgaaggaaattgcaccaaaccatgtcacactcaaattacttggaaaccaataactaagagaaaatcttcaaaagagtcaaggaaaaaagacactatgtacagagaaacgaagataagtatgacatttctcatcaataatgcaaatgcgaagacaatgcagcaacaattttaaagtactgaaagagaaaattggcaatctataattctatacccagtaaaaatatcattcaaaaatttaggcaaaagaacaacctttttagacacacaaaagctgaaggaattagcagcatacctgcagtacaagaaaaagcagaaggaaaattatcacagagggaaatctgatctatacaaataaattaaggatactggaaatctttgggagtttttgatttggtgggaagatagtcttcatctctgttttgcaatttttcttgtggtatctttgattttgctattatggtaatttattggcctcgcggaatgcataggaagtgttccctcctctttaccttttgaaagtgtttgagaaaaattagtgttaattctctttatatgtttggtagaattcacgagtgaagccatctggttacagatatttcttttttgggaaattttaaaattactgatttaatacttttacttgctataggtctgttcagattttctaattcttcttgaattagttttggtgatttgtgtgtttctaggaattcattaatatttctaggttatctaatttgctggcatataattgctcatagcattctcttatcattcttatttctgtaagatcagtagtaatacctccaatttcacttctgattttaggtatttgtatcttctctcttttttctttctcagtttagctaaggtctgacaattttgtggctatttccaaagaacgaacttgtgatttcattgattctattgtcttactatatattttttgtttctactctaatctttattctattttttcttctagctttgggtttagtttgctcttcctttttctaaagaagatatgcttcttaagttgtaaagttagattatcaatttgagatctttactcttttttaaaacttttaagttcagggtttgttttataggtaaatttgtgcaggtttgttatgtaggtaaactcgtgtcatgggggtttgttgtacagattattgtatcacccaggtattaagcctagtaaccattagttatttttcctgatgctcttcctcctcccagcctccatcttctaataggcccagtgtgtctgataggcccctctatgtgtctatgtgttctcataatttagcttccacttataaatgagaacatgtggtatttggttttctgtttctgcatttgtttactgaggaaatggcctctggctccatccatgttcctgcaaaagacatgatcttgttgatcttgttctcttttaggactgagtagtactccatggtgtatatgtaccacattttctttatccagtctaccattgatgggcatttaaggtgattccatgtctttgctattgtgaatagtgccgcaatgaacatatgtgtgcatgtgtctttatgatagaacaatttgtactcctttaggtatatacccagtaatgggattgctgggttgaatggaatttctctttttaggtctttgtggaattgccacactgtgttccacaatggttgagctaatttacactaccactaaatgtgtataagcattcctttttctccacaacctcgacagcatgttatttttttggactttttaatagtgccattctgactggtgtgagatggtatttcattgtggttttaatttgcatttatccagtgatcactgatgttgggctttttttcatatgattgctgctgcatataagtcttcttttgaaaagtatctgttcatgtcctttgtccactttttaatgggttgtttttttcttgtaaatttgtttaagttccttatagatactagatattagacctttgtcagatgcataatttgcaaacattttctcccatccgtagggtgtctgttcactctgctgataatttattttgctgtgcagaagctctttagtttaattagatcccatttgtcaatttttgctttgttgtgattgcttttggtgtcttcgtcatgaaatctttgctcattcctatgtccagaatagtattgcctaggttgtcttccagggttttcatagttttgggttttacatttaattctttaatctatcttgagttaatttttgtatatggtctaaagaaggggtccagtttcaattttctgcaattggctagccagttatcccagcatcatttattgaatagggagtcctttccccattgcttctttttgtcagatttgtagaagatcagatacttgtaagggtgcagccttatttctgggtcctctattcttttttaatgtaggcatttactgctatacatttatctttgataactgctttcgctgcatatcatatgttttggtatgttgtgttttgttttcatttatctccaagtattcacaattacccttgtgatttcttctttgaccattggttgcttaagaatatgttgtttaatttccacatatttgtagattttctaattttctttctgttattggtttccagccttattccactgtggttagagaagctactctgtataatttcaatatttgtaaaatttattaagactcattttgtgacaagtcctatacggtctatcttagaaattgttccatgtgcgcttgagaaaaatgtgtattctgctattattgagtgcagagttctatatatgtctagttattaggtctactgggcttatagtgttgttcaagttctccattccttattgaccttctattcattatagaaagtggagtattgaagcttccaactattattatattattatctatttctggtcaggcacagtgactcacgcctataatctcagcactttgggaggccaagggcagatcacctgaggtcaggagttcaagatcagcctgggcaacatggtgaaaccctgtctctactaaaaatacacaaattagccgggcgtggtggtgcactcctataatcccaaatacttgggaggctgaggcatgagaatcacttgaatcagctgcagtgagccgatatcatgccactgcattccagcctggatgactccatctcaaaaacaaaaacaaaaacaaaaacaaacccaccccccccaaaacaagaattgtctgtttctctcttttattctgtcacttttcattcatatcttttggggctctattgtttagtgtataatattcataattgttatatattcctgaagaattgaccctttcattaatatatcatgtaatttatctcttgtaacggtttttgacttaaggtctattttgtctggtattagtatagccactttagctcttttttgattgttatttgcacataatatcttttctatcctttatttctttggacctaaaggcagcctctttagacagcatatagttggataataattttaaaaaactgattctgccaatctctgccttttgatattagaatttaatccacttccatttaaagtaattgctgataagaaaggacttactcttctatttgctatttgtttattgtatgtcttataccttttttgtttctcattttctccattactgccctttttgtgtttagttgattttttcatattcaactatttcagttctctctttatttccttctgtgtatattttttagatattttctttttcggtactatggagattacaattaatagtgattaaatttatagtaatctagtttgaattgataacttggctttgagagcatacaaaactctgttcctatactgctccatccattcctttatgttgttattgtcatgttacatctttatacattgtgcactgttaacacagaattagaatcgttttatatagttgtcttttaactcatgtgggaaaggaaaagaagagatacaaaaccaaaataatataatactggcttttatatttacctatgtagttacctttactggagttctttatttcttcatattacttcaagtaactgccaaatgtcctttcactgcagtatgcagggttctctgacttgcactgtatttctttattttaatttaattttattttagagatgatctcactctgttgcccaggtttgaatgaagtggtgtagtcagagctcactgcagttttgaactcctgagctcaagtgattctcccacctcagcctcccgagtagctgagactacagatacatgccactacacctagctaattttattttttagagagatgggctcctgctgtgttttccaggatagtcttgaactcctgggcttaagcagtcctcctgcctcattcccctaaagtgctgggattataggcaatgagccaccacacccagctacttgtagtgcatttcctgtaggacaggtctattagtagctaactccttcagcctctatttatctgtgaatttcttcatttctccttcatttgtgaaggatagttttgccagatacagaattcttggttgacagttttttactttcaacaaataaaattttcatctgccctccatggtttctgatgagaaagctgctgctaatcttacggaatctcatgactatgttgttttcaagactttcttcatccttggttttgacaatttgattataatgtgtcttggtttgaacctttttgtgtttatccttcttggattgcattgagctttttgaatgtggacagccatgcatttgatcaaatgtggaaatttttcagccattatttcttcatatattctctcttactttcttattttctccttctggggttccattatatatattttggtatgctttatggtgtcacacgagtctcataggctctgttcattccttgtcatccttttttctttctgcttctcatactggataattaattaaatggactgatcttcaagtttgttgactatttcttctgcctgctcaaatcttctactgaaacctattagaaaatttttcatgtttgttattgtgcttttcaactccagaagttttgtctagttcctttttaaaatttctatttgttggccagtcacggtggctcatacctgtaatcccagcactttgggagggtgaggtgggtggatcacttgaggttcaggagttcaaaaccagcctggccaacatggtgaaaccccatctttactaaaaatacaaaaattagctgggtgtggtggtgggcacctgtaattccagctattcagggggctaaggcatgagaattgcttgaacctgggaggcagaggttgcagtgagccaagattgtgccactgcactccagcttgggtgacagagcaagactctgtctccaaaacaattctatttatttattaatattctatatttgtttatacattattatcagggtttcctgtagctctgagcacatttaagacagttgaagcgtgtgacattggcaagatggtggaacaaaatgtcccagcacttgtcttcccacagaaacaccaatgtaacaaccatctacaaataaaaatacctttatgagagctccaggatcaaggtgagaggttacagcatgcaagtggaacaaatatatgagaaaaaattgaaaggataagaaaataaatttcactttatagagttaccctttaccctacacagcatacacgatgctgaaagagattcctttggatcatgagctctcttgtgggggaaaaagagagcaaccctgctcctgggcactggcatcaagactgtctacccacacagtgacggtggcaccaggcctgcccgtggaccacagcaccgagcccactggtagacccaggcaccaggcccacccacacatggtctcaagcaacaagccgttcacacgggccttgccagctgacccacccagaatctctggctgactgatttgtgaaagactttttctgccaaagtcagtctgtgaagactgaaagaggtggctgcttcttcaaacatccagacattaatacaggttacaaggattatgaagaaaaaagacactatccaaggagcacataaagctccaataagtgactctaaagaattggagacctacaaattgcttgacaaagaattcaaagtaacatcttaaagaagctcaaagagctataaaaggacacagataaacaactacacaaaattaggggaaaataattcatgagcaaaatgagatattcaacaaacataaaccataaaaaagaaccaaagagaaattttggaggtgaaaataatacaataaaggaactgaaaaattcagtagagagctcatacaccatacttagtcaaacagaagagagaatcagtgaactcaaagacaggttatttgaaattatatggtcagaggaacaaaatgaaaaagtataaagactacaggacttgtgggataccctcaagccaacgaatgaatgcattatgttatttacagaaggagaagagaaagggaaaaggaaagaaagcttatttaaattaacaatgcctgaaaacatctcaaatctagggaaggaaatggacatctggattcatgaggaccaaaaggatcacaaagatatctaacctaaaaaggtctagactgagacacattataatcaaattctcaaatgtcaaagacaaaaagacaattttgaaagaacgagaaaagcaacttgtcatatacaaagaaaaccctataaaactatcagtggatttattcttcaaatttcttcttcttcagaaacactgcaggccaggaaagagtgggataatatattcaaagtgtcataacgaagaaacaaaaaaccccaaaaccactgccaaccaagaatattacacccagaaaaactatcctctaaaaatgaaagagagataaagactttccctaataaatcaaaacaggaaatacatcacctgccttacaagaaatgataaaaggttttattcaagttgaaatgaaaagatgataaacagcaacactaaagctgcaggatacaaaaacaacatacaaaaatcagtggtgtttctatacatcaataatgaactgtcctagaaagaattttaagaaaaccatctcaggccaggtgcagcagttcatgcctatttcccagtgctttgagaggccatggtgggaggatcctttgaggccaggagtttgagactagtctgggcaacatagcaaggtcccatcactacaaaaaataaaattagttggcatggtagtgcacacctttggtcatggttacttgagaggctggggtaggagggtagcttgagcacaggaggcgaagactgcagtgggctataatttgccattgcattcccacctgggcaacagtgcaaaaccctgtctttaacaaaacaaaacaatctcatttacaatagcagttaaaagaataaagcacttagaaataaatttaaccaacaaggtgaaaaactcataccctgaagactgtaaaacactgatgaaagaaattaaagtaggcacaaagaaatggcaagacaactcacattccttcactgaaagaattaatattgttaaatgtttatactattacaaataatctacagatttgatacaatccctaccaaaattgcaaaggcatttttttacagaaatagaaaatataattctaaaatttacatggaatttcaaaagacacaaaatagccaaaacaattttttgagcaagaagaacaaagccagaggcatcccacttcctgatttcaaaaaatatcacaaagctgcagtaatcaaaacaatatggtactctcataaaaacagacatatagattcatggaacaaagtagaaagttcagagataaaaccatgcatagatagtcaactgctcttcaacaagggagccaagaatatataatgggtgaagaatagtctttttaataagtggtaatgggaaaactggaaatccacatgcaaaaactgaaattggacccctatattaccccatacacacaaatcaactcaaaatggattaaagacttacacatacacctgaaatcataaaacttttagaataaaacataagtgataagcttcttgacattagtcttggcaataatatcttgactatgacgacaaaagcacaggcaacaaaagcaaaaacagacaagtgggactacctcaagctaaaaaccttctgcacagcaaaatgaaaagacaacatatacaatggaagaaatatttgcaaactatacatctggtaagaagttaatatctatctaaaatacatagggaattcctacaaatcaaaagccaagaaccaaatagtctactttaaaaagtggacaaaggagctgaatagacatttcttcaaataagatatgtaaatggtcaataggtacttgaaaaggtgtttaatatcactaaccattagggaaatttaaatcaaaatcacacaccagttaggatggttattgtcaaaataaccaaaggtaacaaatgtagctgaggatatgcagaaagggaaattcttctacagttgtggaagaattgataaagaaaatgtggtatatacatgcaatgaaatattatttggccttaaaaaagaaggaaatcctgccatttgtgacaatatggatgaacctagaggacattaatctaagtgaaacaaggcagggacaggaggataaataccacataatacaacttatattaggaatctaagatagtcaaactcatggaaccagagagtgggatggtggttgccaaggactgggtgagggggaaacagggaagtgttagtcaaaggtcaagatgtataattcttagagatctatgctacagaatagtgcctattgttcataatactgtattgtatacttaaaaatttgctaagagcacaatttctttgttaagagttgttacatgcacacacaaaataataaataaagagagtgagaggaaacttttagaagtggtgaatacgtttatggcatatgttgtgatattttcacagacatatactaatctccaaactcaaactcatcaagttatgtacactaaatatgtagagtttattatatgtcaatcataactcaataaagtgttttttttttttaaaaagaccattaagtctttgtttagtgagtccaaagtttgtggttcttctggaacagattatgttcatttcttctgtaaatggtccatactttctcatatctttgcatgcatcataatttttggttgaaaatttttggttgacactttgactcttacagtaactcttgaaatcagactcttccttctgcttggggtttgttttggttgcttggggtttgctttggttgcttggtgtttgtttgatgacttttctaaactacttttggcaagtctattctttatcacatgtggtctttgaagtctgttcctttgacttatattcagctagtatttagacagagatttccttcaatgcaagaggagggagagagagagagagaagaaaaagaaacccagaaaaacaaatcaaaatctcaaaatctctcccagtctttgcagattggttctgtcctgggcactcactcatccaggccatttgcaactctaccttagccttcacttcatacttgcactgaacttagacaaccaccagaggtgcaggctcagagtcttctgaggtctttctgagcatgtatcctgccctgagcatgtatggggcttcctaaactccccaatacacacaggcacttttgaatgccctaattttccataggatcttagtttttccccatgctttggtgctctgttgtgtgcctccactgtaatcctttgccccagacagctgagattgctcattaatcttgcaatgcctgtgctttgtaatattaatgcttttctgctctgagttctgagctaggtgaaaccaagacaagtgcctggggtctgtcctacaggaaggccttaggatagaaaagacaaacacattatttttgaataaggtcttctctgttctttccagtgctagggaaccgggtccctccctgagtgagaaacgtacatggtcagtgtttgctgcaccagagttaggagaatttcttccatattagatagacagatttatatactttcccatggaagattaagaaactgaaatctaagatacatgaagaaattgtaagtggaaaggccacttagtggttggtttacaacagtattataagtgatagggtgatagaagtgtggtaagtgattaggataatattctgcatagtaagagaaacagtttgtatttttagaagaaaattgctttaacatttgcaaactaaggtaatgagaatacagtgaatttcaaaatgtctttttaatgacaatgtgtgaacttgttttaataaaccaaaatttgttgttattgtgttaaggctattttatgtactcagatatccttcaagaccactgccaaattagggagggtatggggcaaggacacaaaggacagacacgcaaaatgctactaagctttcataccatttttagttgcctgttcctgcattcaacattttcttaggtgctataaacctttgactgttttccagagttctaaataaagttggttctgacagcttccctttggtttctgtagaaatggatttttggtttttggttttggtggatctgcctactctgccatttccgctgccatcacttgcactgcacaccctcctgtgtgccacccttgtttccaggatgttgtcattctgcttaacattaccccagttctttctctctaaaatgccacccatatgtgcctgagtttgtaataaaattttagggtaaaataaaatttagggtatcagttggtgattacgtcacagcacaattatggtaggtaatcatgttgactgaaatatttggcttctctgttttttttttttttttttttttttttttgagacaggatcttgctgtgtcacccaggctggaatacagtggcatgatcagagctccccgcagcctcaaactcctgggctcaagcaatcctcttgcctcagcctcccaaagtactgggattacatgcgtgaacccccacacctagtcagcttccttgttgttgaacatcctctggttattccccccattagaaggccccagcagccactcccactgtgctatgggtttcttttccatcttttctgaatcccctagtttccttgtctgagtaggttcagtaaaaccgaaaacagaaaatagaatcaccagtaatcttattagccaatgatagcaactattaactgtttgatacatacactgtaagatcttttagtcatatatataagtaggtataagtatgcatttatatatatgcatataaacacacatacatatgtgtgtgtgtgtttttcttcaataaaaataaaattgtagtaaggactttttatttagataaatatgtcatttcaatggctatgtaatagttcaattttggatatacaataatttaaccagtgtcttattaataagcatttagttatttccatttattctctattataaacattgcaatgatggcaactattttagaagttacaagaatcttaaagtgtgttttcttaagtagttttctttaaatattttcttctacaagctggcactaagacaagatagttttggattgccaccaaagttggcaatcatcaataagtatccaaaatattttaaacatttttcaccttaatagatgacactctaacttcaataaaatatgtcatttcagtttcgagttcctttgtagcccacaaagccttcattctgatcaaatggattcatttatttggaggggcctagtgcattgctgccttcctatggtagcacttgctgcttttcctggctaaagaagctggaaatcactcctctttctcaccactgatcacatgtaatacagaattaaacgttcagctcaaatcctacttgatctataatctcttcatgacctctcagcatgaagtgatttgtcctctcattgaagtcctttaccacatatttgtatcacttttgacaattaaatatatactgtcttgtaacttgcacttttgtgttttcagatgtttcaaatttgcttattatttcccctttctataactatagagcgtactaagaggctgttgaaggaagagatcagtctcactgtcttcgtagcactgtaccttacacacaggaggagcctggtaaatatttttgatttactacaattacagtaaatcacagccttgtattagtaaaattcttgttcagttcaatgcctctgcatatataagcacataaaaagaactatttttaaaaaatcacttttatcaagatattaacataaaacatttgttgctgactatagagtggcattgttgtaactgaactatgtaatatttaaatcaaaattatatatttaagattattttctatgtttttacaacctttaaattatcaattaaaattgtttgcataaaggttgaattacttaccttgcaaaaccttaagtggaagcacagaaataacaggaaaacatgaagaagcttcatgttggaggtgttcggggtctttgtctctgctgagaactcttttccactccaggtattcttttgaaatttaatttttaacctctgaaaaaatgtttcaaaagaacaaacctcctaaagagctttgtacttttgaactctgaaagaatttggctgaaatccagagagatttaccgtaactgaaaccaaaaaatggccttcccattaaaga

SEQ ID NO: 2439 - DNA, 5758 bp, Homo sapiens
  source 1..5758: mol_type = genomic DNA
tcgaagaggctagtttattgaggtttggaaggtcagggggctcagagtggaggagagaagtgttagagttcctcttcctcagggtctttgcaagcaggcacgtgtagacatggtcgtttctcctccaccaccagcttctgcccttgtagctcctcacaccgtggcagcggtctcccccagaaggtcacgttcttctcgccctgaccttcgaccatggaaacggtgggcctgaggcattaggggtggggaggaacggaagggagaatctcagggaaggcaagaatgcattcaattcttattgagtgcctgctatatgccgagggctactttttttttttttttttttccttttttttttttgaggcagggtctcactctgttgcccaggctgcagtgcagtggcacaatcatagctcactgcagcctcaatctcctgggctcaagtgatgctcctgcctcagcctcccaaagtgttgctgggattacaggcgtgagccactgtgcctggcctcccaacactactttttagctataggatattgggcaatttctttagcttctctgtgcctcggtttccctcatctgcaaaatgagaatggtaggaatagtaatattaatactcacctcacggggttgaatgaggataaatgagttaattcaggtaaagtgctcagagcagtgcctggcacacagcaagtgctcaataaatgctggtgaatgttacttgttggcatgagctactttcttttacctccgaaatatataccctttatatctctttccactgcctccaggaaaaaacccaatgccttgtcctgacattcaaggccttattgttgggcccaaatccctgccccaagccaatctctctctctgtctcctccactttattcaagctcagtccctgtccagaaaggtctttacctgggttatttgtcccactaggaaagccctccattcactcccatcccagttctctcaattgcttcttcctccactcagtctctcgctcactcaagtcctttgtgcctccattcaacacctctaatcttcaggccccactctaaccccctcagccgggagatcccttcccagatggcagcccttccacgagctgggaatagttcacttaatctagtagcttgatgtatgtggaaggaagaaaagggatgaacattttaaccctctctaacacctgggcccctctggcacctggaaacacttatagcggctaatcacctagctccaaggctccgttcacagtcttgatgccaggaatgcctttcccaacccctacctgccctgggaggcccagtcagcttcctggacctaggttgaggtggcagcacctgttgcatgcaccagctgttcctcatatgcctcctgtcaggggcttgctcagctgggtcccttggaggatccacaggatctgggctgtgtgtatctgcaactgttgctgaaaaagccttggagtgccttggctcagtgagatgctgacaaagtggatggaggcatgagtgactgtgggaggcaggcagtgaatggaggcctgagtgatggcagctaaaagcatgggtaactgaaggtcggagtcaatgacacatgaaggactaagtggatgagtgactgaacaggtgactgaggggcacagaggctacgaattatcctccaagaacttctttctcatcttcttagtttctccccacttcctgcagctgggaggtggcactcggcaaggcagataccttagattcagcagtggaaaccctggtttcctggggtagccgactctcccgcctgtaatataatgaccccctcccaggcatactttgccctctcactcacgggtacttggggagcaagggtgtgcagaggcgctggcgggcacgggtaggattaggtccacaggggggcatgcacagcccccaggtactccactctgaccatgatcctttcactgcaatgaggggtaggggtcacagagtcagaactggaggtcttggtgggaaagtgagagggaggctgcagagacgtgaggtccacagcagagagttggaaaccccttatcctgcatgggccaccccaccctcagagcacagtctgtgggacactcacaggggcagtgctggatgctgtagcagtgccggatatcctgctgttgcccggcacatcgatgtccgtcaaacttgcggcccctgcaggtcctcccgcgtgactgctggcccgggatttcttgacagctgatggacttcatgttccgtcggatacaggggctccactccccccacgagtcccactccccatccactgcagagacagggcaacaggggattggaccaaagcagggaatcagcaagggggttcagaggaaggaatgagggcggtaggagggagtagaggtgatcagatgtgtgaatgggggaccaggggtggaaacaaggtatcagggccaggaaaggaggaatcagagacaggaacaaggcctcagcagcaggagctgggcagcagagaagggcaagggggacttaggcatgcaaatcgtgaaccctgagatgctgaccagggcagggcacagctgtgttgcagatgtgggtccgggtggcatcgccagcacagaaggggcccccatgctggggcacagggtgattgcacgtccgttgttccatggtctggcccaggccacaggtcacagggcaggggctcacagggccccaaggcccccagcccccagccactgttggaggaggaaagggagtgaggagaaaggcctcctcaatccttcctctcagcccctagacccttgaagcagactgtccccaaatgaagggctgcatggtcacatggcctaggaactctagaaatggcagagcatctctgccctcaatcaagagccccaccagcaacatcagcagcctcatcctggtgtacctgggcagggtggcaggccggtgcacctccgctgctcgtaggctagccccgggcagggcttcccaggaggtttctgggagggctcaggtgcagaacacttgcggcttcgtgtctccttaggttcgtggggtccaccgtggcaggaggctgagcagggggtccaggggccccaggtggcccaggccccgtgtgctgtggtggggtgggaggtggagggatgcaggtgtggtcatgcatgctaaagtcctctcagcctggcagttccctgctgtaaccccgcagacccacgctgggtgcacccatcagcatcctgtggcttccctcactcactggggcagacctgctgggtgtcacaggcctctgattcctgtgcctgtcctgggcagtggcccccacacttgggagcagggtgattacaggctcgcctgcgggtccgggtccctttggagcaggtgacagagcaaggctcccagggcccccagccagaccagccgcccatctctgtgggagagaagagagggtaatgggatggaggtggggtgtcattcagggctctttgcttccttgagtgccccacatgagctaatcctgtccttatatcctctgccaccattctgggcccaccatccccgctcaccgggcctgccgcagcaaccttcacatgggtgcctccgcttcccctctcaccctcaccgtgcacagtctgttctcctcccaaccccagtcagatcacgttcctcctctgcccacagtccaaattactcagatgaaaagccaacgtcctctctgtggcccccaggcaatggaccctcctcacctctctgacctcacctcccaccactctcctccttaggtccttacaaacactggggacgggcccactctgaggacctctgtaccgatcgttcccaccagtgctgggtgacagggagtgcttgcccgccttgctcatcctcctcaccaggacagcactgctggtcctcacaggcctggagctgccactccagggtcccaggtgccacctttccagagcactgcccattccagcccacacagcgccggtaccgcagctgggagccctcagagcacgtcaccgaacagggggcccatgtggaccacagggaccatcgtggggacctgtggagaagagcacacacatcccatcctggcatgagctaacaagaatggcatgtgggactccagagtgtgggcagacacgaagggttgctaggcaagtgcgtgtgcgatggattgataagtccttaccttttagggatattgggatactgatgggaagcagtggatatacaataagtgcttgataatgtcatttaccttcacaatcaggcatctggagttaccattggaaggctgcatggccaacaccaggtccgcagtaagcaaaggtaaggactagaaaccaagggctgctgtcagaaacccaccagatcaccacactacacggtagtaggtaaatagaaagtgcttaataaacctgagccatcatccctatgacctcagaggcctcctcagaaataaccccagatctatccccaacccactgcatagccctaggtatgctgttcatgccaaatagatgtgatgaactgttgacatgacttggggcccagagctgccctcaaaaatccccaagctccccatgcccacggtgtatctgggatatatagtaaacaagtagaaaacaggtctggcatacggtaagggctcaatccatgcaagctggaaatcatgatcaggagactagagctaccctcagaaatcctcaagctcatctcccaaccctgccatgcagctggtatacagggagtgctcaatgaatgtgaagtgtcatcataattaggggcctagagctgccctttgaattccccaaactttcccgcccccacagtgtgtccatatacagtaagcactcaataaacatgagctgtcatcaaaattagggaaataccaagctgcaccccacctgcaatgcttccagtgtgcaggaggtgctcaatatgtgtgagctatgtcagtggttctcaatcaggggtgattttgacccccaggggacatttggcaatgtctgctgacatgtttggttgtcacagctggtggggagaattgctactggcatctagtggaaggctaggggtgttacaaaacatcccacaatacacaggtaagcaatcccctcccccagccaagaatttccagccccaaatgtcaatagtaacaaggttgagaaaccctgaggtatggtcacgatcagggcctcagggccacccttggaagtcccagagaaagaaagtgcccagttttgggtgacccccacagacagtccttccctcccccccatcccccaccccaggctccccctaacctgcaaggctgacagagcccaccactacgtttctggtaggcaaaggcagtgttgagacagcagtcttccacgctgacaccaccccccaggaggcccttgcacttgccggaggattcttcatactgggtgaagcagagcacggggtctgagcctgtaacagggccaggggatgggtgggtggggctcggtcagggatgtggtgggcctggacacccctggggccagctgggccctcaccccctcacctgtggctggcagggtgagcagcaggagcagcggcggcagcaacaatcgaggggcctgcgctccctctgtgatcatgttgagtactgccccctgcacctctaccagagaggaggtcccgctttatctgggttgataggctcctggaatcagcagggaaagaggaacctagaggcaggaggaactgggagggcatcctgcttt

SEQ ID NO: 2440 - DNA, 6093 bp, Homo sapiens
  source 1..6093: mol_type = genomic DNA
tcgaagaggctagtttattgaggtttggaaggtcagggggctcagagtggaggagagaagtgttagagttcctcttcctcagggtctttgcaagcaggcacgtgtagacatggtcgtttctcctccaccaccagcttctgcccttgtagctcctcacaccgtggcagcggtctcccccagaaggtcacgttcttctcgccctgaccttcgaccatggaaacggtgggcctgaggcattaggggtggggaggaacggaagggagaatctcagggaaggcaagaatgcattcaattcttattgagtgcctgctatatgccgagggctactttttttttttttttttttccttttttttttttgaggcagggtctcactctgttgcccaggctgcagtgcagtggcacaatcatagctcactgcagcctcaatctcctgggctcaagtgatgctcctgcctcagcctcccaaagtgttgctgggattacaggcgtgagccactgtgcctggcctcccaacactactttttagctataggatattgggcaatttctttagcttctctgtgcctcggtttccctcatctgcaaaatgagaatggtaggaatagtaatattaatactcacctcacggggttgaatgaggataaatgagttaattcaggtaaagtgctcagagcagtgcctggcacacagcaagtgctcaataaatgctggtgaatgttacttgttggcatgagctactttcttttacctccgaaatatataccctttatatctctttccactgcctccaggaaaaaacccaatgccttgtcctgacattcaaggccttattgttgggcccaaatccctgccccaagccaatctctctctctgtctcctccactttattcaagctcagtccctgtccagaaaggtctttacctgggttatttgtcccactaggaaagccctccattcactcccatcccagttctctcaattgcttcttcctccactcagtctctcgctcactcaagtcctttgtgcctccattcaacacctctaatcttcaggccccactctaaccccctcagccgggagatcccttcccagatggcagcccttccacgagctgggaatagttcacttaatctagtagcttgatgtatgtggaaggaagaaaagggatgaacattttaaccctctctaacacctgggcccctctggcacctggaaacacttatagcggctaatcacctagctccaaggctccgttcacagtcttgatgccaggaatgcctttcccaacccctacctgccctgggaggcccagtcagcttcctggacctaggttgaggtggcagcacctgttgcatgcaccagctgttcctcatatgcctcctgtcaggggcttgctcagctgggtcccttggaggatccacaggatctgggctgtgtgtatctgcaactgttgctgaaaaagccttggagtgccttggctcagtgagatgctgacaaagtggatggaggcatgagtgactgtgggaggcaggcagtgaatggaggcctgagtgatggcagctaaaagcatgggtaactgaaggtcggagtcaatgacacatgaaggactaagtggatgagtgactgaacaggtgactgaggggcacagaggctacgaattatcctccaagaacttctttctcatcttcttagtttctccccacttcctgcagctgggaggtggcactcggcaaggcagataccttagattcagcagtggaaaccctggtttcctggggtagccgactctcccgcctgtaatataatgaccccctcccaggcatactttgccctctcactcacgggtacttggggagcaagggtgtgcagaggcgctggcgggcacgggtaggattaggtccacaggggggcatgcacagcccccaggtactccactctgaccatgatcctttcactgcaatgaggggtaggggtcacagagtcagaactggaggtcttggtgggaaagtgagagggaggctgcagagacgtgaggtccacagcagagagttggaaaccccttatcctgcatgggccaccccaccctcagagcacagtctgtgggacactcacaggggcagtgctggatgctgtagcagtgccggatatcctgctgttgcccggcacatcgatgtccgtcaaacttgcggcccctgcaggtcctcccgcgtgactgctggcccgggatttcttgacagctgatggacttcatgttccgtcggatacaggggctccactccccccacgagtcccactccccatccactgcagagacagggcaacaggggattggaccaaagcagggaatcagcaagggggttcagaggaaggaatgagggcggtaggagggagtagaggtgatcagatgtgtgaatgggggaccaggggtggaaacaaggtatcagggccaggaaaggaggaatcagagacaggaacaaggcctcagcagcaggagctgggcagcagagaagggcaagggggacttaggcatgcaaatcgtgaaccctgagatgctgaccagggcagggcacagctgtgttgcagatgtgggtccgggtggcatcgccagcacagaaggggcccccatgctggggcacagggtgattgcacgtccgttgttccatggtctggcccaggccacaggtcacagggcaggggctcacagggccccaaggcccccagcccccagccactgttggaggaggaaagggagtgaggagaaaggcctcctcaatccttcctctcagcccctagacccttgaagcagactgtccccaaatgaagggctgcatggtcacatggcctaggaactctagaaatggcagagcatctctgccctcaatcaagagccccaccagcaacatcagcagcctcatcctggtgtacctgggcagggtggcaggccggtgcacctccgctgctcgtaggctagccccgggcagggcttcccaggaggtttctgggagggctcaggtgcagaacacttgcggcttcgtgtctccttaggttcgtggggtccaccgtggcaggaggctgagcagggggtccaggggccccaggtggcccaggccccgtgtgctgtggtggggtgggaggtggagggatgcaggtgtggtcatgcatgctaaagtcctctcagcctggcagttccctgctgtaaccccgcagacccacgctgggtgcacccatcagcatcctgtggcttccctcactcactggggcagacctgctgggtgtcacaggcctctgattcctgtgcctgtcctgggcagtggcccccacacttgggagcagggtgattacaggctcgcctgcgggtccgggtccctttggagcaggtgacagagcaaggctcccagggcccccagccagaccagccgcccatctctgtgggagagaagagagggtaatgggatggaggtggggtgtcattcagggctctttgcttccttgagtgccccacatgagctaatcctgtccttatatcctctgccaccattctgggcccaccatccccgctcaccgggcctgccgcagcaaccttcacatgggtgcctccgcttcccctctcaccctcaccgtgcacagtctgttctcctcccaaccccagtcagatcacgttcctcctctgcccacagtccaaattactcagatgaaaagccaacgtcctctctgtggcccccaggcaatggaccctcctcacctctctgacctcacctcccaccactctcctccttaggtccttacaaacactggggacgggcccactctgaggacctctgtaccgatcgttcccaccagtgctgggtgacagggagtgcttgcccgccttgctcatcctcctcaccaggacagcactgctggtcctcacaggcctggagctgccactccagggtcccaggtgccacctttccagagcactgcccattccagcccacacagcgccggtaccgcagctgggagccctcagagcacgtcaccgaacagggggcccatgtggaccacagggaccatcgtggggacctgtggagaagagcacacacatcccatcctggcatgagctaacaagaatggcatgtgggactccagagtgtgggcagacacgaagggttgctaggcaagtgcgtgtgcgatggattgataagtccttaccttttagggatattgggatactgatgggaagcagtggatatacaataagtgcttgataatgtcatttaccttcacaatcaggcatctggagttaccattggaaggctgcatggccaacaccaggtccgcagtaagcaaaggtaaggactagaaaccaagggctgctgtcagaaacccaccagatcaccacactacacggtagtaggtaaatagaaagtgcttaataaacctgagccatcatccctatgacctcagaggcctcctcagaaataaccccagatctatccccaacccactgcatagccctaggtatgctgttcatgccaaatagatgtgatgaactgttgacatgacttggggcccagagctgccctcaaaaatccccaagctccccatgcccacggtgtatctgggatatatagtaaacaagtagaaaacaggtctggcatacggtaagggctcaatccatgcaagctggaaatcatgatcaggagactagagctaccctcagaaatcctcaagctcatctcccaaccctgccatgcagctggtatacagggagtgctcaatgaatgtgaagtgtcatcataattaggggcctagagctgccctttgaattccccaaactttcccgcccccacagtgtgtccatatacagtaagcactcaataaacatgagctgtcatcaaaattagggaaataccaagctgcaccccacctgcaatgcttccagtgtgcaggaggtgctcaatatgtgtgagctatgtcagtggttctcaatcaggggtgattttgacccccaggggacatttggcaatgtctgctgacatgtttggttgtcacagctggtggggagaattgctactggcatctagtggaaggctaggggtgttacaaaacatcccacaatacacaggtaagcaatcccctcccccagccaagaatttccagccccaaatgtcaatagtaacaaggttgagaaaccctgaggtatggtcacgatcagggcctcagggccacccttggaagtcccagagaaagaaagtgcccagttttgggtgacccccacagacagtccttccctcccccccatcccccaccccaggctccccctaacctgcaaggctgacagagcccaccactacgtttctggtaggcaaaggcagtgttgagacagcagtcttccacgctgacaccaccccccaggaggcccttgcacttgccggaggattcttcatactgggtgaagcagagcacggggtctgagcctgtaacagggccaggggatgggtgggtggggctcggtcagggatgtggtgggcctggacacccctggggccagctgggccctcaccccctcacctgtggctggcagggtgagcagcaggagcagcggcggcagcaacaatcgaggggcctgcgctccctctgtgatcatgttgagtactgccccctgcacctctaccagagaggaggtcccgctttatctgggttgataggctcctggaatcagcagggaaagaggaacctagaggcaggaggaactgggagggcatcctgctttgaccccaccctgtcccctctgcctccttctctactctcccctccccatttcctgtcttactcttggtcttgttctgtttgttactatatccccagcacctcgcgctcctcccagcaacctcacagtgttcaatagaagctcctaggacaaattctcacccagaggaaatggagcataggagcgtgcagcaacttcctagccgtgtgaccttgggtgagtcacttaacacccctgagcctcagtttccctatgtggaaaatgcataatctctaacataatgacggggtcaacctcgtgggggtgttgaaccagggtgaagtgagtgtgcggtgctc

SEQ ID NO: 2441 - DNA, 188702 bp, Homo sapiens
  source 1..188702: mol_type = genomic DNA
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattgttttgaaagaaaatgtgggtattgtagaataaaacagaaagcattaagaagagatggaagaatgaactgaagctgattgaatagagagccacatctacttgcaactgaaaagttagaatctcaagactcaagtacgctactatgcacttgttttatttcatttttctaagaaactaaaaatacttgttaataagtacctaagtatggtttattggttttcccccttcatgccttggacacttgattgtcttcttggcacatacaggtgccatgcctgcatatagtaagtgctcagaaaacatttcttgactgaattcagccaacaaaaattttggggtaggtagaaaatatatgcttaaagtatttattgttatgagactggatatatctagtatttgtcacaggtaaatgattcttcaaaaattgaaagcaaatttgttgaaatatttattttgaaaaaagttacttcacaagctataaattttaaaagccataggaatagataccgaagttatatccaactgacatttaataaattgtattcatagcctaatgtgatgagccacagaagcttgcaaactttaatgagattttttaaaatagcatctaagttcggaatcttaggcaaagtgttgttagatgtagcacttcatatttgaagtgttctttggatattgcatctactttgttcctgttattatactggtgtgaatgaatgaataggtactgctctctcttgggacattacttgacacataattacccaatgaataagcatactgaggtatcaaaaaagtcaaatatgttataaatagctcatatatgtgtgtaggggggaaggaatttagctttcacatctctcttatgtttagttctctgcatgtgcagttaatcctggaactccggtgctaaggagagactgttggcccttgaaggagagctcctccctgtggatgagagagaaggactttactctttggaattatctttttgtgttgatgttatccaccttttgttactccacctataaaatcggcttatctattgatctgttttcctagtccttataaagtcaaaatgttaattggcataaattatagactttttttagcagagaactttgaggaacctaaatgccaaccagtctaaaaatgcagttttcagaagaatgaatatttcatggatagttctaaatactaatgaactttaaaatagcttactattgatctgtcaaagtgggtttttatataattttctttttacaaatcacctgacacatttaatataggttaaaaaatgctatcaggctggtttgcaaagaaaatgtattacaaaggctgctaagtgtgttaagagcatactcatttctgttctccaaaatatttcataaggtgctttaagaataggtatgtttttaaaagttaagttcctactatttataggaactgacaatcacctaaaataccaatgattacaaacttccttctggccttctggactgcaattctaaaagtgtaaaaaacatattttctgcattaagttaggcagtattgcttagttttcaaagtggtaggctttggagtcagattattttgattcagatcctacatctactgtttagtagctctgttgcctgaggcaggtcccttaacatctctgtgtgtgacttgacctttaaaatttggagactgtcataggggttaatcccttgagaaaatgaatgtgaaaagttagcctaatgttaactgctattattatggattaccatattttcacattcatcacagtacatgcaccttgttaatataagatgctcaattcatctttgagtataattttgtgactctcaatctggatatgcaatgagtgggcctgtatgagaatttaatttatgaaaaattgtgtttcacatggccttaccagatatacaggaaacacgtcacatgtttctattgtatgttgttaaatgccttagaatttaactttctgaataggatcccttcagtttgagagtcataaaagagtaaaattattatggtatgagttatagattgtattgaatatctctttatatgtctaggttttgtcattggaaaaccaaaaagtttggaaaaaaaatctaagttatttcttactttcttaattttgtgtggatttcacatcaagtataaaatttgaagaacatctgaactatcataatccatatatatatataaaataaacataatctaagagagaatttcaccatgaaaaattcaggtagttcatgactatcagagcaaacaagtacattaaattgaaacttttatgaaaataacatttatgaaataggaagctatttttaaactagaagtgatatattagcatataatttataattcatatacaagtgggattgatttataaatggtcaccaacagagattgtgctatttaatttgggaaaattttttaaatttacattttctcacaacttttaaggtagttattcagtttgttcctctctgtctcttctctcatgccctgaatttttcatatttcgtttagttgtaagagtgtatatcaaaccgtgtgtcacatgacataacttgaattttcgtcgtgatatctgtgctatgtctaggtctatactgaggaactgtgggaaccccacagaatccaagtatacagtgccactgatttcttacaagggatgtggggtctcctgtaaactctgcagttagtctcaagtaagaccaaagagtaaaatattgttaggatctaaggtggaaattcagcaaagaatcacatagtctaagtctcgagtttaacagtaagataatttgagatacttttgtaattattaaacacaaagtaatgagagattttaaaacaaacaaatacacctgaatttatatatcagaataggtatggtggttcaaaatagctatctaataaaaaccacactcctattctaaacatttgcctttgatcaaaataattttgggtctcttattatgaaattgcctttctaaataatacataaatttcttctcataagtatatattagccacattattttattgttattgttttatattcatagcttgctttagattaaaaattatattacccagactggtctcttggacttgcttccaagtgacttttgactgtatcacaaaatcaaattcactctgaaaatataaagatttttcatcataatttcctttgttaacagccaagtgctacctaattttaggtgttttcattaaaaaaaaatgcattgcaaactttaaagacaattcttttgtttgtttgtttttaaaagacagagtctcactctgttgcccaggctagagtgcagtgacacaatcataactcactgcaacctccacctcctgggctcaagtgagccttccatcttgcctcacgagtagctgggtcttcaggtgtacaggtgtgtaccaccatgcctggctaactttttttttttttaagttatatagagacagtatctcactatgttgcccaggctgctcttggagctcctggcctcaagttatcctcccactcagtctcccaaagtgctgggattacaggcgtaagccacctcaccctgtcagcctaaagacagtgcttaatgaagagaaatataagtgctttgagcaatggaagtataattaaaattatactatgaaagatttataaagatgaccattttgaatgggaccacacttatttggttatataaattatgatacactattaaaaattcatcatgatgattttgtatttacattttatttacatgtttgcaatttgtgaggaaagctaaaattatggctaagccataaatatttttgcagtttgttgagggtgtttgtaaaagtgttgccaaggaagaccagttggctacccaaacaagggtttagtctaggtctgatcaatacatacacattatctcaggtttgtctatcagaaaaaccttaggttatccaaatcaaaataaaatagatgcataaaacaaaggccaatatgtgttgaacaattatattgtgatatacaactgccaagcattcccgattaccatgactccatttagtcagtccatgggcaaatgccatcaatgaggacagcccagggtttccatattctctcttggctttacatcctataggaattggaggggcccacctctgggataggagcccttctgtcttgaacaatgttgtctgaacactaacaaatgttgactttctacaccagtccctcaatagtcttttctatttatccttttgctgaccatgttttgttattacacagttgagatttttcagctgggaatctgtgttaattttgtattaattttgattagcttaactctcagagttctaaaagtacctcctgtacctgatatatgacaaaaattataattacatttatttatatataaaatatctttgtatatgtaaaatatctttgtatatataattatataattgtttcttttaattttgcaaattttaaaaagttctcctttgttttgaagtttattcctatagttttttatatgctagttaaattattaatcacttgattcaagtaatattcttatatacttataaggaatagtgtagttttaatatttaattccttgctaaagagagaagtggaatctatttttcttagctacttcatcaatattttatgtttgatgtgacagtcaaaatatccctcagagctaactgttacactagggaaatcacggttttccagttttccatttatgtgttatgggagggagtggaacttagtgtaataatattcaatacataaatgttaacacttgtttaaaggtccttgagtgagtactgctataaaatgcattattattgctagtgtcatttcacaagagcctataatttcagtgtgatagagctacaatataagtatagtattgcaaaaccatcaggaagggtgttaactatttagcatgcagttatgtgttggttgtcaaaacgttaaaaacatctctgactcagcagcaattttggcaattttgatcctgaggcatctgtgtagggcatcttcctggagaaaaacctctgagatgcaatgaggtcaaaaggggaaaacagactatgataaagatcaagttgtttggagatcttgtagaaagattaatttacaaatatgtcaagtgcattatcatggaggaaaacattgctatttctgttggttctcttcagagctctagaatcaatttaccacatagttgtttcagtgtgaaattagcattacagagtggctttacggctttactgtagggcattgtgtcagcaaagagcttaggcttcttttagcaagaagcttgtaaaaatttaatttactcttagattgcttgatgtagagaattacattcctacagagctctgaaaaatcttttttcagagtttttcacagctgtattcaagttgcaaggcttgtcaactttgctatttttctgtgcagctctgttaacttattattatcttttgacataaattatgattccaaattgtaaagctctggatgtcagggccttttctaatttgtttagtatgatattcagaccatttcaagactcttccgtggaacaatttaataaagatttttttgtgatgttaatgagttcatggtgatcaaccctagagacctgtgtctattgtagatcgatgacattcaacagtcctgcagtgctggcatcattttgataaaaaggggtcaaagcaagtgggactgtgggcagatttttaatgcttagaacaattattccatcgaagttttcttgtgtcccttctgccttagcctttgtaggatagcatgcttgctaatttcttgctcatggggtaaggaaatgaagatttttgctaggtccgtaggattattaggactactcaggcctgaagctatgcctggatatagccagaaaactctcccatagcttgctccaaggagctgagatacagcagtacttcctttgtaggtcatgattctgggtaacctggaagatgacctcattcatattctgtattctatgtgagacgttaagaaggtagaggtggccaagaaggaaattgttgctgcctttatggaacaaattatctgaaacccagctttctcgagggcttcattgaagtactcaactggggcacttaacccagtctaaggctggtcaaggaaggcttgctgggggaagtgtcttttgtattcacacctaaaggaggttattcaattagaattatccaaagagggtagggatgggctaggaaaaatttaaacaggtagtgtggaggactgacaggataagtaagcatggcaccttcaaaatatcctgagaagttccctatgacgggaacataaaatatgtgacagagatttgtgggagatgggtctggaaactctagcaggggccagatcgtaagggggctttgtaggctttgtaggctttgtttgggctttatcatactggaagtgaaaagccatggcttttaaacaggagagggacataatcagttcatatactgttgcagttttgtaaaagaaaagatgagctgaaagagtggccatggtggaggtgggtggggtgggggggagggggcggggagagagagagagagagagagatttgaaagacatttaggaggtaaaatcaactggtttggtaatcaattagtagttgaaggtgaaggaaagagaagagttaaggataacatctatatttgttgatttggataatagaggggacagtggtgctgcttattgaatgagaaaatttaatcggagaagaaggcatggagcaggagtgcagacctatgtgactctacttctctcaaaaccagaaacggaaatgatgtatatggctcagggttaggtaatatggttatttgaaaatgtattaaagtgatttagagcttagtcttaggtaagagatataagatgtctgaggtgacagttttataaatatgtagagtgcccacttgtttggccttattgtggcatagtgtgacctgagagtgttaggaagaagcagctgagttctagggacagtactggttaaattctacttagaaattatacttagaactctcctatataacctgctaactgatgtctgaacctcctgataacttcactcctttaggcagtgcttttcacatcacgggacacaacatatgagagatcatagaaattcaatgtggtatgaaaatctgcttgggacttcagatattgtctccagtgattgaataaaaataggagctcacctactatgatgaggtttctgtgtgtgttaaaagaaggttttcattacttttgaaaaggttatgtatccttgttttatgttaaaactttgagctttgttaaatatgcagagttctctttcttagcatggactacagaggtgcaactacctcctacctgacttcacatctactcccaaatgcctagtgaaggcttaataatttcaaaaagggactctagaatttcatttgataccagtcagacaaatgtgtgaaaattaagcataataggcagaatcccaggggtactgacagctgtattaagaggtgattcaagggctaaaccttagagtccagcattggttatgggtgtgacaagaaaatgaagcctatgttggctgggattagcaaccacagttctagaggaagcaaggtggagaaactatatagggggctccctttgtacgttttatttattttaaacatctctataaactctagaaattaaaacaacaataccaacacaaaagcatcactttttcgaccaaagaccattgctatacttttttgtgtaaagggctagatagtaaatattttcagctttgtgggccacataagtctctgcaatagacaatatgcaaacaaataagcatggctgtgtttcaattaaactttattatgaacattaaaatttgaatttcatataacttttacatgttgcaaaatattctttatttaaattctattgcaatatgctttaaaagatacagtttttagtctttcttagtttaaaataaaatctagaaaaaattttaagtcttctataactttttttcggtaactgaataattttaaaagtaagtgaaacatttagacatgcaaaatggacttttcagaagaagaaaatggtagcttaacagttattagattattgtccagaataatttttgacttataagtctctgttgaccatttcattgcctctttttttggaatatgcatcttttaatgtgtccttcaaggcaaaggctctatcttatctatcttgtgtcttgcattttcccagggcaatgtttttcacaatttttttaaaaaacaatactgtaatcaattttcaaataaaattttccatgggaccgcagtgtatacaaatagcagtgacaataaaagataataactctcccataaatacaaagaaacagttaacctagtgctctaaagtaaaggctacagtgattttgtataacatttatatgtaattttcttgatcctacatggttgtgtttttcacagtgttatgtttctgaaatcgagatgccttttataattgatgtcaaaagaaacttgtcagccacaaggcccaggaataagttgtaatatgggaacttagcaatacataaaggtatatatactcctgtgacctcagctgaattatttgcattggttgcatcccacaaggttgactcttaaataaatttagtttgttgcttgaaatttcttgggataaattactttgtgatgtagttttgaaaaaaaaacaggtaatatttagtctgaagtttgtctgacatactaagcaatgtaattaaagtagaagtcgcctaagctcagcactttattatgccttgaaattatactgcctgtcctacaggtgaaggtgttatgaatgcagtttgtcactgtaactctattcatagctctgaaaggctgagagtgactcagaagaatatttttgctctgaatatgaagaacgcttagactaaaactttaattacgatgctgaagaagaaagtggtaggtgattgcatgaataagtatgtaatattgttaatttctaaaaactgtgtatagttaatgtagtgcttctttttggaaaggctattgttaaattgatggtaaattctataaccaatatcaccttaaagcaagtacgcatgataaagtattataaaaccatgataatatcatatgtggcttattattgttccctgagtgttgtacaactctgttatgctgtgatgaaacctcatgcaaacaggtatgtcaaagatatgatgggctgttaactgagcttggcccacatatggtgtagtgacatgctcactaatgcagtgcagagataaccaataacagatcataacaggtttaaatatgtgcaaggagatgtcagcagaagctttcctacatagtgaatactaaacaagcctgacagcccaggatcatgttcggatcaatctagtgtgctaaaattaacatatagtcctacatttgagaatgtgtgattttcttggttcctgtctataaaataatattttaaaatacatacatttcaaatcagaagttggtgaattcactgaaatatttctagagaacactaggtattggggctcatagtgtgaaaaccactgacttaattcttcccccatcttggttgttcctgatcttcccttgtgtccccattccagccatttgtatccttagaaaatgatctcatattctacttcatctttatcttcattgtcaactgtcaggtagcaatatatgatggaagaagcatgtactttggaatcagacagacctggctggaatcctaactctgtcacttattaacaatgtgatcttaggcaatttacttaatctctctgaacctcagctactctcgtcagtacaatgagttatccttatctttacatggcacagtattattatgatatcaaaaattcattgagtatttactctgcatattagtcaaggttctccagagaagtagaaccaatgatacacacacacacacacacacacacacacacacacacacacacaatttattataaggaattgacttacatgattatgatggctaacaagtccaaaatctgcagtatgggtcagctggcaggaaacccaggagagtcaatgttccagtttgagtctgaaggcagtctgttggggaatttcgtccttctctgggaggccagcctttttgttctatacaggccttcaaccgattggatgaagttcacctttattagtgagggcaatctgctttaaccaaagtttactgatttaaatgttaatctcatccaaaaacacccacccagttgacacataaaattaaccatcactctctgtaagcactttctatgcattaagtgatagcaaataatgccagacatagggcgtctttaataaatggtaagcactgttatcagcaacaacaggattattataattagcaccttttcatctttctgtctgggctctgagaaagtacctctcttctctaaatttatccctcctttcctatgaattagacccagtgctttctctgaattatgaaggtcacactcctacaaatgccccttcccaattgcacatctgtcggctttctttgccattgacttttatctctagcttttaaatttacaggcatatgtcagttaacaatgggaatgcgttctgggtaatatgtccttaggcaattttatcgttgtgagaatactatagagtatacctacacaagcctagatgtcgtatagcctactacacacctaggcaatatgacatagtcttttgcttctaggctacaaacctgtacggcttgttactatactgaatactgcaggcagttgtgacacagtggtatttgcatatcggaacatgtctaaacacagaaaaggtgcactaaaaatactatgtagtgatctcatgggaccaccattgtatatgcagtctgctgtagactgaaatgtcatgcagtgcataactgtatcttaaatactcaaagtatcacctttgtttgtttgtccccttgtgtgcatcatcctaacgtggaatttctctgttgattagggccagcgtattagtttgctagggctaccataacaaaataccacaaatttggtggcttaaataacaggaatttattatcttatggttttgaagactagaagtacaagatcaaggtgttggcaggtttttcttctaagggccatgaggaagagtctattccatgcctttcccctaccttctggtggtttgctagaaatccttggcattccttgacttacagaggcatcaccctgatctctgttttcatcttcacatggcattctccctgtgagcctgtctctgtgtccaaacttctttactattaatataaggacaccagtcatattggattagggtctactttagtgacctcattggaatgttattacctctgtaaagatcctatctctaaataaggtcacatccttaggtaccgggggttaggactcaaacatacctttttttggggaaacacaattcaacctataacaattgataacactctttaggagcagaatgcgatatggaagtaatttgagaccataaagtatatacatgtagggagttaatctatgaaacctattgaaagccatatatacctcatgtatagtggtccataaatagcatggagacattgcagaggatgttaagtgatatgatacaggaacaatccaagaaggtcataagaaaaaggaccttttgctcttgagaggactgaagaatgactttccatttatgaaattttggtacatgtccactaaaaataggatgaaggccaaacttaggaagaatattttgataatggagaaggttgcatataaaaacattttattgaggacaattaaataatgttggctggaagttttaggatgatcatctttaggactcagaaaaagagaagaaacattattaaagaattgtccctgaacaagtataggcaccctcacatttgcattgcatttactatagaattgaaaaatgttttgaccttttttttttggcttttaatatatttgaccaagagtaacagctaagcaatacctatttgcaatcagtgtcatcatgtgggctccaaacatatcatgtttgtgtaattaattgattgacccattaatttgttcaatttctgctctgttccaggcactgaacaacatgatggagataaaagataaatattacacctgccttgtcctcaagaagttagtcttctgagggaaagaaattagcaaacaaattgtaatctcagttatgtgccatgttccatgctgggcacaggggatacagtagtttaaaaaaaacacaagatctataaggtgtttcttcttgtggaccttacagtctagggtgcttggaaacatggggcgttggcagacaagtaaatacacattttgtggtaaaggctcaggtagaagaagtacaggatagaatagagcacaccatggggaattaatctagacttcagagaggctcacacatacataatttatgtgtgactatttcaatgcatttgaggtttcttggaaatagaggttaggttttattttaaggaagttaccattttttttttcagtgtgatgtggttgaaccaaagaatgccatgcccagtgatggtaataggataatctttttaaaaattaagagccacctaataaatcaatagtttcattcagcgggagctcctgcagagttcaaaaagaagagaatctggcacagcgtttcctttaaagttcattttcctagagtgtgaatggaagcaagagattataacattttgaggtcaaaaaaattctgaaatgcctataaaaattattttctccaaattatcatcatttgtgcttttaatgacctgattgcaaagatgaacattttgaattcttaaattgcttattaggattggttaatgaatcaattatctattactgtatgttttgctattggaaaaaatagcaacttaagtgttttgcagacctttacttaggtatatgttgcttttatgaaaaaaaagatgtaaatattaagtaaaagggatttaaagcaaggcttttgaggtagagtcttattaattccttggtaaaccttgagccaattgttgtctatgttctctgcctctgtcttgctccttccttctgggattcactgtgggaatgcgggattgttaatctggggatgctgtccaatcctgcctctctcaagctttgctattgatctccctcccagtgataataaagcttgaagaaaatgaaagtagcgttagtattggtcctcaaactcaagaacaggatgaaacttaaatcttgagtcatacaattgtgtctacatactgctccccaaaaagagaagtaaagaagatgctaactttcccttttaatttgcagtacttagcaatttgttttcttgagggttaagtaataacagtggaagaaaaaagggttaaaatgccaccaagaacccaattccatgtttagtttgaaagtgggaaatcagctgccactgggaagtctgaatccaatgccatgatgttctttgaatccttctgagaaataatcatgtgtagccataacatacctgtataacagagcagagaacataaacaaatgaaggtgaagggaagattaagacagaagagaaaaattccagaatcgactgatcatttttatctgtttagatgatttcaggcagaatcctagagaccaactttatcacaactgaattttaaaaatcaccagctttgtcattgtgatgcagcatcagtttcagtattatccttggagtattaattcttaatcatcttcatcttagaacatttttgaggtcacttctagtctctatttcaccagtgaagaaacaaaaatccccaaactatatcaggtggaattacacagtattttttttttaattttggggaaagtcgattcaaggcagtaacttgcaagctagtgttagaaaggatttaataaatagtggtttttctgtacacatagtgagaggtcattacatcatttggttgttgaaagtcataaggatgtctagcatgcgctttgcctgtagtggttcatgccaggcagattcctgactcctataacccagagcttatcagagcatttatgtccccaaagagaaatgtcacctccatctttcaataaacactttagcaaagaaaaatcaagtactttaattccaaatcttgagttaattccagaataacaatgatggctcggaaaaatatgggtatttctgtcaaaggacagagaaacctagtagagagtatttactttgggtcctagtgatggtatctgaacaagctaggtgaacaaagagcctcaataagggattttgaggtctagaaaaagagaggaaataccaaataaatggaataattataaaataaataccagcaaagttaaatcaatatatcatgtgggagatatccttatatcactcatgtgatttctattttgttcctatattaggccaaggagaggtggaacttgttttcctttttccctctcagctacgaatggacatacttaaaactgtttctctgcttctgttctctaaaatgtgattgtctaacagtaaccgtgatgacgttttgacagttgcacaagtttctttctttaagctttaaaaatgccagccagtaacccagtggcatttctactataaaatcttaaggccaatccatttccccttttccttattttcttggtttcaaatatatttttattgccaatggaaataaaaatcctaaattagagagcaatggcatcccttgtcttgtgaataaagagctcctaaatgtgaacttatacaggatgcagcaatttatagggtagttaatcattcttctttctagccagttgttccagctacagttttgtggctcttgttagtggcttcattcccagatagaataaaaatcaaaccaaaatcctggaaaggcactctgaggatgcttctctaaagtagatgggcatcaactataaatcacaatgctttgtttcctctgttatgtttcaagatgggtgggattttttttgtagcattacttattattgcctctcaagtgcttgagtctttgaaatccaagtcatgtgagtgaattagatacagctgttagaagtggcctttcaatgccaatggtacacattccttggtttctttacgatactattgctcttacaacttttatctgaagtcataaattcatagttgtcccagaagttaagttccttgcttctagaggacagaaaacaaacaatttacacaactcatggtgcatgtcaccagtccttagatctcatgaaatatgcatgaaatcttaaatcacttgctgtagccacccagccattgacatatttgaaagactttagtgtatcaaagtcactataatgaaaattttgatttcaccagttctaggagtgaaaaatcaaatgtttagtaaaactttctaaaattaacactgacagttgatttctgtatactgttgttcttaataatagctttattgagatataattcatattcaaaacaacttacccatttaaagcatacaatccaatgattttttagtatcttcaaagagttgcctatcaccataaccaattttagaacactttcatcactgtaaaaagaaactccattcctattagcagtcattccttattccaaatccccctgctcgccctagacaactacaaatgtactttccatctctatagatttgcctgttctggaaattttatgtaaatagaacaaagtgttcttttgtgactggcttatttcacttagcattttttttcaaagattcatccctgttgtagcgtgtatcagtgcatcattcttttttatttttttagagacagggccttgctctgttgcccaggttggaatgtgcagtggcatgatcatgggtcactatagctttgaagtcataggcgaaagcggtcctcccacctcagtctcccgagtagctgagactacaggcttgcaccacatgactgtctaatttataattttctttagagacagggtcttgttatgttgtctaggctgctctcaaactccagggctcaagtggtcctcctcccacagcatcctaaagtgctgggattataggtgtgagccacagcacctggcttgcatcattctttttattgttgaataatatcccacttgtaagaatatgtattttatttatcctttccccagttaatagatatttcgattgttcctaattcttgtctattataaataatggtgctatgaacatttgtgtacaagtttttgtgcagacatccattttcctttcttttgggcatatacctacgagtgtaatggatgggccatatagtaactttatgtttaatattttgaggatttttcaaactgttttccaaagtggctgcatcattttaaattccttccaccattgtgtgagtgtttcaatttctccacatatttgcaacacttactattatctactcttaaaaattacagccatcctactgggcatgaagtggtatttcattgtgagttttttttttctttttctttttttctttttttgctaatgtttgtggattttcttttcattttcttgatggtgtcctttgaagcacaaaagtatttaattttgataatttccaatttattttttgttattgctgtttgtgcttctggtgttgtatctaagtgtatgctactttaaaaaattagttgtaatatggcaaattggatacatgtgtaggctttggtgtcacaatcctaattttaaaattctgactctgcccttgacaaattaactaattaagcttccttagcctcagtttctcaactgtaagttggagatattaccaagacctacctcttgaattgttgtggggatcagatgaaataatgtatgtgaaatatttagaattatgcaagtctgtggtaatgaatactaatgttagctatcattattgttataatcccaataataaattctggtgctttgaaaattaaaccaaagccaagcagttgatatgaagaagcatgtaataatgtacagacataatgctttatagacaacattgaatttggctctcatgaacatcaggaatagtggtcatggtagttattatctccagcaggaactgtagctgagagatcttcagagctttttccaaggcgatatcactgggaaataatagagacaaggttacaagctagggctgtgttttcttcttaaaatctttagttcagtttttttcaataacagatttgtagtaggcatcaggtgactggggattcgtattcttcaagttgaaatattaccttgttgagaaagaaaccatgtgtgagacaaccatgttgagaaagaaaaagtgattttatagaaaattaatattgatagtgagcattatatgaaaatcatgaagttagaacatatttggccagaaaatttacattaatagttacccatagcaattaatgcattataattacacataccttttctttaatgaaaaagaattctttccttccaaagttatgcatgctattgttaaacattagagaatatagagaagcaaaaaagaaaatatcttttttgatattttcttaacatacgtctgttcctaataatgtttatagtttagaagcattgcatgaaatgggtagatcaattttctatttaatgtttggattcattaggtacgaagttagcaaattaatttccattagggtgcctgtatggttgtaaatcctggacctgcagaagatttttcagtattggtttgtagtcttttgtttagcagcaaataattagttctccagagcttctgaaattaattgaccactttaatggtgtttacctacctagagaaagaaaaagaacttctccaagtcccttggtaaaattaagcctcatgaacaattaactcaaatatacacaaggcttgtctttagcgagcatatactccctaaagttgattaagctgaccaagtgattactgcttataaattcaccattttatggagaagaagcaaacactgctaaataccttgtggaatcagaggaggggaaattagtaacttgaccccaatactgcgattttaaattgaattcttgaagcctacaagttttacacaggactttagagagctggatagtatcactttgtcaagtcctacttttactatgattctttgagaaaaatacatctgactaaataactctgaatctaaattggataaaataaatgtgacattcaaaatgttatttatgattttagaaaaatatccttatagacactagatgagttttagtctcaaatcaatcctccctatcatagtcacttatcaaaataactaaagcaaagtggtagagctgtgctctagaagtttgggatttatgatcacaatcttttccaatgagtcccctctttcctctgcctgtcttcaacatttgtttttttttttttttggttaggactatccagattgtgtggcctatttcaaactcatggcaaatacattggatgatcagaaattttctaatgtatttgaatttgtctacacaaactagagtaattgctattaattcctcaagtgttaattatttcatgcaaaaaggaaaaaggctattagtctttaagtgtattagtatgtcaatatttgggagaagtgtcatgcaattagtggtttgaatttcctattttattttattgcattttattttatttgcctagtcaaataaaaagtaatgttaaatacatggaagcatgattgttttctacactaaaaatcattttgacttgaaaagatctgatatccatgaccttcatctgaagttttggcagatgaaaatgtcagatgcgtcttttggattaataaaaggcaaaagtcagatcgaaaaatgagtataagctttaattatatgactttaggaggatatgttatgaaaatcaaagctttaatagtgattataattggcaagttctttttttataaggaattacaagtcactctatacaaaaattggaatttttgtcctaagaaatgaaatttactatagtttcatctgtgtgtgtgtgtgtgtgtgtgtgtgtgtgtgtttaaaaaatcaagtgatagggcttttcctcaataaaatctgaaatctcttatagttaagtgaacagaacagtgtatctaggatgctagacttttttttcaaagttagtttaaaacttatacatagtaaaatctgtatgccttagggatctctgtttgctatcccatagtgaatgattaattagtttctgttagaaatagtcagaactaggctgggtgtggtggtggctcatgcctgtaattccaggactttgggaggccaaggcaggaggatctcttaagcccaggaatttgcaaccagcttgggcaggctggtgagatcctatctctacaaaaacaaacaaacaaacaaaggacaataagaaagaaagaaatagccagagctttgaacaaaatttctaagtagaccaatgtaaaagtctgtcgtcaatatgtagtggctatgaatggaggttatgaatgaaagagaaggataagatgaactagaggtgagaggggaagacagcaggcccaagtgaaaggcagagccgagtttattgctttttggttattccaggtgtgtctgctttgtctcatgaaacacctggatgatcactgatttctagtggaagaaatgctgaaaagtccttactgtgcatttaaacattctaggtttaatatactcagggtttttcaaaagaaagggtggctggagttttgcactaactaatatttcataaagtgtctaagtatagatgtctggtttttttttgtatttctaagactggcttgaggtaggcatggagaattctttgatgggacataattttcttcctttctttttttttttttttttttttttttgagacggagttttgctcttgttgcccaggctggagtgcaatggcacaatctcggctcactgcaacctccgcctcccaggttcaagcaattctcccacctcagcctcccgcgtagctgggattacaggcatgtgcccccatgcctggctaattttttttgtatttttagtagagatggggtttctccatgttggtcaggctggtctcgaactccttacctcaggtgatccacccacctcggcctcccaaagtgctgggattacaggcgtgagccaccgcgcctggcctgatgggacatatttttcattcaattttattgatttaacctcacaaaataaaatatttccttaagatgactctgtggtcattgttgggcagcataagcttaatggattttagttatcataatttaccttaaacccaatttgtatttcaggatataaatagaggtttattgtagtgaatcttccaggaaatactaagtgatactaataattatagatggtgaacttaagtctttatattactgaatttgtttggtttgatgatgctaggctatggcattcttgctaatcaaaacgatgtgtcatggtgtaacataacttattaaaatgggcacagataacacaggaagctttttataaaagcagctcacaaattgtgttactttgaactgaactggccatttatgggaaaggtcactgggttgtaaataaggaccaaaagagttacgtttatattttttaaaagagattgaggagatttatttttacatttcttgaaaatgccttattttggtatggtattgacagatagtgaaattctgctcatttgtaaatatagtgtcatattttaataatttcaaacatattgaaaatgcagaatttattaatagtgggagcacattttcctttttactaaatgttctacaggttcttttctttccatccacacacagtgccattaccctcattctaagcctttcaaacatctggcagtaagtgatctgctgcacttagctctttccagctgagctgatttttaaattttcagaaaatttgtgagctaattgttaaacatggccattattaaaaattaaattatttcaacttataattaaataaattatattaaaacaaaagtattaaaaactcaaaagttggctgggcgcactggctcacgtctgtaatcccagcactttgggagaccgaggcaggtggattgcctgaagtcaggggttcgagaccaacctgaccaacatggagaaaccctgtctctactaaaaatataaaaaaatagccgggcatggtggtgcatgcctgtaatcccagctactcaggaggctgaggcaggagaattgcttgaacccaggaggtggaggttgtggtgagctgagattgcgccattgcgctccagcctgggcaacaagagtgaaactctgtctcaaaaaaaaaaaaaaaaaaaaaaaagaaacaaaaaaaaaaaaaaaacaaaaagcaaacaaacaaaaaaacaaaaattatcacttcctaattattttgcattttactattatctatgctattaacgttatttgccttcattgtatttgaaaggtggactatattctattgcactttcattgtactatattctaatatgcaactgtgtatcccttcccaactctgtgttcaatgactttatatttggttgctttaaaatgatgacgatgagagtatttatatcatagaaattggcaaatgccgtaagtcagtttttgtttttgtttttgttttccggagaggggattgttaaatatttgcctgcatgcaacaccactacatgcagtctgctatcttttgttcttcctgctttcaggctcctctcccagctgtctgtctagcacaacccagcataccaaattttcttaaatagggaaagttgaacatggtaaaagaatgaatgaagtcaaaagaatgtggaaagacctaggctttgccatttagtaaagtttagcatctctaagcctccatctctttatcaataaaattgagcaatgatcccttttagttctacccatttaagaagattttcaaatgaaaaccacaacctgctcatgtttatgaaggcactttggaaagcgctaaatacacgggtttttattagtagtaaacacttacttcacctttttcacttcttgactttagtttacaagggctcataatctaaattatatcataaattgctgtcccagatttttttacagcctaattgccacctgtatgttcgactttccttctgttctttatgttagatactgggatagtatgcaccaggtgggtgtgccatcactttctcagatgatgtccactgaagaccttgcatgatcatggcattcattttcctgctgtattcagactggcctcaactattttctttattgctctccaggaaaaattacaaatgaatcagactgggcaatgaagggtaaacctaattatcgctctttgttaaagacagctcttgttaaaatgcggatattgcaaattaatggaaaaaatatgacatagtaaaccatactcacttattaatatcttagtaaggaataattgatgaagttacttaaccttagagccctaattcagttaagttttaatgaaggacaagttgtagagatatcgagaacccagggcaggtgcctactgaagaagttccagaccaaggaagtataaagaaggacctgggtgggagcagtgagattggatatgagggccactggcaaagttttgccccagaacagtgtcaaaatgtttgcatttggcatagccctttctctttttgttctgaatggctttgctagaatatcttttctataatgaatttatcctgcttctcagatattgctaaagcactcccttttgaattttggtgctttaacatgcattttgatacattaccaaataaggtctgaatgacacaaattttagaactctccagagaaaagaaagatgctgagggaaaaagcataggtttgggactcactaaatcccagttcaattcctttctttaataaatatattcaattttacctgagaaagctctcgtgctctcgaattttatttagaaatttctctttgtacatgattgatttcacaatccttcttctgcctcctcttctactttcttctttctagattttcctatctttatgaagattattctgccttatcctcaacagttagaaacaatatttttgaaaatcactacggtatcctgcatagtgatttcccatgccaactttactaatttccattataaattattatttattgatgcctagagggcagatgagtgtagctgctatggagtgaggagacaaaacataagaaagttatgatcctaccctcaggtaatgattcagacatgataattaagtcaacaaattgatagaaactaatcactaactctctggctatagtcattctttcaatgaatagctcattactgagtatgcatgctacagtaacaaaattatataaggctgttgattaaatgttgattaagtgcatgtcttattcagagtttttttatatttgaaatggaagaggctggacttcagtaatttgctataaactgctagtatatgattatttgggggcagttattttttaaagaataatttaaatatggaatgtttagcagtttgttttttccctgggaaaaaccatactattattccctcccaatccctttgacaaagtgacagtcacattagttcagagatattgatgttttatacaggtgtagcctgtaagagatgaagcctggtatttatagaaattgacttattttattctcatatttacatgtgcataattttccatatgccagaaaagttgaatagtatcagattccaaatctgtatggagaccaaatcaagtgaatatctgttcctcctctctttattttagctggaccagaccaattttgaggaaaggatacagacagcgcctggaattgtcagacatataccaaatcccttctgttgattctgctgacaatctatctgaaaaattggaaaggtatgttcatgtacattgtttagttgaagagagaaattcatattattaattatttagagaagagaaagcaaacatattataagtttaattcttatatttaaaaataggagccaagtatggtggctaatgcctgtaatcccaactatttgggaggccaagatgagaggattgcttgagaccaggagtttgataccagcctgggcaacatagcaagatgttatctctacacaaaataaaaaagttagctgggaatggtagtgcatgcttgtattcccagctactcaggaggctgaagcaggagggttacttgagcccaggagtttgaggttgcagtgagctatgattgtgccactgcactccagcttgggtgacacagcaaaaccctctctctctaaaaaaaaaaaaaaaaaggaacatctcattttcacactgaaatgttgactgaaatcattaaacaataaaatcataaaagaaaaataatcagtttcctaagaaatgattttttttcctgaaaaatacacatttggtttcagagaatttgtcttattagagaccatgagatggattttgtgaaaactaaagtaacaccattatgaagtaaatcgtgtatatttgctttcaaaacctttatatttgaatacaaatgtactccctgggaagtcttaaggtaatggctactggttatcaaacaaatgtaaaaattgtatatttttgagtacctgttacatgccaggtagaatatctcctctcagccactctgagtggaaagcatcattatctctattttacagaaaagcaaactgaggctcagagagataatatactttgccagttaatgaatgatggagccatgattccagctgaggtctgtattgccttgctctctaggaatggtagtcccccccataaagaatctctcagtttcctttccaatcaaaaggttaggatccttttgattgccagtgacagaaacccaatttactagcttaagtaaataaaaggaacgaatttattggctcatgaagcctgaactatgtgaagacctaggtggagaactggccttaggaactcaatgggaccaaggactcaaatgccacctggtggcatttgccttatgctggttttattttctcagaccggaccagctttctacataaagtgggtccctggttagaactctttgctcctatctttaaggaccacgaaagaaggagccctttgtccttggctaaatgtgaaaaatcccagagactcttgagtcatagtgcttaccccttgggccactcatagtctagaatgaactaggctgagtctcgtgccaacagcacaggcctgatgccagataaaagggtgagtgaagggggataaaaaataagacatagctactaaattattgcaccaaagtaaaaacattgagttgacttgcaatttgtttcttttaattaaattcatttcctttttttggcattttgaaggcaaagtaagatattaaactttatttttattgattttattcaaagaattaagctagtgggagtagcagattcacacttctaagatcaagggccagcttctattattgaacacttggtgtgtgcaaatgccatgaggtagggatactttgttttgttttttattttttattgggttcgatctcttttgtttatgatgtatccccaagtgcctagaatagggcctggcatatggtatatactcaataaatatttgttgaatgaatccatgatggaatgtgaaatggctagcattacatagaaacctgtagcattgctggagagataaaatatataaacataatccattgcaggtatattgacaagttcaaaataatataatgggtattgaatatctaaatgtttgttgttgttgttgctgttgtttttgagacagagtcttgctctgttgcccaggctggagtgtaatggtgcaattttggctcactgcaaacttcgtctcctgggttcaagtgattctcctgcctcagcctctcgagtagctgggtttacaggcactcgccacaatgcctggctaatttttgtattttagtagatgtggagtttcgccatgttggccaggctggtcttgaactcctgacctcaagtgatctgcccaccttggcctcccaaaatgctgggattataggtgtgagccactatgcccagctttgaatatctaagttttaattggatgctgagggaatgattaatcagagtagggctgggttaattgaaaaatgtgatacatttgtatttatggccagatagagaacatgaatctgaatttgcagaattatctggcttaacatttttttctttccagttttcactgtatcccccatgttgattcaatttaaaaaatatacctattttacttcaattcaacaatgctatgccagtacaaacccatacgttctattatttttgttttgttttgtttttgtatctccaccctgttacttcttttcttataaaattggtatttgaaatttattgaaatattttggaagagtgacataccatttttggtactttgtacctctgcacccttgggaagtgaccctggcttcacatttcataactgccttgtgaccatggccctcaagtggttgccagatggttgaagaacattaacctatctggctcaattttgtgaccatggattgaatcctctacataactgcagtgtgcaaaccacacatccgttccaagattgtagtcaggatatgaactttttaagaataaaacttcttcccttctgatctgggcctggtatgtggtcctactagaaccacatcacctactcttggtgctaacaatttgtggcaccaagttgttcaagtttcacccattaaagaaattccccgaccttgccttctcctcaggtaactaccccattctattttttctttcatagctaacattctctgctctcctggtctctctacttcactttcatttacatctcagctcctgaagtatggtttccaccatgttcctaaaactacattgcccagggtcactagagacctcttatgaaatataacaacacctttctacattacttccgtgtggaccactttttcacattgaacccattttgttggtttatgtacacaccccttccttggctttcccatctgatccatttctcctttgatggagaaggtgagtctgctccatatttagcttcttactctgagtaaccaaatgttatggatgggaggttagctctgtgtgtgagagaaaggtggagaagcatgtggggagggaaatagatgggaaaaggtaattaggctttatagaagggctctcattagcaagcttctaggggatgccaagatccatgcttagagattgccaggcttgtcttcaaatctcagctgtgtattactcctttatgttttttgtttgtttgtgttgtttgtttttgagacagagtctcgctgtgtcacccaggctggagtgtagtggtgtgatctcagctcactgcaaactctgcctcctgggttcaagcgaatctcagtctcctgagtagctgggactacaggcatgcaccaccaggcctggctaatttttgtagagacggggttttgctatgctggccaggctggtcttgaactcctgacctcaagtgatctgcccgccttggcctcccaaagtgttgggattagtggcgtgagccactgccccggcctattactcctttagagtgatttagagccatgtttacttatggtaacttgacagtaatgggaataaccactgatgaaacgtaaagcctttgtctaattgtttacctagttcttccttgtggttcatgaaatttttcatctctgtacagtttgaaaattaagatgataatatttagagatattttattcctttgtgaagagaaaaaaggctttcattaacagaaatcagtggcaataacttaataaatacaatcagctggtgttcctatagtatttaaaagaaaacagaaagtttactagatttcagccagttttcagactatttaatgtctattcttactataatagaaaatatataatttgatcttgttctcatttttcaaagacctttaatacatgattttagtagttgaaaatgaagtttaatgatagtttatgcctctacttttaaaaacaaagtctaacagatttttctcatgttaaatcacagaaaaagccacctgacattttaacttgtttttgatttgacagtgaaatcttataaatctgccacagttctaaaccaataaagatcaaggtataagggaaaaatgtagaatgtttgtgtgtttattttttccaccttgttctaagcacagcaatgagcattcgtaaaagccttactttatttgtccacccttttcattgttttttagaagcccaacacttttctttaacacatacaatgtggccttttcatgaaatcaattccctgcacagtgatatatggcagagcattgaattctgccaaatatctggctgagtgtttggtgttgtatggtctccatgagattttgtctctataatacttgggttaatctccttggatatacttgtgtgaatcaaactatgttaagggaaataggacaactaaaatatttgcacatgcaacttattggtcccactttttattcttttgcagagaatgggatagagagctggcttcaaagaaaaatcctaaactcattaatgcccttcggcgatgttttttctggagatttatgttctatggaatctttttatatttaggggtaaggatctcatttgtacattcattatgtatcacataactatattcatttttgtgattatgaaaagactacgaaatctggtgaataggtgtaaaaatataaaggatgaatccaactccaaacactaagaaaccacctaaaactctagtaaggataagtaaaaatcctttggaactaaaatgtcctggaacacgggtggcaatttacaatctcaatgggctcagcaaaataaattgcttgcttaaaaaattattttctgttatgattccaaatcacattatcttactagtacatgagattactggtgcctttattttgctgtattcaacaggagagtgtcaggagacaatgtcagcagaattaggtcaaatgcagctaattacatatatgaatgtttgtaatattttgaaatcatatctgcatggtgaattgtttcaaagaaaaacactaaaaatttaaagtatagcagctttaaatactaaataaataatactaaaaatttaaagttctcttgcaatatattttcttaatatcttacatctcatcagtgtgaaaagttgcacatctgaaaatccaggctttgtggtgtttaagtgccttgtatgttccccagttgctgtccaatgtgactctgatttattattttctacatcatgaaagcattatttgaatccttggttgtaacctataaaaggagacagattcaagacttgtttaatcttcttgttaaagctgtgcacaatatttgctttggggcgtttacttatcatatggattgacttgtgtttatattggtctttatgcctcagggagttaaacagtgtctcccagagaaatgccatttgtgttacattgcttgaaaaatttcagttcatacacccccatgaaaaatacatttaaaacttatcttaacaaagatgagtacacttaggcccagaatgttctctaatgctcttgataatttcctagaagaaatttttctgacttttgaaataatagatccataatatatattcttatggaaatctgaaaccatttgggcatttgggggtaaaaagtattttattagtaaatttaaatgaggtagctggataattaaattacttttaagttacctttgagatgatttttctcaatcagagcaccacccagagctttgagaaacaattttattcacagcttctgattctatttgatgtaatttttagaaaataagttttgctggttgctttgaatcagggtatggagtacagttcactctgatcctatcatataaatcatgtaagtatataacattttcaataagtgattgttggattgaagtgaatgatatttcaagtaattgttatgtcatggccaagatttcagtgaaactcaaaatttctcctggttgtgttctccattgcatgctgcttctattgattaacctaagcactactgagtagaagctggaagaggggtctaattagaaggcccctttctatgctctgcttggcttgtaaaataatttatttctctagatcccaccaacatagtagtttcatgtatgcaaaaacacccacctaaatgtcaaagtttgtatgatacatggacatatctatagaattttttttggtctggtgcatgccaaaaaataaacatgatatagaagaatttaatatttattgagtacctaatctgttccagttcaatatgaaggtctttatgcagattattttacttaattttcctagtaactccatggagcaaaaattatctctaatttatataacaggaagttgagcgtgaggcaaattaagtaactttcccaaagttacacatatggtaagtttgagagatatcccagtctctttagctccaaagcctttgaccctttcaccataccagattatgattgctattaatatataattataattataatgattgtatttaggtactcaacagaatggtgactctagtaaccagccttggttctgctgagcttctctgcgtcttctcaggagacacaggctacagagcttgaaggctgaggattcttccagggtcacttcaggggcaaatctgaaactttcttcaggacaggaatcaacgagatcttctcacttacttatacctgggggaggaactgtatgaaatccacccaagaaccagtcatgctaagggccaaacctatagacaaaaaaagggataggagaatggagtatgtatggagaaagactaaattgttcttaaacttctcaagcttaaaaatatcccagcaaaagagatcgtaaaagcccttcatggcgtattaattatccatgcatgggggtgagtggaaaggtactcctgagcccgaggctacagctttggaactagcagcacctttgaaggggaaagcgtgtttccatcatctcaactcctactgataaccaatggaatattggtgagtaaaggatcctgggggaagaagcagctgaaatgtgtaggtgagaaggcagagagaagaatatttatattgggaatggcacaagtgtgatgaggctgcaggtttttcacccttgtcatagagaaaaaaccacgctgacaccatgcagttttaaatagtgagaaatttgcaaattgttagatcttaaataatttagataaacatagtggccatttagattattgcagttttttcaggatatctgatctcttgatttcattctttttgtctcttataagaataaaagggggggagaaaatttagccattatagtatttctctacattttctctgtccttttacataacttacaccagtgccttcctatttatggtattatttatgggtatttcttcttttctttcactgagcaaggataaatgagccagggattcttgaaactactgtaacacttctcttagaaatagatggtcatactttcagaatctctacacattcttagtccctctaaacaatgatagttgtggcataaaaatatttgcttggtttcaggactgatagagaaaagtactataaaatttgctgttaactgtgaaaggttaaaaaaaaggaggtgccatcatgaaggagctaatctttctgaagtactgctgtagttttaaatattattagctatgacttctcaccattaactatgcacttgctttttcttcatctgactcagcagccagatagatgcaacattgtctttaacatttaagactcctagcaagtccgggcacgggggctcacacctgtaatcccagcactttgggaggccgaggtgggcaaatcacaaggtcaggagtttgagaccagcctggccaatatggtgaaaccctgtctctactaaaagtacaaaaatcagccaggtgtggtggcgtggtggcgggcacctgtggtcccagctacttgggaggctgaggcaggagaatagcttgaacctgggaggcagaggttgcagtgagctgagatcgcaccactgcactccagcctgggtgacagagcgagactccatctcaaaaaaaaaaaaaaaaaaaaagactcctagcatggaagagaaactggctgttgaaaacctgaatgtgagagtcagtcaaggatagtttgagggaagccaagtagaggaagctctcacaagcagattggtgagagaatatgattatacaatgcatttattatgataagaaattcacaagcattcattcaaaatactcttgattcctaggcagctctgggcatatttccaccaacaaattgaggcatatgtcagtgcagcctaggtcagactaccttttttcattaaacctcacaaaattaaaggacatacaggagaagtcctggtactcatgttgcagactacagtctatatggcaaaggaggatctctgtcccttatgtttggatgaaaacattgggtaggcatttgaatacaagcctactgctaatatggggctaaggtctttggccccctaaaggtttgctgaaatattactgacaggaggcagattgataagaggaaaagcacataaatgtatttgacatgtatacatgggagccttcaggatgaagacctaccctctcagtgcagtatggaagcttgtataccatcttgaggttacagaaagaatgggggtttggatctttgtaaaacaggtttcagtggcaagacaggttatgagaaggagaaaggaagagacttgggtagcaaagggggtcttgttttgtaggtaaatcgttggcagcccacagagaaaatagatggagaatgtttcttttcagaccttggcaggtgtcagattctcagttaatctctcctagatttgaaaaaaaaaaaaaaggtctagaaagggagagcctggctgcactaacacattttctacagatgcaaatttctcccacaaaatacagctttgcaggtccacttctatctgctgggcctgtggcaaccatttcaaaatatgtgaatgaaatatatgtgggggtaaactatttttatttacttccctaaagaagggatggtgttctctcgggaattctgtgcatagagagcctgtggcttaggcactttgatttatgtatatctcttcctgtgattggctatctagggactgctatctccagcaaatcttctaaatgtctgccatgtagaattcctttctcatctttctgtctcacccccttatctagctgcttctctaaccctagagtgacactgcactccccacaatctcctatgtcctgaatattttaccccatcctaaactccatctctaacacagatgcactttcttgtgctgcctactgcattgtacatcttccccttagttcccatgatgcaactctgccctaccccagaaaatgtaatttaattggtctgggataaaacctgggacactatcattcttgaaatattccccaagcgattctaattatatagccaaagttgagaactatttgtagacaggcatcagcatgatcacttaatgatttgacttttgctagatctaaggtgaggaaattggagagtggtatccataggaagaactgtttagtttaattttttttttattttttcttctaaaaaaaaatccaacaacgagatacatgtgcggaacatgcaggtttgttacataggtataatgtgccatggtagtttgttgcacctattgacccatcctctaagttccctcccctactccttacttcccaacaggccctggtgtatgttgttcccctctctgggtccacctgttctcaatgttcaactcccttttacgagtgagaacacatggtgtttgattttctgttcctgtgttaatttgctgaggatgatagtttccagcttcatccacgtccctgcaaaggacatgatctcattcctttttatggctgcatagtattccatgatgtatatgtaccacattttctttatccagtctgtcattgatgggcatttgggttggttccatgtctttgctattgtaaatagttctgcagtaaacatatatgtccatgtgtctttatagtagaatgatttatattactttgggtatatacccagtaatgagattgctgggtcaaatggcatttctggttctagatacttgaggaatcgccacactgtcttccacaatggttgaactaatttacactcccactaacagtgtaaaagcgttcctatttctccacagcctcaccagcatctattgtttcctaacattttaataactgctattctgactggcatgagatggtatctcattgtggttttgatttgcatttatctgatgatcagtgatgctgagatttttaaaatatgtttgttggccatgtaaatgtcttttgtgaagtgtctgttcatatcctttgcccaccttaatagggttttttttttcttgtgaatttgtttaagtgccttgtaaattctggaaattagatctttgtcagatggatagattgcaaaaattttctcccattttgtaggttgcctgttcactctgatgataggttcttttgctgtgcagaagctctttagtttaattagatccaatttgtcaattttggctttttttgcaattgcttttggcattttcctcgtgaagtctttgcccgtgcctatgtcctgaatggtattgcgtaggttttcttctagggtttttatagttttgggttttacatttaagtctttaatacatcttgagttaatttttgtataaggtataaggaaggggtccagtttcagttttatgcataatggctaggcagttttcccaccaccatttactgaataggagatcttttcctcattgcttgtttttgtcagatttgtcgaagatcagatggttgtagatgtgtggtgttatttctgaggtctctgttctgcaccattggtctatatgtctgttatcgtaccagtcccatgctgttttggttaccgtagccttgtagtatattttgaagtctggtagcgtgatgcctccagctttgttctttttgcttaggattgtcttggctatatggagtcttctttgattccatatgaaatttaaaataatttttttttattctgtgaagaatgtcaatggtagtttgatgggaatagcattgaaattataaattactttgggcagtatagccatgttcacaatattgattctttctatccgtaaggacgacactttttccatttgtttgtgttctctcttatttccttgagcagtggtttgtagttctccttaaagaggtctttcacatcctttgttagctgtgttcctaggtattttgttctctttgtagtgattgtgaatgggaattcattcttgatttgcctctctgctgcctgttgttggtgtaaacaaaattcatttcttgttcttatttgtgaaattttggaaccaaatctattttcaaattagaaattgcttgtgataatggttttgcaacttagactggatatgagacgatgagatattagttctttcattcctttgtaggaatatggtgcatcttgcattattttagctaactagtgtcctttaatgactaatgaatatgacatggtgaaacaaagtaaaatatatatgatgcactaagtatgcattgtttccaaaggttcagcattttttttttgttaactctgctgggatctgctttatgcactgataacataacttattttatgatcttaagcaaataaaaacacttatctggacctcagtttccttaactgtacaactgagggaaactgtatagtatagctatagtacagtataccatctttaccgtcacttccatcttttaaattatgtgtatataagatagggcctagataaatggtatttatcttaaattacagtgatactagcttataacttaatttgctaggtcatgttgaactgataacaatgtgtgaactgatgagcaactgagaagtaaccaggttgtgttataacagtttgtttttgatttagggttatcagtgagggtggcggtggggaggggactttggagtctaactgtctagttcaaatattagtttttgtttatttttatttttaatttttgtgggtacatagtagatgtatatatttatggggtacatgtgatgttttcatataggcatgcaatgtgaaataagcacatcatagagaatggggtatccatcccctcaaacacttatcttttgagttaccaacaatccaatgacactctttaagttatcaaatcacagttttgccagctactagccatgtgattttgggtaggttacttaaattctcttcatctcaatttcattattgtaaagtggagataatgatagcacattttttctttttcttttttcttttattttttattattatactttaagttgtgtgatacatgtgcagaatgtgcaggtttgttacataggtatcaacaactctataaaacatgttctatccaggaaaagaaactatcatcagagtgaacaggcaacttacggaatgggagaaaatgtttgcaatctagatggcgattgcaatggcggttcgctgcatccatcagcccatcatctacattaggtatttctcctaatgctatccctccccttgctccccaccccctcacaggcccctgtgtgtgatgttcccctccctgtgtccatgtgttctcattgttcaactcccacttatgagtgagaacatgtggtgtttggttttctgttcttgtgttagtttgctgagaatgatggtttccagcttcatccatgttcctgcaaggacatgaactcatccttttttatggctgtatagtattccatggtatatatgtgccacattttctttatccagtctatcattggtggacatttgggttggttccaagtctttgctattgtgaacgctgcagcaatgaacatacataagcatatgtctttctagtcaaataagttataatcctttgggtatgtacccagtaatgggattgctgggtcaaatggtatttctggttctagattcttgaggaatcgccacactgtcttccacaatggttgaattaatttacactcccaccaacagtgtagaagcattcctatttctccacatccgctccagcatctgttgtttcctgactttttaatgatcaccattctaactggtgtgagatggtatctcattgtggttttgatttgcatttctctaatgactagtgatgatgagcttcttttcatgtttgttggctgcataaatgtcttcttttgagaagtgtctgttcatatcctttccccactttttgatggggttgtttttttcctgtaaatttgtttaagttccttgtagattttggatattagccctttgtcaggtggatagattgcaaacattttctcccattctgtaagttgcctgttcactctgatgatagtttcttttgctggatagaacatgttttatagagttgttgtgagaattaaatgcattaagcacatagaatagattctggtacatagcaagtgctctctctatatatggaactctatatgtagttggtgcaaaagtaattgtggttttcaccattgaaagtaatggcaaagaccatcattaccttttcaccaatttaaatatatggaaggaatatatatataaaacctatatatatatgtcacatatatgtctctaacccattattataatatataatacaatatatattataattataattgtatataacatatgttatataataatatagtaatatttattctaaataaatatataatactataaataatataataatttatatatatgattataatatataataggctatattatatattattaacatatacatatgtgtatatatatgtctttcatagacttaaatatatagagcaataataggttagaaaatagcaaacatgtatatataaacatatatacatatagaaaacatatataaaaacatatatatatatatatatatgtgtgttttctgcctttcatttttagagacagggtctcatcatgttgcccaggctggtctcaaactcctgggctcaagtgatcctactgctttggactcccgaagtgctgggatttcagacatgagacactgcacccagtccagtccctgtctttttaaatagactctctacctaagtgcacaaatactcattatttacatttagttatttctgtatatatgctataagcaaatcttgtagcaccagtttgatttttataaggcacaagaatatattttactaatgctttaaaatggcagctagattctagtattactttagaaattaaaattaatattttaacacatctttcattattgtgttatctgaaccaaacctattattgctgctatttcagcaaatccaggggctttttcttataaaatatgaagaatatagcttagatttctagtgaagatgttaccagtaataattaataaaatcagtaagcactaaaaggaaaataccaaaactaaagcattttgaattagtcattgaatctaaaagaaaggtagatttttttctgagattctgttctaggtgtggtatatgtgtatttttgcaaaaactataaacaattgtggcaaaatgaaggaaatatttaaaaacaaacctcttaattcttcagtggattaagcgtgaatatgtttttattttctatgatgaatatggaaaaattcatttccttagcaatttgtatgagcccaaaaactattgtcagactctgctgtatcaaaatagacaaaaaattgacactcacttttaccctgccaaaagcaaaatcttaaacttttgctttagtatataagccagcattcattgtatcctatgatgggttctgagtgtaggtgtatttgctttcttccattttttgtatgcatgttttctttttatttattattgtaagttgtatgaaatttttatccaaatttttattttcttctgattaataatcagaataatcagataattactggtaaatttgatgttaatccttccagctttttcccatgggaatttatacttaataaaggggagaagtcatcattacataatgtgcatattaatctgcttctccctttaatgtgttgtgaatgcctttccatgtcattagatgtttttctacctagttactttcatgaatcatatggctgtaccatgatttatttaatcagttcctcatcattgagtatgtaaattgcctccatttttttattactataaaaggtccttcagtacacacccctttaaaagctgactcttagaaggtgttcttgactctctacctaagtgtaaaaatacaaataaattgctttccagaaaaggtgcactactattttactttcctgatactaaactatgaaaattcagtcctaacaatagatatttaaataaagttttaaaaatgccaagtgaaaaagagcatattattattttcatttgcattacttttggttcctggtgagtttaatctgtttttgtatattaattatgcatttatatttctttttgtgtgtgtgaattgcctttcatgttctttgtgtgtttttattttgttgtatttgtctctttcttgatatatgagagaatattttccctagcctgtcaattgccttgtaattttgtttctagtgagtttttttttttttttttacaattaaaagctttaatttttgaaaattttgctggcaaatctatatatctttttctttgttttctgctttgacattattcttttataaaggcccatgccacccaaatattatgtaagcatgcatctatgtttttattacttcatcttttacatttaaatatctactctatttagaattcattgtgatgcatgtatgaggtagaaatctaatttcaaaaagatgagtatccagtttgtccatcatttattgcatgatctctttctccactgaattaaaatgccgtattttataatatattaaagtattacatgtgcttggacatgttcctggacttttgagataaatcagtctatttctttgtcatgtcacatattattatggctttatgatttaatatccagtaatgtaaaccctctgacacattattcttattcctcaaatgtttttgatgagttttcttccaaatgaaatttataatcattttattcattgattcaacaaatatttgttgaatggatattctgtgcttggtattgtgcatggtattaggattgttgcaaaaattgagactgacagtccctactcttacggtgctaaaaattcacttccaaaaaaatctttaaatgttgatgaagattgcactaatcttataaaataacttggaggggaatgtaatctttgcaacattaagttcttcattttagaaagttttaagactctccatttatttgagacttttaaaatatgtcccaataatgttttgtgagatgtatattttaagatatatatcttattgctattacattgtatcttttgttatattgttactatgaatgggatactcatttaattagatgtcatttttggtatatagaaatctattttcttagcatagtcattttttaaacctcgatctattaaattcttgattcatttacatttgttacacaatcatattctatgctgataatacttcttgcttctttccaatatttgtacctcgatcatttttcttgttgagttgtattagctagaagttctagaaaaatgttaaatggtagtaatagctagtattctgttttttcctgactctaaatgtaatgcatctagacttttataattatggcattgattgtaacattttgaggaagaaatcctttttcaggttaataatgtatctttatattcaagtttattaagaacatttattggaaacatattgaaattttatcagattccttttcagttgttactgagataatcataggttcttctgtattcttttaattaatttctcaaaattaaactgtcctattattcttggaataacgacatataaagtactgtatatttaaaagaagttaaaatgataatggtgattttattaagtgacctcacacaatagaaaacagtgtagccttagaagttttccaagtgaccattctacttagaaacaaccctgctttgggatcagaactgtaatttttaaagtaaagttttctgggtttaattcatttagtgtaattacaagcatgagttcaggtttctatttttttcacctgaactttccttcatggtttgaatatctagaaaaagcagactttcctatctctagactaaacatttgatcctatcttaggtatgcattacaattttttaaccataaatggttaaagaatttagactcatctacaataactttgaagctctggtcttgaagaacatgtgagaaatgagatataactcctagaagatataggagacatttttagtcttccaaattttccctgggaggctgatctaaattgagtcacaaaattgttcccaccaggaatgcaatcacttgagctgttttctaatctgagcccctctacccagatgatcttctgaactcatactgttcagactttcatccttctgagtagaaaacagccatagtcatggcaggatgagggctaggacaattacccaaggaattcttggcctctgccatgggactctgcagactcagatcatataatcagagatgttagcactggaggggacatcacaattagctttctccacctcttagtttatcagtgaggaaaactgtccagagcgcggaagagactaaaataacacagccaatgtaggtaatgtgctggataagaatttggaattcacgattttgaattcagtgtttatttcaccatcacgctggcttacacgttggtatcaggcttcttctattattgaagtgagccattaagtgaattccatcttgatttgtgtctgatacagagtaataaactattttattaaatatccaaataattatacattcctccttcttacatgcaagcctaagtttgcttgtactatttcatgtggtagcaaatcaggacgcttcttgtgtctctgaaaatactctgagtaatggagtacagtcagctttcttgtaccaagaatatagggactatgtttctcccagtcattctggggataatttttgtgaaggattgcacttcataggttaagctaggtatcagttaccagtgttttttccaaataaaaaaaaaatcaggtgatatctgtaaatggttccattgtaaatattaaagaacatgatgcttaaaacagattagggaaaactatagaaggggtggggtttcggagtgctaattttgtccttgaatggtaacagctccatgtggtggtgaggtttatgttggtttgctgtttgcagatgatcttattattagaatttttcataccgaaaataaactgcattttagtttgtaaacatgcccttccagagtaatgctaccagttctttgtgaaatagctactgttgttcaaaggatgactatgtcctcttcggttgaggaaagatgacaacaaactcagtaatgacatgtaaaataggtattacaaaccaggtatggtggcatgagcctgtaatcccagctacttgagaggctaaagcaggaggatctgttgatctatggatttgaggctgtagtgtgttgtgatggcacctatgaatagcccttgcactccagcccaagcaacaaagcaagactgtctctgaatttttgttttgttttgttttttgtttttttttttttgagacagagtcttgctctgtcacccaggctgaagtgcagtggcgcgatctccactcactgcaagctccgcctcctgggttcacgccattctcctgcctcagcctcccgagtagctaggactacaggcgcccgcctccacgcccagctaaattttttgtatttttagtagagacgaggtttcactgtgttagccaggacggtcttgatctcctgaccttgtgatcctcctgcctcggcctcccaaagtgctgggattacaggcgtgagccaccgcgcccggcccctgtctctgaattttttaaaaaggcattccactcaaattaatacacattttaattgtgttttgttgtaaattacaactgaataaaaattcagcaaataagtctgttgtggtagggaaaagtctattgtgatctggaaaatataatggagaaatccagtggaagagattttatttcacattactcaaaataaaaaaatcttatacaagtctttacacttgtaacttgaaaaattctgtgctaaaatttagcttggttgctaaaatatttctctttttttctcagaagcttctttttagcatcctatagacacaagttactttttaaaatatttgcatacttgctttgcaatgtattgtttatcagtagttctatattctttgagatagtctatccagtctttctgtatttatcgtatgtctgtatagatatatattagcagataaatgagttctgaaaggggagaaatgtgattatgctaatcatgatataaagaattgactttataagcagtgttcacaggtcatacctttcccgttactgtcttacagtgaacaagaaatgatgctttgtctggtatgcatggtaaataatgccccttgctctctgcttcatgatcacatgtgatacttctaacatagatagcacatgtaaatccagtggccttgactgcaactcaagagagcattttggccaagtacaaacccactagtcatgaaaaaaaaaaaaaaaccaaatcaaagtaaattgatggtattgacatttgtctatgaaaaacaacataatatagaacaattctggggtaaaatattgatctaaaataattttaaggattaaatattgccattgtaagcatactatgagcaattatgtttgtaatgcagatatatttataattttaaatccaagatttaccttaattgtacattttcctaatttaaaaaagttattttgaaaaaaaaatcctcgaatctagagaaaggttggcaaatacatatggaactttgtaaaaaacatccagggcagcactttcactgattgcagtagcttaggagtgaaaaacaacacaactgctccaatgtatggcaatgggcaaatatcccgatttattcacagggtggcatgttaggcagtgcttagaataaatgagttggttatacaagtatcaatagggataaatgtgaaaaacacagtgttaagtttttaaaaagttgtaaaaagcacagtaggatgttatttatataaaatttaaaaacctcaaaaaccattcttctttgatatatattctaaagatgaacatatatgtaatagaagtacaaaacatacataaaataatatacactatgcagtcatttgtgtacttacttttcaaaaatatttcagtagatatagcaaacagttaacatgtaatatttggataggaggttggcaattttctttttagcacctgcctgtctgctatcattcaaactcacatttaaaatgtggctatgtgagatgagagaactataatattccaggtttgtgattagtttggaaactttttaaaagtttgaatgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttatatttaaagttaatattgttatgtgtgaatttgatcctgtcattatgatgttagctggtgattttgctcattagttgatgcagtttcttcctagtctcgatggtctttacattttggcatgattttgcagtggctggtactggttgttcctttccaggtttagcgcttccttcaggagctcttttagggcaggcctggtggtgacaaaatctctcagcatttgcttgtctataaagtattttatttctccttcacttatgaagcttagtttggctggatatctctcagaccacagtgcaatcaaactagaactcaggattaagaatctcactcaaagccgctcaactacatggaaactgaacaacctgctcctgaatgactactgggtacataacgaaatgaagacagaaataaagatgttctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcatagaattggaaaaaactactttaaagttcatatggaaccaaaaaagagcccgcatcgccaagtcaatcgtaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggtattaccattcaggacataggcgtgggcaaggacttcatgtccaaaacaccaaaagcaatggcaacaaaagccaaaattgacaaatgggatctaattaaactaaagagcttctgcaaagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacactactcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaataggaaagacttggaaccaacccaaatgtccaacaatgatagactggattaagaaaatgtggcacatatacaccatggaatactatacagccataaaaaatgatgagttcatgtcctttgtagagacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataaaaaaaaaaaaaaaaaaagtttgaatgttttcttgcattcagagccttggttgacatagttaattaaaaataaaacattgtatataaagcacagaatgagcagctacacaaagctgctcaatcaatgacagctctatatgggttagggtttcttgtggggatgacattgatgtagaaagcatggtcatctattgagaatgatggggctggaggtattggatacttgaggtttagaaaatacattgtagaaaatggacaaaaacccctcaaattaagggatgaggcagaataatgcttggcaataccaggggtaggctgcagtctttcttggaaatatatattttaaatggaaccaattatcatagcatcatttcctctcagggttaccctctgatccctattttactaaatcgttataaaacaaaatgaggaattatgtgtccttcccttttgaagccaatgtaacaagatgggtaagaattagacctcctgagttcaaaatccctggattcagatctattcctgtatattcaggagaagtggtaataaattcgatggacaatttggtttagtagtcgattgaggaccctgatgaggtatatttgggaaaacataacttccgctctctctcattgactcacgggcctttgaggagtccaggagtcattggaatctggcctgaggttgaggctgctggcaaaactccttccccaaagtccattcctattgctgactgagaagggactagcattggaagtggctgattttaaataccgctagtgctggtgtgctcctccctcccattcccagctctgctttgtgtagttgccttgagaagctaagttcattctgaaaataatgccattgcacaaaacacttttgaaagttctagtttgaaattacatcaggtcacttggtctgtgtggcctcagtttcttcatctgccatgtgaaaataataatgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgttcagcaagaagagtataatatatgattgttaatgataacccaaacaacaaaagatttcaccttaactggttgtcataagtagtagtatccaccgccttattttgagttggatttttatcatcctatgagccctacaaatttaaagtttttggaacagcacgtgcattgaacccataagaacctactctgcttttctgcatgtattgtccagacaagagaccaaattgccgaggcatcatttaggtgaattctaattaacatttagctaccttacaaccacaattcaaggttgtttcaaaggcatgtgcttgcatcatcctgattcactaccatgtgttactaacttggatctgcaaagtcattataaaaagctgttttgatggacttatttggatattgctttacccttcttctctcttttcttttatcaatgtaaaaacattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaatgttttatttcaatctgaacattttacgtaagtgaagactttgttagatatcatttggaatgtggaatctacacagttggcatatcagagaaggttgaattcagtttaataaatgtttatagaaagtgcttgttatcataatgataatagctcaggatgtgcatgacaagcttttaagcgattgggtacactatctcatttgatcttctgcacaactattaatggtaggtactattatccctatcttatggataagtaaactaagatttaaaaagtacagaacatggtgtgaacactgcttcaaaatttctaaaataggtaaatcacgatctctaaactggagggttgtccaaccactagggacaatagagtactgatatttagtggtcagactgtaatgcgggaagagacaggcatgggctaaacgggtgtagagatcaaataaggggcaggttagtttgtaaacatgtccatatgtaacatttagcacaaatacaggatataggtgctttcagacccagctgcattgataaaaagttaggtggtattgtatctgtcttcctttctcaatgttgcatatctgtgttcttgcccagtttgcttcatctctctagccacacttattggcctacaatggcatcatcaccaaagaaggcaatcccatctccgtgtggctttggtttgctccctaaagtaaaccttgtgtttacttttcccaggtctcatgctttcccatatctgacctgttttgtcctcatggccaggatatgtgggacctttcctacaatgttccaaagtttgtaatagagctcttctctgctttgttccaaattctgcaacattttactttaaataatgaatttaaatacaaacaaacttgagctttgcctatacttttcaagaatgcagagataactaaattaataaaaatattcattgagtccttactgtgcacacagctctatgttaagccttgtgcagaactcaaagtcactcgagattaagcctgttactaagttatgtgcaatttagctcagtggatttcccccacttcatattgctctgataatgttttggaattaactgccttgattccttcttttctctgcttgtctatacactatttattattctacaccatctcaaattctaactcctcaagaaaatccttccagatgatttttctaaccaggagttttaacttccttttaactaccctattactttctacttccttaactcatctatcatattatatttagttatttatatactaggtcgccttgaagaagggattgtgttttcataaatcttaataatccctgaggcatcaagtacagtgatttgcatttactaaatgctcaacaaatatgtgagggattcacttgaaactaatattagataattcccagtcaaagtgatctaatagcaaatcaattcttcagttttataggcaaagtatgactctggttttccataatcataattaatttgtcaactttataattttaattaagtaaatttaattggtagataaataagtagataaaaaataatttacctgcttaactacgtttcatatagcattgcatttttctttgtaaaatttaagaattttgtattaataaacttttttacaaaagtattaattattcagttattcatcatatacttttattgacttaaaagtaattttattcaaaagagttagtataggactacatgaaaaattcaaggccaaggcttaatttcaaatttcactgcctttggctctatcttttaaaacaaaacaaaaaactcccgcacaatatcaatgggtatttaagtataatatcattctcattgtgaggagaaaaaataattatttctgcctagatgctgggaaataaaacaactagaagcatgccagtataatattgactgttgaaagaaacatttatgaacctgagaagatagtaagctagatgaatagaatataattttcattacctttacttaataatgaatgcataataactgaattagtcatattataattttacttataatatatttgtattttgtttgttgaaattatctaactttccatttttcttttagactttaaagctgtcaagccgtgttctagataaaataagtattggacaacttgttagtctcctttccaacaacctgaacaaatttgatgaagtatgtacctattgatttaatcttttaggcactattgttataaattatacaactggaaaggcggagttttcctgggtcagataatagtaattagtggttaagtcttgctcagctctagcttccctattctggaaactaagaaaggtcaattgtatagcagagcaccattctggggtctggtagaaccacccaactcaaaggcaccttagcctgttgttaataagatttttcaaaacttaattcttatcagaccttgcttctttttaaaactttaaatctgttatgtactttggccagatatgatacctgagcaattcttgttctgggttgtcttatgtgaaaaataaattcaaggtccttgggacagataatgtgttttatttatctttgcatatccattacttaaaacagcattggacccacagctggtacaaaattaattactgttgaattgagcaaatatttattctaaatgtctctgtcaaatgacagagtgtggttgtgtggattaagtccctggagagagttctttgttctctcatgttctatgctgtggttcttgctttatgcaaaaagaagtaagttacttaaaacctggacatgatacttaagatgtccaatcttgattccactgaataaaaatatgcttaaaaatgcactgacttgaaatttgttttttgggaaaaccgattctatgtgtagaatgtttaagcacattgctatgtgctccatgtaatgattacctagattttagtgtgctcagaaccacgaagtgtttgatcatataagctccttttacttgctttctttcatatatgattgttagtttctaggggtggaagatacaatgacacctgtttttgctgtgcttttattttccagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacaggtagcaacctattttcataacttgaaagttttaaaaattatgttttcaaaaagcccactttagtaaaaccaggactgctctatgcatagaacagtgatcttcagtgtcattaaattttttttttttttttttttttgagacagagtctagatctgtcacccaggctggagtgcagtggcacgatcttggctcactgcactgcaacttctgcctcccaggctcaagcaattctcctgcctcagcctccggagtagctgggattagaggcgcatgccaccacacccagctaatttttgtattttagtagagacagggtttcaccaggttgcccaggctggtctcgaatgcctgacctcaggtgatccgcccacctcggcctcccaaagtactgatattacaggcatgagctaccgcgcccggcctaaaaaatactttttaagatggtgtaaatattactttctgtatcaatggtacattttttacttgtcagtctctagaatttctttataaatatgttgattcagttcatttttgtagattataaaacaggtaaaaaaggataaaacatttatgtgaattaaagggaatacctaatttttgtgtagagtttattagcttttactactctggtttatggatcatcacaccagagccttagttactttgtgttacagaataactaatatgagtgaatgaatgacttacacaagtcactgcttaggataaagggcttgagtttgtcagctagagtatgacagaaagtatctaagttttggagtcaaatagcactttgtttgaatcccagattgcatgcttactagttatgtgaccttagtcaagccacttcacctcactgagtctttgcttttttcatctctaaaatagagatacccaccgctcataggctgtcataagggatagagatagcatatggaatgagtctgtacagcgtctggcacataggaggcatttaccaaacagtagttattatttttgttaccatctatttgataataaaataatgcccatctgttgaataaaagaaatatgacttaaaaccttgagcagttcttaatagataatttgacttgtttttactattagattgattgattgattgattgattgatttacagagatcagagagctgggaagatcagtgaaagacttgtgattacctcagaaatgattgaaaatatccaatctgttaaggcatactgctgggaagaagcaatggaaaaaatgattgaaaacttaagacagtaagttgttccaataatttcaatattgttagtaattctgtccttaattttttaaaaatatgtttatcatggtagacttccacctcatatttgatgtttgtgacaatcaaatgattgcatttaagttctgtcaatattcatgcattagttgcacaaattcactttcatgggctgtagttttatgtagttggtccagggtgttattttatgctgcaagtatattatactgatacgttattaaagaatttcctacatatgttcactgctgctcaatacatttatttcgttaaaacaattatcaagatactgaaggctgattggtaactcacatggaactgggagagtatacaattctgaaccaaatagatgattctctattattatatcttaatttatgtgttatggtatattaaacatgaaaaaaattgtatttggttagaatatgtttgctcttccttaactcgggaatgacatagggtaatattcacagattgggttcctataaatcctccacttgaagtgaagtcagttcaagtaatgaaagctacctcctgagatagaatcagtacttggcacctatctctagtgttctttcacctcatataacctttcactgattagtaaagattatatccaacaaagaaagtacagcacagactgagatatgattactgagataaatttgggcaaaatataaactacagcatttctgtagcaatgagaccatttttcttcagttgagctccatgttctacaaacttcaatcaaaaaaggttctaggagactcagtgaaagttgatacactgttcaaggaacaaataatttcagcacatgggaatttcacagggaaaaatatactaaaaagagaggtaccattttggatggtgtcaatatgggttatgaggaattcaggctgctgagtccagtgtacaatggaaactgagctgcaggtgtgtgattgtaacaacaaaagaaatgctgaaatattaagtcctttgccatgtaaatagaaaaagagtatttatttcccaaacattattgctcacctgtttttgttatgcctttcaagataaatccaggaaaggaattgcattttctttccagaaaacaagttcttgggggaattgttcaattggtagatgttgtttttctcattaacaagtgagtgctccatcacacttgctgagtgctccatcacacttgctctctgcattactcctctgcctgcaaacacatatatagcaagggtgatgacaaggatatcagagggtctggttttctcaaactcatgataaactcatggctgggtcattcttggtgctgattttactttgttttttgttgttattgttccctcttcctcaaaagatgaaatctatccctcttacttggaatttctctttgatatatagcgaatgtttggttgtaacctgtataatctggcatgaaattgtcactcgaaaaggctagaagtgttgacataaatatgggacagcaagagttgctcctactcaagagagcaaatataatgttctggaagagattggcagaattcacatcaaaggagtgattacttcagcctgggccactgttgtactggtcaaaaggctgtgcaaagctctctgaaaatccactcttttattgctctttagtaataaagtcactttcaattttaaaaataacaaactgatatatttttatgactcataaaatgttagcaattatattatggagaatctactttctgggtgattcttacaaatgttcttggatctatttttttttcttatagtacctattcttcccatttttctcagctctagttaatatatttcaacaacagttcaacaaatttaacatttttataaaaagtgtttcctatcattttataaataccagcctagtccatgttattccttttcttgttgaggagaaaggacacacattgtaaattcaaatatagacctctactgtgctatttaatcttggtaacaactccacaaaggagatgacatgttttccttctatagaggtagattctgtaaagttagagggaagagtgacttgcttaagatggcataagctgtaactggcagaaccaggattcaaagccaggtgggatgccaaaatcataatctgtcttcagtgtcaagttactgaaattggtaaacattagacctaaatagacggaattgcaatccgggttgggcacattaaactccattttcttcatcaatgtgctcagattacattttacttttcaggctaaaaatggaaaaaaagagtccctcttagttctgcacttgagaatgagaatagcttttctgaattatacaaggaagaagaactaatgcccaaatgccaggtacccacatgcactatgccatggcacagctgttgccccctttcaccagagccctctctctgtatcctggttgacctttccttgggcaagagctgggtggggaggatcacaagtgactccaatttggatggcttcgggaagactgggaccgagctgaaggcagtgttgtcctctgcactccctgttttctgtctgctggagcactgaagcctcacatatgtattaaaaaaataatttccatttgcatttcagactagaagattgaacgtatagtgtaatgtgattgcaaataattatattgaaatgagacagagaggatgtagtatctactgtcataatttttcaaaacccacctgcaacttgaattaaaagaaccacttgggtttttttttttgtttcaaacgcaaatcctggaaacctactgagactcattcagtcagtatctctaagaggcaagcttgagactgtatatttaaaaagcatctcaggtgatttttacacatgctaaggcttaagaaccacttctctgtagcttatatgttattttcaatgttcctcaaagccaagttagaatttccaaagtgttaagaatccattagacaatcacagaattgtctttttcctttataaatcttgcaatgttgttctcatttccatacttaattacttaaaacaccaaccaaccaacaagcaaaaaatgattagtctaactaatattacaagttaataatgaagtaaaggtttaaaaataatgtcataataatgttaataacaaattattaattataatttaaaaataatatttataatttaaaaataatatttacaagtactacaagcaaaacactggtactttcattgttatcttttcatataaggtaactgaggcccagagagattaaataacatgcccaaggtcacacaggtcatatgatgtggagccaggttaaaaatataggcagaaagactctagagaccatgctcagatcttccattccaagatccctgatatttgaaaaataaaataacatcctgaattttattgttattgttttttatagaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggtaatgtaccataatgctgcattatatactatgatttaaataatcagtcaatagatcagttctaatgaactttgcaaaaatgtgcgaaaagatagaaaaagaaatttccttcactaggaagttataaaagttgccagctaatactaggaatgttcaccttaaacttttcctagcatttctctggacagtatgatggatgagagtggcattttatgccaaattaccttaaaatcccaataatactgatgtagctagcagctttgagaaattctaaagttttcaagtgataagactcaatttatacaaagctaattggataaacttgtatatgattaagaagcaaataaatacttattatgcttttttgctgtttatttaaatatttaacccagaaaataagtcactgtgacagaaataaaaatgagagagaagggtgagccactcttaggtagttctggcattatttaatctaggccagaggttgcaaatggtgtcccatagaactaattttggctcctagacctgtcttatttaacctttcatttaaaaaatttgtattggttgccagcaattaaaaattgggagatgtctcacacacacacacacataaacacacacactcatgtgtgcagcctcttttgaagaattggaataactagtcaactgcgtcctccttttccacaagctgtgacagctccctgctcacagagcacctgccctctcctgttcatcatgctctcttctcagtcccattccttcattatatcacctatttggtcctgagactaagtgagtttgagatctgtgatttagacaaagtggtgaatctagctctgaatcatagtaagtagctctgggaatcatcttgtcttctgttagcccattgagagagaaatagagagagagagagagagaaagaaagaagaagaaacagatctggggagagtcactgaatgggagcatagagacagagaaacagatctagaaaaccaaactgggagaaaatgagagaaaccaaaagagaggtagagaggagcagagaagaaaatgaagaagcaaggcaaggaccaggctttttcattatttcttatggccaagacttcagtatgcgtggacttaattcttccttatgctcctaccttccctagggaaactgatttggagtctctaatagagcccttcttttagaatcacagtttgatgccttaaaactagttatataccttcacatgcttccttaacccacagaagtgatgctaatgaggcccttaataaggagcgtgctattaagatgaagacattcattttttttctccgtccaatgttggattaaggcacattagtgggtaattcagggttgctttgtaaattcatcactaaggttagcatgtaatagtacaaggaagaatcagttgtatgttaaatctaatgtataaaaagttttataaaatatcatatgtttagagagtatatttcaaatatgatgaatcctagtgcttggcaaattaactttagaacactaataaaattattttattaagaaataattactatttcattattaaaattcatatataagatgtagcacaatgagagtataaagtagatgtaataatgcattaatgctattctgattctataatatgtttttgctctcttttataaataggatttcttacaaaagcaagaatataagacattggaatataacttaacgactacagaagtagtgatggagaatgtaacagccttctgggaggaggtcagaatttttaaaaaattgtttgctctaaacacctaactgttttcttctttgtgaatatggatttcatcctaatggcgaataaaattagaatgatgatataactggtagaactggaaggaggatcactcacttattttctagattaagaagtagaggaatggccaggtgctcatggttgtaatcccagcactttgggagaccaaggcgggtggatcacctgaggtcaggagttcaagaccagcctggccaacatggtaaaacccggtctctactaaaaatacaaaaaattaactgggcatggtggcagatgctgtagtcccagctgctcgggaggctgaggcaggagaatcacttgaacctgggaggcggaggttgcagtgagctaagatcacgccactgcactccagcctgggcaacaaggcgagactctgtctgaaaaagaaaaaaaaataaaaataaaaataaaaagaagtggaggaatattaaatgcaatataaaagctttttttatttttaagtcatacaatttgtttcacataacagatcaggaaataatacagagatcataagttttggagctgggtttgaatcctggctctgccatttactttctgtgtaatctaagtcaagttactgaactttgtgggccctctggctctccatgtgtaaaatggagaatattaatatttaccttgcaagtttgttgtgaagactgaaggagagaatttaggtaaaacattcatcagagtaccatgcacacagttgttcctcaataaacattagcttctctgattgcaagttccagtctaaagtgctttatatataccagccaataaaaggatgcgagagagatataccagtgtattgttttctaccattttaaacctattttcatccactgttacaaattctatcatactgctccacataaaaaatattatcaatgatttttagtctctgaagtgcaatatttgattattgagcacacctgttgaagttttagtttcttctcacttacatgggttgtgtaaaggtaggaggtataaaaccagtgtcctaggtctaaatctttcttaatgtcatactttggattcattgatataagtaacttgagcaccagcgcttcattttacttcattttttaaagatatagtaagagtaattcccatctgcctagcaaaattgttttgtagaaaagtttgtggatcagatttattttactttgattttaggaatttcaagtgtcttcgtcggcatgaaggaaaaatatgcagtttgacattttctactactttcaggtcattattttcctactctggtgcaaaaaccctcaattcctgtctcactccatctaatcaaataggtagcatgcttgagcccttactatgtgccaggcactaggataagcactttatatgttttgtcccaattaattctcacagcatttctatgacctaaataaaattaatattttcatttcaccaataataaaatggaggcttcaaaaagtttagggacttggctcagctcacacaactggcaaggactgaaaatggattttagtcccaaatgtcataggctagagccctttcactaaactgttgtcttccatctggtggcatcctcttcctccagtctttgtcacctaaactctgggcaccccttgatggcatttacttatgatggtgatgcttgttaaacttcctgtttgcgacttcaacgtccatataaatgagtcttccaatactgtacttagaacttatattttgtagtgacttctttaaaagctttctctcttagtcatatcctgagttttgttagcacctggacttaccttactttggaaatgttgcactctgaaatctctttctcagcttggaatttcctaatcttccaactgtttgagtcttttaattctacatttactgcctttccatttcatcaggatttctagtctctttaattcttccttttgaactcctcctgatttaacctctgcttattcgaagaacaataattttattctctcagctgcactctcaattcccttttccttttggtgatttttctttttcctacagaacacttactttatcagttttggagaaggaagtgctatctgggtaacagtagtgctatctgttgactctagtcaactgtaagttttatacatttattgtttaaaccttatatgggtctataatccttcttgggaaatcctttcatttgtctttaatttcctttaccatttccctaaaggctattccagatttttatcacattcacaaaattcccgtcttttctcaggatctgttcacccccagtagatagccttgtctcccacaatacatggagaaaatagaggccaccgtcatatttgaatgtttccaacttctctcttcacctttggaattatctttttcttcttttgtgtctaagagaaagatgtatacttcttcttacccttgtctgaactactctattttgcttcatcttctcagaacaggggaccagcaattattcttcctccagaagcttcaacatcttttgtcaactgactccttctcatgtttaaatattttcaagttaaacaatttctttcctgactttcgctcacgcaacctcatgcccaaaaccttatcactcttcttccctttgctgtcaaggctgttctcacttcttcactttttgtggacttctccccactacaacatagattctgctatcaccaatctattaaaactgttatactcttgtggaatttatcatttaatttagcttcagtgaaccgttctttccagattattttggcctcagaccatgacttctaagtctgccgtgcttgccacttaagtgatgatgggccagtgggtccccacctaggcctctgtgttagtctgttttcatgttgctgataaagacatacccaagaatgggcaatttacagaagaaaggggtttgagggactcacagttccatgtgactggggaggcctcacaatcatggtggatgatgaaaggcatgtctcacatggaggcagataagagcatagaacttgtgcagggaaacttccctttattaaaccaccaggtcttgtgagacttcttcactatcacgagaataggatgggcaagaccctcccccatgattcaattatctcccactgggtccctcccacaacacatgggaattatgggagctataattcaagatgagatttgggtgaggacatagccaaaccatatcagcctccttctggctttttatgttctccgtgggtgacctctctcaggctcaagtgataaccaatgtgctgatgactctcaaatgcgcatctctggcttcagtttcttccttgaacttcatacatatgtttccaaatttcctgcgtgtacctcaaggttcttgttcatcacttcccaagcttcataaacgcactcattttagtgtattctctgtctcctttgatagcatccctgagaggcaagtccctggtgagttatatacaactcctcccttgctccaaacctgagagtaagtaacattcctattaacatattaggaagctgaggcttagacagtttaagtaactcaagcatggttacacaactagctagggcagagctaaaatgtcaggctaggcttctgtgactccaaagccctttctcacttagcatatcatcacttatttttttttttaatcacatatatgatttttttttctttaagagatagaatcttgctctatcacgtgggctggagtgcagtggcacaatcatagctcactgtaaccttgaacttgggctcaagtgatcctcctgccttagcctactgagtagctagggctacagacacacaccaccatgcctagctaattttattttattttattttattttttgagacagagtctcactctgtcacccaggctggagtgcagtggtgcgatcttggctcactggaacctctgctgcccgggttcaagcgattctcctgcctcagcctcctgagtagctgggattacaggtgcctgccactgtgcccagctaatttttgtatttttagtagagacggggtttcaccatcttggccaggcttgtcttgaactcctgacctcgtgatccactcgcctcggcctcccaaagtgctgggattacaggtgtgagccaccacgcctggccacctacctaatttttaatttttttgtagagacagggtctcactacgttgcccaggctggtcttgaactcctgttctcaaacaatcctcctgcctcggacaccccaagtgcagggattacaggcatgagtcattgcagctgacctgtatatatgatttttagtatatgtaaatatacatatttattaaatgtaaatataaatataaatgtgtggagtgatatccattgaaatgttaaacatagttctcagtggtacaactacaggtgatttctcttttcttatttctggttttctgtgttttccaaatttcttgaaatgtgtcttctgtaatcagaaataaaagttattagtaacaacagtcttccactggtacaagtgcttattggataaaagtcccacttctaagcatgatactcacaacttttaggttaatagcctttgtcaccttgccatatacatctgatccagccactcacaccattcctgagatatattttgttcctttgtgcctaaatcattgtgcatgcagatccatcttcctggaacacctataaccatttcttagtcctgtgaaatcctacttacatccttcatagcctagcatgtatgtcatttatttggtcaagggtgagttggttgttctcttgaatgtactgccatatgacgtggtgtgatttcaattgtagcaccaagctcattgcaatattaattcgtttgtcattctcccatgtaggatgtttgaagtagtttctaacacagagattatactcaataaatatttattagataaataaatgaataagggaataacaaatgcctttgtctcattttaaaatactttcattgttagctacccatataataaaaaactaaaagcagtagttttcaagcatgattgtttatgtatgccttaaaagaattttgaaaacctatgtacccctgacacacttttaagttaacttataaatttttcaacatagttttaagtggtggcaaatgatgtagtttcttgtgtattttaaactgcttaagtatgctatacatggatttcttcaaaaccctgaagctgcagtttcagtgcattcaatttatggaaaagaaattaatttataaaattggttcttattgtcaagtcaatcagctaaatataacttgctttctgtcaggaaaagtctgactttaaaatacagataagtaataactattattaattaattaaattattaaaattaaaataattaaataatttgttaattaaaatgccttattcccctacttatttctgcaatttgactctaagaatagataggacatgtagattgccttaggtttgaaatctgggtgaaataagatactgcctccttcagtatttctgcctttgcttttatgggagcctctttcaagaaaaagtcattctctcatggtccctttgtttgagtcccagaggttttcctactccagaaagtgcaacgtagtgagactagtactatactcccttgcatggtaagtgagaaggctgtctgtataaaatgagggaaggactcatgagagggaagtaggtcaggagaaatgataggttctcaggcaggttaattttaggaaagagtgaatagagtcccttaaaacaaggtgcatctgcttcctcctgatcaatctttaggactgtttactttgatttgaagaccactatgctaaagcttcccacgggggcaatagtgaggcaaggaatttttaaaagggaattacttcttcgtagctacttttgtgaaatgaattcatttgaattatctggcaatctcttcatatttatattcaacaataattacttaaagaaatgctttgagcttctcagaggagggtgctaccagtgtgatggagtagaattcagatttgggtagtgactttaaagctgtgtgactttagtcatttaactgctgagtcacagtctacagctttgaaagaggaggattataaaatctatctcatgttaatgctgaagattaaataatagtgtttatgtaccccgcttataggagaagagggtgtgtgtgtgtgtgtgtgtgtgtgtgtgtgtatgtgtatgtatacatgtatgtattcagtctttactgaaattaaaaaatctttaacttgataatgggcaaatatcttagttttagatcatgtcctctagaaaccgtatgctatataattatgtactataaagtaataatgtatacagtgtaatggatcatgggccatgtgcttttcaaactaattgtacataaaacaagcatctattgaaaatatctgacaaactcatcttttatttttgatgtgtgtgtgtgtgtgtgtgtgtttttttaacagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaaggtagttcttttgttcttcactattaagaacttaatttggtgtccatgtctctttttttttctagtttgtagtgctggaaggtatttttggagaaattcttacatgagcattaggagaatgtatgggtgtagtgtcttgtataatagaaattgttccactgataatttactctagttttttatttcctcatattattttcagtggctttttcttccacatctttatattttgcaccacattcaacactgtatcttgcacatggcgagcattcaataactttattgaataaacaaatcatccattttatccattcttaaccagaacagacattttttcagagctggtccaggaaaatcatgacttacattttgccttagtaaccacataaacaaaaggtctccatttttgttaacattacaattttcagaatagatttagatttgcttatgatatattataaggaaaaattatttagtgggatagttttttgaggaaatacataggaatgttaatttattcagtggtcatcctcttctccatatcccaccctaagaacaacttaacctggcatatttggagatacatctgaaaaaatagtagattagaaagaaaaaacagcaaaaggaccaaaactttattgtcaggagaagactttgtagtgatcttcaagaatataacccattgtgtagataatggtaaaaacttgctctcttttaactattgaggaaataaatttaaagacatgaaagaatcaaattagagatgagaaagagctttctagtattagaatgggctaaagggcaataggtatttgcttcagaagtctataaaatggttccttgttcccatttgattgtcattttagctgtggtactttgtagaaatgtgagaaaaagtttagtggtctcttgaagcttttcaaaatactttctagaattataccgaataatctaagacaaacagaaaaagaaagagaggaaggaagaaagaaggaaatgaggaagaaaggaagtaggaggaaggaaggaaggaaagaaggaaggaagtaagagggaagcagtgctgctgctgtaggtaaaaatgttaatgaaaatagaaattaagaaagactcctgaaaggcaattatttatcaatatctaagatgaggagaaccatattttgaagaattgaatatgagacttgggaaacaaaatgccacaaaaaatttccactcaataaatttggtgtcaggctgggtgcagtggctcacacttgtaatcctagcacttttggaggcagaggcaggtgaattgcttgagtccaggagtttgagaccagcgtgggcaacatggcaaaccccacctctacaaaaaacacaaacaaaagaaaatagctgggtgtggtggtgtgtgcctgtagtcccagctacttgggaggctgaggtgggaggatcacctgagcctgagaagtggaggctgcagtgagccatgattgcaccactgtaccctagcctaggtgataggctcaaaaaaaaaaaaaattggtgtttgcaatgctaataatacaatttggttgtttctctctccagttgttttcctacatacgaaacagcttttaaaacaaaatagctggaattgtgcattttttcttacaaaaacattttctttcttaaaatgttattatttttcttttatatcttgtatattattactagcagtgttcactattaaaaaattatactataggaggggctgatactaaataagttagcaatggtctaaacaaggatgtttatttatgaaaaggtagtaattgtgtttcatagaatttttaaaattaattctgcgtatgtcttcaagatcaattctatgatagatgtgcaaaaatagctttggaattacaaattccaagacttactggcaattaaatttcaggcagttttattaaaattgatgagcagataattactggctgacagtgcagttatagcttatgaaaagcagctatgaaggcagagttagaggaaggcagtggtcccttgggaatatttaaacacttctgagaaacggagtttactaactcaatctaggaggctgccttttagtagtattaggaatggaacactttatagttttttttggacaaaagatctagctaaaatataagattgaataattgaaaatattaacattttaagttaaatcttacccactcaatacaatttggtaatttgtatcagaagcttaaaagataacctaatagttcttctacttctataacttacccaaatatgtttgcagagatcttatgtaaagctcttcattataacactgctttcaggagccaaaaattgggtgggggagccccataaatgttgaataataggggtttgattagataaattttggtgtagttctataatggcgtgttattcagccaataaaaggtttgttaaagaatgactgtgacggatgtatatgatatactcttaagtgaataaagagttacaaaatgttatgtacaagttacaaaatgtatgtacattatgatccatttttcataaaatcatatgtatgtatatatgtgtgtctggaaggataaatttatcaagttgttatctctgaaattttgggtatattttatatttctagattttctgttactttgttactttactgataaagtaataacgttgttgacttttgtcactctcccctattaataatcatctaggctgcaaaaggatcatgtcttctttatttttatattccaaggactgtcaacaagtgcctagcacttgacaggtatattatagaaatttaactgaatatctttaggaaatagatttttgtttgtagttgttctagtctacattaaatgtcttgcgcttatgaaacttccttgaattattttagtgaagcaatattagtatagaattttgcatcactggatgcccttgactgaaagctggcttatggcatctcaccagtgtgtggggagtttcagtccttctgttgtctgcatcacagctgaagcagtgctgttgctgacaattcctgacaccaccttgtctctattattgatcattgcctcactatggtactgagttttagcttattcttgtaataactgggactcatatgtatagaataagctattagctcacgtttttgcttgctttttatacagaatacatgtctgcaaatagttttatcaatattttggaattttgggagatatgaagttaaaaacatcattgaatatatatatatacacacacacatatatatatgacactatacatgatttattttatttaatttttaaaattttattctttttagagattaggtcttactctgtcacccaggctgaacttcagtggtgtgatcatagctcactgtaaccttgaactcctgggctcaattgacctttccgcttcagcctcccaaagtgctgggtttataggcatgagccactgtgtctggtccaatatgcatatatatatttttaacctggattatcagagctatattgtgtttaggtttataaagctgtactatgtgaaaatatcacttctaggtttaattttgtacaaaggaattttatatagaaatgaggtaattcagattttttcccatgtaataagaattgtaaaatttactgaaacaaacatcaaaaagatatctgttacatgaccttcctttcttttgaatatatttcaggtgatattatttattaaaatttaaaaatgaaaattaaaatatataaaaagttgaaaattattcctttctttactgtctctcatctgtccattttccattctcctgcattccctcatccaaccaaggtagccaatccaggtaactttttttagtatcttcccagagatgtttctctctatatatataatcaatatacattttttattattccccacctctctttttatgtaacaatatgcagagttttgcttcttgcttttcccactatcttggacaactttccatattcaaagcacagaggacttgcacatatgttcagactgctgaatatttctgtctctcccctgccattcatatgttgaaatcctaattcccaaggtgatggtattgcagggtggggcctttgggaggtgattagtccatgagggtgaagtctttagtaaatgagattagtgtctttataaaagaaaccttagagagaccctcacaccttagagagaccctcacccctttctgccatgtgagaacacagcaggaagacagctggctatccaggattcaggagtctcttagcagacccaaatctgctggcaccttgatcttggacttcccagcctccagaactgtgagaaataaattcctgttgtttataagccacacagttcatggtattttgttatagcagcctgaacaaggacacacacacacacacacacacatgcacacacatttaaatagatgcatagtattctatcatatggatggatattctatgatataatgaatcactattgattgacatttgggttgtttccaatattttgttaacacaaagaacaacactacaaataactttatatacatatcatttagcacatctgcaattgtatcagtaggcttcctataagtggtcaagcatttgtgtacttgtgattttggtagatgttgtcaaatgtccttccctgaaatttgtaccaattcgtactcatgccatacactctaaatagagtgctgatttccccacagcattactaacagatgatattatctaatttaaaaagtttctcatcttatagggaaaatagtatgtcaatgtattcttaacttgcatttcttttattataagtagtgtaaaatatcatttcaacttatacacaggaggaatttctctctatataaagtgatcctagaatcataatgaaaaatatcaccaactcattaggaaaatgtacaaaggattgaatagatatctcatcaaaaataaaaatataagtggcctttaaacattgaaaggtaacatttgaacaaagacttgcaggaggtgagggattagggaatgcagactctgggaagagtcttccaagtagcaggtgaagcaagtgcaaagctttcagatgggactgactatacctgtctggtttgaagaacagtaaggaggtcactgaggctggcatagagtaagacagggagggtagaatactgtcagagaagtaatcggcggtggaggtagggggtaaaccataaagtgctcgtaaagactaaggcttatttctctgggtgagattagaggccactggagagttttaaacagaagtaacagggccactttggctaatgtttttaggctattctgtagggagacaagggaggaagcaaggagatgagttaggagtctattgtgccagttcaggcaagtgatgatggtggcttgatccaggtagtagtggaagtagtatagtaggaagtgatcagattcaggacatgctttgaaggaagatccaataggattaatggataagttgaacaatggcatatgagaaaagtcacagaggagtcaaagatgattccaagctttctggactgagtaactggaaggataaatgtgccgtttactagaaagataatgggagaaacaggttttggatggagcttggtttgggaatattaagtttgaaatgcctatttgacatccaaatagagatgttagttggatgtacaagtctagtttcaaggaagagggggctggtagtgtgaagatggggctggataagattctaaaggaaagagggttgataagaagagaaaggggtgtaggggttagcctaagggcattctaagtattagaggttaaggaggtgggtgaagaaaacccaataaaataaaagtctgagaagacaaagctagtgaatgaatgtggtatcccggaacccaactgatgtcaagcagaagggtgttatcaactaggtcaaatgctcattcatcaagtaagatgaaactgttataattaaccggtgtcttctgaaatacggagataactcgtgacttaatgaaagcaatagtagagaaggtcaaacttgaccagaatgaaattagaaagaataagaggaaagaaaagaccaaatacagacaaccattgatgccttattcttttgatatactcctggagtccacttgctaatacaattgacccttaaacaatacaggcttgaactgcatgggtccacttatttgtgaattttttttcagttaatacattggaaaatttttggggttttttgacaatttgaaaaaactcacaaactgtctagcctagaaataccgagaaaattaagaaaaagtaagatatgccatgaatgcataaaatatatgtagacactagcctattttatcatttgctactataaaatatacacaatctattataaaaagttaaaatttatcaaaacttaacacacactaacacctaccctacctggcaccattcacagtaaagagaaatgtaaataaacataaaaatgtagtattaaaccataatggcataaaactaattgtagtacatatggtactactgtaataatttggaagccacttcctgttgctattacggtaagctcaagcattgtggatagccatttaaaacaccacgtgatgctaatcatctccgtgtgagcagttctctctccagtaaattgcatattgcagtaaaaagtgatctctagtggttctcgcatatttttcatcatgtttagtgcaatgccataaaccttgaataacatcaagcaatccatacaaagtgccactagtgatgcacggaaaagttgtaacagtacaagaaaaaagttgagttgcttggtatttaccatatattgaggtctgcagctacagttgcctgcaatttcgagataaatgaacccagtataaagactgttgtaacaaaagaaaagaaaatgtgaaaccatcagtgcagctatgccagcaggtgtgaagtcttgcactttttgcaaaatacaaaatatgaaatatgtgttaattgactgtttatgttatctgtaaggtttccactcaacaataggctattagtagttaagtttttgtggagtcaaaaattatacgtggatttttgactatacagtgggttggcacccctaaccttcatgttgataaagggtcaatggtatattatttaatttttttgtatttatattcataaataagattaaatctatatttccaagtaatctctataagattttgttattaatattactattatttttgagacagagtcttactgtcaccaggctggagcacagtggtgcgatctcggctcactgcaacctctgcctcccgggctcaagcaattctcctgcctcaccctcccaagtagctgggactacaggcacgcacaaccacactcagctaatttttgtatttttagtagagacggggtttcaccatgttggccaggatggtattgatctcttgacctcatgatctgcctgcctcggcctcccaaagtgttgggattacaggcatgagccactgtgcacagccattaatattattgttacccaataaaaaaaatttggaaacttgtcttcttttcccctgattctgtttaaatagcactggagttacctgttttgaattttttttccaagcggtcccttatgagttttctctatgttttatttgtttcatttctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtttcatttcttatatcgtatttttgcaactcctttattgatacttttcttcctgattaggtttctactaaaaccaaacaagctttccatgaattagcttttagatttacttattagtttaactgttctgttgtattgtaactcattaatttataattttatctttattaattattctatttttcttcgcttttttgttgtttttctagtttttgagttagatgtttgacgcttttttaaaaagctgtgcattttcctctgggtaatactttagctgtatattatgtattctgatatatagtgtttccattacattgttttctagaaaatctgtagctttgatttatatttgtttcctctttgacctaagatatcctaagggaaaatttaacattttccagaaagaaaacaaattttctttgttttccaagaatgttgttcaaattatttctactgcttggaatttttatcatttttgtgtatccagtaaatagtcaatatttgtacttgctctctgaccacataaaagaatatattcgtgtagtttctattaatagattagagttcaattcagatattaaatgtacatcattattcatgatatttaggtcttctacatcttcacttatcttttttctacttgctttgccattaacagataaagttgaattaaaggcttctactacatacatttctccctgttattccttataggttctgtaatttttgcttcaagaatattgctttttaaatttaatatatagatacttataattacactctagcattataaagagccttttctttttcattgaatgtatttgggcctgcatatgtctaacatgaaaattatagtcctttttttgtttctttgtttgtatttacagttttaagttccattttcaacctttatgcactctttgctttaggtgtgtctcttttagttagcataaagttaggtttgtctttaatttcacctgaagtcttttcctcttaatagatgggttaagccaactgaaaaataaaactgacttatatacttttatttcaagtatgtcctccacaaatattttttgaatagattagcttatatactttggaatttgttaaaaaaagatttttataaaaaataattgtggtgaaatgtacataacataaaatttatcattttgaccatttttaagggcatagctctgtggcataaagtatactcacatagttgtgcaactatcacctccttttgatttttttttactaattttgtaaatttgtttcatctgagctgtcttattatgttttgttttatgtttttctttcctttattatgaagtcactgtattgtctgtaggctatatgtatctgtgagtgtgtgtgtatatgtgtgtattatggtttttaaaaaagtctatatttgttttccagtggctatacttaatactaataactttatgttaaatttttcattctatgtgactctagttcactaatatgagctctgataaaatcagtgctttttcgaggttaggagatcaagaccatcctggctaacacagtgaaactccgtctctactaaaaatacaaaaaattagccagacgtgatggcgggtgcccgtagtcccagctactcgggaggctgaggcaggagaatggcgtgaacccaggaggcagaacttgcagtgagccgagatcgcgccactgcactctagcctgggtgacagagtgagactctgtctctaaataaataaataaataaataaataaataaataaaatcagtgctttttcttcctctgctacctcctttccttctactcagttttagtcagtagtattatcttttttcagatttatctttgtattgttaaatctgcttatgcttctattactttatttattagctttaaatgataccttttgactttcagcttttcttaataaagcaatcagcaaatttcctttacactccacacttataccccatttcctttgtttgtttatttggtttttacttctaacttttcttattgtcaggacatataacatatttaaactttgtttttcaactcgaattctgccattagttttaatttttgttcacagttatataaatctttgttcactgatagtccttttgtactatcatctcttaaatgactttatactccaagaaaggctcatgggaacaatattacctgaatatgtctctattacttaatctgtacctaataatatgaaggtaatctactttgtaggatttctgtgaagattaaataaattaatatagttaaagcacatagaacagcactcgacacagagtgagcacttggcaactgttagctgttactaacctttcccattcttcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtgaatggatcaattaataaaacacatgacctatgctttaagaagcttgcaaacacatgaaataaatgcaatttattttttaaataatgggttcatttgatcacaataaatgcattttatgaaatggtgagaattttgttcactcattagtgagacaaacgtcctcaatggttatttatatggcatgcatataagtgatatgtggtatctttttaaaagataccacaaaatatgcatctttaaaaatatactccaaaaattattaagattattttaataattttaataatactatagcctaatggaatgagcattgatctgccagcagagaattagaggggtaaaattgtgaagatattgtatccctggctttgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttgtgattcaaaagcaatatctttgatagttggcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttggacttacctcaaagaggatatacttcattcctcaaaaggccttcttccaggaatagtatttcataacctggaggttggaaaaatctggatttgttacaaaaaaatctgagtgtttctagcggacacagatatttgtctaggaggggactaggttgtagcagtggtagtgccttacaagataaatcatgggctttatttacttacgagtggaaaagttgcggaaggtgccttacagactttttttttgcgttaagtatgtgttttcccataggaattaatttataaatggtggtttgatttcctcaagtcaacctttaaaagtatatttagccaaaatatagcttaaatatattactagtaataaatttagtactgtgggtctctcattctcaaaatgagcatttactaatttctgaacactgtgctaggtcctgggaataccaaattgaataagacatagtctatttttctgaagggtttatagcagagtcccctgtgttaataatgaaggagtgtgtggtatgtgaatcatatatcaatagggttgttaaaaataatgaaaaaaggagaagaggaagaacatcttttttttttctgattgcacgggcagccttaaaattatttttgaagtgtacaattcagtgtttttttagcatattcacagggttgtattatcatcaccatatttttggcctcttgaaaagaaatcctgtgcctattagcatccaattaccgttcctttgtagctaagtctcccccattccagctttaaacaatcacccatctactttctgtctctataaatttgtctcttttggacatttcacataaatgaaataatataatagggttttttgtgcctaaataagcttctaaagaagaataaggtaaggaatcatcattcagcaaatatttattaagacttgctttattttatacagtgtactaggagctggagatgaaaatatgtgtagaacatgaatcatatacttcgggaatttgtggactagtgggaaagattgacatatcaataacaaatcgaattagtgatgtaatagaggcatttttacaggagtaaaatgaggtagcatggactctatctgggtctgaataatgtgaggagtaacctccttacacaaagaggcacaaggctaatgtcctctgatggaatgattcaccatgcaattctaagggtgacaagaatgaaagttagggccttgaagaaatattttgattaagagctgccaataaagtagagtaaagattagattgatgtgaagaagtgggagattaatgagtaaatggtcactggcttgttgagaagattaaatgagatgtacatgtaatgtacctaacacaacgtcttgtacaaagtagccattcagtagagactagcttgtattatctccctttgaggtaaagaaaactgttagaaatagtatttctactactgatagtatttcttctacttatgcctccctttgaggtgaagaatactgttagaaaacatgacataggagaaatacccctgagagacagttcttattagtgactactgtgcagaaaagatggaggttggtgtaattaaggagaaggaaagccatgaagccaaagtattatgaaaaagcatcaatatgaattttcatgttgacaaagtggtataaaagataattataaagatggtcacttataaatacggtagttctgtgtgacacaatttacagaagttggtatatcgtgtggaagaaaacagcataagatcctgaaggtttgaactgtgggcacattggctccatgctcaggaaatggcaatggggttgggaagtgattccactttatgtccctttcagacacataaaaattacttgtgtgagtatcttatgccagacactattcactgtgtagtgagcatggtgggtatgaaatgacaactttattgtctttcctgtcaaagaacttgtaggctggttgggggaaagagaccatttcaatatgaagtgctgagctagaggtacccttagggcactacagaagcctagctgatggcttttagcctggctagacagttcaggatctctaaaagcaggtgccttgaaggctgagtcaaatacaaaaatgtattttggacagaggaaattgtatgaacagaaacacagaacatgaaactacttggttggtgcagggtatcatcagcatagaaccagacagaaccagagtgtaaataagccagaaggccatgtcatggaggccttgtataccagtctcaggaatttggttgtggagagctttcatcaggggaatgatgtaatcagcttggaaatgtagatatatcactgactgtgatagtgaggagcagaattaaggtggacgtgattagaagctttgtgaatagcagaaagaacatagattttgaaagctggcagacgtaggttactgaagaaagttacttaaccttgctatgtctttagttttatcctctgcaatatggggataatactgcctattttgtagagtcttgtggattcttctggcatatataatagaaaataaaacagctattattattattgttgatggtactatttgctatatctgactacaaggagaaagactaataggaaaccatttcaggaatccagatatggtcatgatggacaggaagagacaagagttacatagaggaattctgggaagataagaaatgtcatttttatgtactgtttgcatccatcagacaaggcatcaggaaaaatgatccttcaggaaagagtgattttttttcttcaagaaattagaagaggggagaaattggtttaagattaaggactccatgcataagagaaactgggagggaagacaggtagaaatgctatggggttaggaaggaagaatgcagaggtggattacttagaattgagacatctgatcaagacagagggatcacagcttttgctaacaaagtactagtggaggatgccactaggtgaggtttaataaataattgttgacaataagttccatttaaaaaataaacaatttatgcttcttctttgcctaagtgtcaaataaaacattcagatttttatttcaaagtatccctgagtccctgttcccttttttgtcctgctgacttttggaactgatttaggcttccttagtcatctcataatagaaaaaatcagccaggtatttcctacatttcttgtattttaaaaaaatgtaatggatgtaatgaattttaagcaaatgtaatgaatacaataagtaacttagtatatgctgttttcttctctatgctgaatgtttcatacatgttattttctatacaactacatggtcaattccttgaaaatatcaactccaaaatctttattttggtatactccacgtagcacattgagagagttttaaactcttgttggatgactgtttcaaaagtgttttgaagtaggcatgtcagttgcaaaaagtttgctcagcaaatgttgttctgtctcacagtctcagacattgagcagatgattacatgacagcacgtgattgctgggagtaacagacaaaagtaactgaaagtgctcggttatcttgacagtcaaaatcaaaagtgtcccctattttcagtgacctaagagtttctttttgtgtttttggtattgttgttaaataagtgttctcacctttgaaaaggtcaataagaattcaatacagtataatgtctgtgtgccaaatgaaggtgccccttatttttaagtgtggaggagttttgatcataagaacttgaaatacctacagaatccttgatggttaagcagctggtgccagcacaagaatccctcaatatgttctctatgaagccccgatcaccaaatgcaaacattcatgattcagtatattttcatcttgactgccaaagttgatctgtttcttaatatattacatctagacttggaactggagatgagaacagaatattatcttcctcatttttgtgtttttgttcaactctaatgtctgcaaagcacttgcgtatgtaatgatgctcagtgtcataggagcaggcaggtaagtgtaaatttgtctggataggagaaagcatgcacaacatatttcacatagttttctgatttcagtttgtttttgcaaattattcactcagtgagatagcttaaagacgttatcacagggaaaggcatggagatagttctgtgttgatagaaaacttgtaatgtacagccatgagtgagaagtcaggttcagattcttcaccttcagtcctcctctttcataaacagctccatgtcctattttacatatcctactttaaaacgagattatagaagaatgaatttctaggcaaagtgacacttattttaaaatactattacgtatccctgtgcccattaacttatcctaccatttttcttcccctgtgtccaaaccacctttagaatctcctaaatatttgtagctattgtaaacagcactggagactttgctagtttaaaaggagaaatcaacgcaattaagccctagttaatttacttatcccttatgagattataattgtattttgttattaaaagggggacagagtacactgttctcttgcctttttaatttccagactaccacttctcctgcacttgacaataccgcagtctaccacgtagtcccatggctgacaggaggagaattctaggcaggccagtgtttgagtagtgagtaattggactgtctttacccagcaactcactgttttgtaaatgtacctgagtttggagaagtaattggcttttataaggggtgcggggtggagggttggggtggggagagtgagaaggaggtcagagctttaggatatataattggtctccacaaagttgttgtgatacttttggaaccacgtaatggtcttcattaactaagtgtctgtcatgacagccattacatatgcattataataaaaatttatttacagtgtaagttgaagaaggtaaaatctggatgtagtttctaaactctgcttggcagttttcatatttaagccactagaagaaaaaaattgggagggaagctgagaagaatttactgaaagaaaaaaatacttgggagggaaattggcaagaagtatgaaaaagcttgggagggaagtaagcaaataaatgagttaatgactgttctggaaaataaactctatcatgcagatatcacatgactgattaaatttgaatttgacctcctgctttccaggtctggtaaaaactaacctgtaagaacttgaaacttagcctttgaatggtcaatccaccactgtaggagaatttatgaatgttcagttgagagaactgaaaataaagaagtaccataggaattaacatttgcattcagtagccaagatataatggacatctgaaacaggtatttgaggccaggcgtggtgtctcatgcctgtaataatagcactttgggaggccgaggtgggtggatcacaggaggccaggagttcaagaccagcctactaaaacacacacacacacacacacacacacacacacacacactagccaggcgtggtggtgcacgtttgtagtccaagctacttgggaggctgaggcatgagaatagcttgaacccagaaggcggaggttgctgtgagctgagattgcgccactgcactctagcctgggtgacagagtgagactctgtctcaaaaataaaataaaacatatatttgaaacacattgaattatgtcccttaaacaagaataaacatcactaaatgactgtaccttgaactacctgtaattttctcctgataggtaattaagcttcaaagtactgacacttatttactgtaatatgaagcaataacttaaaaaaaaaaaaaaactattgaaccagaaccaaacaggaatgccatagcattttgtaaactaaactgctatttcatttcatttgagccctggaacttgaaaataaatgctagctaacatctgtgaacagaacatacccatcagtactgtgctaagcacctttcatgaactggtcattaaatcctcactttccatttatttagtgacaacttcacccagagtttgcagtcaaagtgaaaatgtgctgaattccaaaagtgtgagctaggttttagaagttaatcacaattctggaacaaattactagcttaacaaatgagagttcttatgtctctaaaaccaaaatagccctaagtctgtccctcccagtaagatttgggccagtcaatggaacagtaatatacaaatataattacagctgtctaggagcaaactatcctatgaatagataataaaattaagacacttaagccatgttttcatattaaaacacaaagtaaaaaatcattgttttccaaagataaaagccatactgtatcatgacatatatatgcccgatgtttcgaccctcttgaagaattgagattctcgactctacactcttagcgttttctatattgaacagatgtttaatttaaggaggtcaagagaaatcttacacttattttttaatggtaccttagacatagaaggaacctcagaaatctctggctgaatatttccatctgcagatgatcatgtcattaggcttctgactctatagccatagaaaaatattcatgaagacctttcaggaagggaatgttggtatttctaaaaattgagtacaagtattctctagacaaaacagctcttgaaatggcagattgtattcccattattatatttcagaatcaagacattaatacctactttttatttaccaggtttagttatccttgaattagattttataaattaaagaaatagatttcaataaatatttgttgagttcctagtatggaaacatcgtgtttggcaccagggatgttgcctgcaagtataacaggagttcgtatttgtaatgagtttatgatttacagatatttggggggcaaagatatcattcggtaaatacttatgagtgcaaactttgaactagggactgggccaaactctaggaacatatttgatgacagagacacaatccctgtcctcaaggagctttcattctagtagagaagatgaaaaccagtacagtttggtaagttagatgatattggttaatgtagggttcttatgtaagtctagagaagtagcatttaatctgttcttagaaggtcaggaaagatttccctggaggaagtgacatttaagctgagagaggatggataaacaggagtcatctgagtgaacaacagggagaacattccagaaagagaacaaaatgtacgaggcctgatgccaagagagaacattcattgcattggggaactatagtcacttctgtgtggctgggatgtagaatgaaatgagcctggacccaagagagcactttgccctttggggaagctgtaggtattacagtaaggttggagtctggaaagaaaggggtatattgtgagatctgaattgggagaggacagttatatccagacctttatatgctccagtaagaagactgaactttacactgggggccatgggactcactgaatggcattaaatttgagagtggtcatatgaccagatttgcattttacaaagattgtcattgactgcaacatgaagtatggagtattggaggagcggtaaggctggtggcagggagataatttaggaggctttaggtgagggatgataatgacttgccaggtaggaaggagtaaatttcttctcagtggataattagaagattgaatggatggacttggtcactatttggtatagaaggggaaaaaagatgtcaaagatgatgccaatttttaaaaataatttaacatttatttttaaatattttttcagccttattaaggtataatggacaacaattgtaggtatatgtcatttacaacatgatgttttgatttatgtatacattgtgaaatgactgccatagtcaagctcattaacatatccatcactcacataattaacattttgtgtgtatgcagtgagaacatcaggctctactctcttagcaattttcaagtatagattacatttgttaccaactatagtggccacactatacaatagagctccaggacttattcatcctgcctaactaaaactttgtactctttgaccaacatcttcccattcgtctctcctccccatgccaagtttccatcttggtcagttgggtggatagtagtactatctgccgaggcaggttggtagggtgaaaacaatgtgttcccttttggaaatgctgaggtgaccagggaacttccaagggaatctgtctggatctagagcttagaagagatgtttgggctggaaacagacatcaggtattcttcagtatatgggttgtaaatgaagtcacaggagtgggtgatatcaccaatggtgagtgtagtataagaagactggactgaggacagatttccaaggaatttcaatacttaagaggtacgcagagaaaagaggggctgtgaaggacaccaaggaggagactaagagccaggagggaaaactttcaagagagtattgcattatggaagggaagaagagagaacattttaaatgatacgcaatgctcaataatggtatccgctttggagaggccaagtaagattcctaagtacccattggatcaaggtccttaatcttacaaaaacttatgcaaatcaataataaagagatgataacccgataatcaaaaatagacaaggcatataagaagaaaatgaattaaaaatattcaaagcattcaacatatacaaatgcgctcaatctgatatataatgaaagaaaagtaaattaaaacaacaatgggcatgactaaataacagtatgagggagcctgaggagaaggagcatttgaaatttcagtacagaagagaaaaggggtgacttatagaaaaaggagacagaaaccatagaacatgtttggaggataagactcaaacaggtagtggggacccttttctagagtaggatgaaaacaggtaatgtgtgtggatgcaaatatgaggtaggatgtaatgggaagttgagcgaattcatatttagtcattcattcaaaaatacttaattgagttactgctgtgtggcaagcatcattctacaaacagagggcacagtgataagcaagccagtttgtactctcgtgtaacttacattctactttgagaagacagattataaataggttaaaaagtcaataatatgatgtttcagcatcaacaataaaaaattagggtgatatatagagtgccagggaaagtgctttcatggacctcttcattctctcctctcctggtgtcataagctactccttcatccatgctgccatttctcttggtttacggttccagtatagtactcatcacattattactatagagccatccaccttatgaaggtgaaggtgtccatctccttacttaaaaaaaaaaaaaacaaacaaaaaaacaaaaaacccgaaaaacaaaaaaagaggcagaaagacagaaggtcctccactaactttcacgtgccatgtaaccagcgaaatccaattattttacagcattctagctatagaagagtttgggaagcgtagtgcttagtgttctagcctttgtagcacaggaaagggcctggaaggaaaggaattgtgtcttccgcagttgcttttctttatggggaagtgctatagcccaaacaatattttaggaattttcatctattgtcaatatgcaaactggaaggggataatgaaaatgttgtggttagaagtttatgaaatattgttattcacattttaaagtaaaaagagggaatgtttaagagacttgtttaagatcacatgtctcataattggtgggaccagcaatacaatccaaatctaactacttatctttttgctatgccctattagtgttcatattagaaaagaaattctatctcagacactaatgatttgttctttggacaccaatgactttaagttaaaacttcatactagttaatttaattatggtgtagcagtattattaaactatcaagactataaattttctatttgtaaaggagattatgataccaaagattagtgaactaatgatattgagaattctatgacataattttgaaaaatatttgcaggatatttatttttgtgtaaatgatgctttcaagctaccataatcctaagtaagtgtatatttgggaaaaccacctattctaacacacttgaaatttaaataagtcaggaaatttttttccagatcttctcccaaattatcttcatctttttcctctccccttgggaaagaatctcttcatgcctcataatatcaaatttaaactatggaagtccaggtggtggacagtcagcaaaggggaagatgagaagcttgtgttataaagccagctcttgtcagaataaggatctggtaggaacttcagaagtgatgggtaggtaagtatgaaggccaggtcctaagatctaaattacaaagcagaagacttacttaccagggagctggaaaacatgttaggaaatccagagcaggaacagatttcaagatagcacaataatatagcagtgaagtactgagaaaagagtttttttcacgggttggatttattctagcattttaggcagcatttgggcatttctaagtggtcagacttagaggagatagttaaggaattagcagctgctaaatgccaattcttagaccagttgaatcaaaatcatctaaaaagctttcagaaaccagactttttaagggccatttgagagactctcaaatctggaatccagaaatctatagctagatgagtttaaggtagagccagaataagaaaaataaaatagtttgtttgtttcaggtatcttttccaatattatttccgaacctaccccaaacaccttaaatcactgcattctatagccattcttttaaaaatgcttgagttattagttttcaaaaacaaatacaaatctgcacacatacagaaataaacattaaagagacataaagatattaaacagagttacatatacttacaacttcatacatatatattatatataaaactgaatattaagtgtttgatattagtgacaaaatctgtaacatccattatattagtgctttttgtactttttgttgggtgtagtaaaaattgcattcgaatttgagttttctgctatatatttggtcagttcctatcagtgaaggaaaaacctttttttattattttattgtttttttattttttgagacggagtcctgctctgttgtccaggctggagtgcagtggcatgatcttggctcactccaacctctgcctcccgggttcaagcgattctcctgcctcagcctcctgagtagctgggactacaggcacctgccaccaggtccagctaatttttgtatttttagtagaaatggggttttgccatgttggccaagttggtctggaactcctgacctcaggtgatctgcctggcttggcctcccaaagtgctggaattacaggtgtaagtcaccacgcctggcccctttttattttttaagctgattgaagattcttagttctcatgctttctagtggtgattaatctttagccaatatttctatatacagttattagtaatcatgtttgacttaggtcaacaaacaatctttcctaaaaaaacagaaccccaattttaatttctgaattatttagtatctattttctgctgtggaagttgaattatgttgatagatatcatacagggccatgtaacactctcagatacacgttcacatgtatagtagctgtatacaaaaatgttacttcattctctctctctttataatactcttggctctcttacgttctctcacacactctactcttcccttcctctgttctttctacttgttccctctgctcctaccacacttattccccccttgtccattttccttgtgcataaagcacaagtgcttagtaattatcaaatattaataacaatgacactaaccacccaatgatttagtgttaatgacatgctttattgaatggcattacctctaaagttcatgtttcctttacccaaccaagcttcttaccctcctcccttaccacaagcatctatattgtcaaggttgttataaagagtaataagccagccattaaaaaagggtttatggtattttcctatctacaaagtcacaggaagctcaaatgtactcagtaaatattgcaaaattacacaggaccattaaatgtaacactccaccctttctctctctctctctctctcttgctctctctctctctttctgtcaatatagcaacaccctatatcattgccctttgtatgtgcaaatcagagttaataagctttatattagcaattactccttaacaacttctggtttgtttggtccagttgaataatgtaagcacttaaaaaaatgaaattataaacatttatgtgaaaagtgcatatatcacattggatatgttgttatgcactccttaataataaagtaagttaatctttattgcacacttattataatattactttgaccctctctagtactctttatctaagtattctcaagtgctttacaatctcaaacagacccaatgtgttgtatacacagaatcctttgaagctgacatttgcctttctgaccagcttgttgtaaaggaaatcagccaaaaaacaagtatctagatgagtagctcaaacattagtacacatagtaatcacaggtcaaaatgcagatagattaccctgtccaaattctcctgagtaagagtaggtgaaacatttttaaataagctccccaggtgattctgaaattggtccaaggaccacatattaagaactaatgatccaaacaatttgactttttattgtagattaaaccatgctgagaaaattattaaaaattgaaatggcagtggaggatggtttgaaagaaaggtttttcagggccctttcaacaataaaattaattgaacacaatattaaaactctatatttgatttaagactaaggttttcattgtttttaaatctcagtaatttttatgtaacaggtcaattcatacccagcatcttaattccaatgaatgatttcccacaacaatttttgtggataactccaagggaactcgaaggaagttgtagtatgaacaaagagaagtagaatttgtccctgtgtgtaaggcttctctgataagcagcacaggctctcatactgctttttaaaaaaattatgatagcatcaagtggaattaattttttttagattatactttcatggaagggaagatctactgtgaaggctggaaaaccaacacccttaagataaatatattaccagatttgagcgctcttagtaatcagcaaagataaatgtttaacagtgcatacaaaatgaagtgttttatgttaaatcaaatagagaaagccaaacactaataatgtggttacaaatgaacaataaattaggtaatcagaacaggtacagacattaatagcaggatattggtattattaatgtattttgttttaaaataatgaacttaattacaattctcctcatcctaccccactattttattttattccagattcagcagcttcatattatgtctctgaaacacttattattaaagttatccaaatgtacacatttctctttatataaatgtttcagtccagaaaaggaggccaaatacattagctcagaacatcaaatcttctcagatgtgggaatcttttattttcacacttttaaaggtaatctgtatttctagcgtctattatagacagaaaactttcatatgacaacattcctattttcttaactgccttgataggggcgaagacaaattctaagtaggactttttaccccattcttcttaccatcattctttcacaaaacccccagctttagacaatcgctattatgaatttgacatgtactattccaatccattcccataaatttacacccatatatacatatagttatctatgaacaatatttagtagcttttttgtgtgtggctttaaaatttacataaattgtataatttgtgcacattcttctttaatttgccttcttggctacggttatctttttgagatctagctatgctgctggtatgtagaattctatttcattcttttttcattgttgttttgtacccataacgtgtcacattttatttataccttctgttcctgatggacatttagattcttccaggattttactcaatactgcaatgaaaatctttgaatttttctcttttgcacatattcaagagacttttctgacatatatatctataggtgaattgtgtagtcatatgatacatacacacattttaaatttcactagatactgccaatttgccctttgaaatagccatacaatttatagtaccaccagccacttatgaaagttcccatttcctcaaatctttgaaagttcttattataaacagacatattaattcttgccattctgatttgtaaatcagaatctctattgttctacctctagttctaatttggaattccccaattacttgtaagatgctatatattttcatgtttgttagtcattctgatttcatatcctttaccaattatctttttggtaagttattgtggtggccatgagatgtgccttacagaggccttgctagagggaatgtgattgaatgagagccccagatgctgtgtattaaaatcctgcactgagtttgtctcaagatttcttgcacgtgaatgaatgagtacagctgggatactaaagcagatgtgtatttgggagatatgagacttctttagtggctgatttttggctcataaatgactttgccaaaccttccttagactgctcagtgttctaacatcttccatccagccttctacccttctttcctttactaggggattgaatttacattgaggtctcatagccttctctgcctctctccttatttccttttatacaaatatttcccctaataaatccatgcacatttaataccattttgctatttgcaacctgcaggtcctggactaacacagttctatacattgcattaccattctctagagtgggatcttttgttgtagagagttttaaaatttttatgtagtcacttttatccatatttttctttatggtttatatttttgtgtcttctctttaacacatcttttctagcagaattcataaatatattattctatattgccaaaagtttgaaagttgcaatcattagaattaatttttgtatattgtgtaagttaagaatctaattttattgtttttcattggaaagccatttgtcccaagataattttttagtagtccctccttcccctattgtcattctgacatattttttctaggttccgatctatgcatgtgtttctttatggaagagttggccctttgtatctttgagtttcaaatccatggattcaatcaaccacagatagaaaatatttagaaaagcgtcagaattgaacatgtacatacattttgcttgtcattattccctaaacaatatagtataacaactatttatgtaggatttacattgtattaggtattgtaagtaatctagagatgatttaaagtatacaggaagatgtgcatatgttacatgcaaatactaccccatttatataagggtcttgagcattcatggattttggtatccacagagagtcctggaaccaattccccacagatgccaaggcacaactgtatttattctatcatctacttgtttaatctcacatcagtatctacttttgaaataacaataactttattatttaactttttttattacttaggattagagaatttcctctggtgaggcatcatagtgtctcaagctggccataaagacaagtgagggctaggatcggtaagactgggcagaggaagatacaacagatctcctatgcatgaagcaaaagtgcagctcagaagccagctctttcattaagttgtcctctataccctcactagattgtaagctcttgaaatgagaggctataccttaattgtctctgttatctaaaatacttccactcactgcttggaacatattgcctgcaataattaagcttgccctggctcccaaagcatagagcaaatcacactcctccccttgcctttgagaagctcacagtcttcgaaggtagagatatgtgaacagataagaaaatggatgacaggagaacagaaacgcatgactgtcagagaagtcattggagactttacagaggaaattaaatttttattgatcttgaaagagtttgccagatgaagtagaggacaggcattttagacaaagggaacaggaaatgtgaaaacacaaagtgatggaagtcatggtgagtttggagaactataaaacttcaatgtggctgaagggtaaggtggatatagaggagtgctgggaggtgaggctgaagaaataagctaggaaatgtctttttatgccattttttaaagtttggactttattctgaagttcacatggatccaatattttttgttttgtgttgttttaagcagaagcgtgacatgatcagcttgaatgatgaacaacttgaattgtttaaagtggatcacacagtctactgttttacagttattctttgaccaagatattctttattaactgaggaaaaaaagggctttcctgaattttgcagtcatgggatatatgataagcattcttgatttatcatcttcaatcctgttacataacataataaccattgttattacctttagcaatgctttcctcagtattatctaatggcctataaaatgtgactttcatttgcaaatacagtacatctaacaagaacttaccacagctgctatgcaaaataccaatacaattgacccttggacaatgtgggggttaggggtgctgattccccatgcagttgaacatgttacataacataatacataaccattgttattatgtaacaggattgaaaatgataaatctttggaaagtggggcaaatgaattcttatgaattccatatcttccacatgtgttttacttttttgataagaagtagtaacctagttcagaaagaaaataatcatccccttttacttatgcaggataccaagtctatcttagcaccataatagtgaatgataggaatcaagctctatgaatacattcacatgtacatatatatggctatataggacacatgcatgcacatatacatatatacacttgcatatatgtgtatatacatgtacatatatgcatgtatattcaattgtatatgtgtatatagccaagttattgtacagttgacctttgaacaacacgggtttgaactatgcaggtccacttacacgtattttttttttccgtttctgacacccctaaggcaacaaggccaactcctccccttgctcttcctcctcagctgactcaacatgaaaactatgaggacgaagacctttatgaagattcacctccacttaatgaatagtacatacatttctttttccccatggttttcttaataacattttcttttctctagcttgctttattgtaataatatagtatataatacatataacataccaagtatgtgttaattgactgcttatgttatcagtaaggcttctggtcaacagtagactattgctagttaagtttctggtagttacaagttatatgtgggtgttcgactgcatggggagtcagcaccccaaccctcatgttgtccaagggcgttgtccaagggtcagttgtaattggtattttggatagcagctgtggtaaattctggttagatgtactatatttataaatgaaactcacattttataggccattaaatattattgaggagagcatttctaagggtaaaatcttgtctaatgcttgaaacatcttcattttcctgtcagtttagatctttttgaagtaattctgaaaatctctcttttaagctaaatttaacacaaccaaatagccaaatatttaagttccactaatgaagatatctaaatttctgttaaaaatttaagatatatgttaaacccttctaatataactcttctctcagtcaaacttttttttttaacagttgctttgcttcttctttcaaagtcatacttcaacaaagttgctattgaatatgtctgactaaacatgttagctatatgataagatggctggataagagataaatatagaaaatgtagctttttttctacttgcaataaccctttaggaattaaaatggaaaactaataactatttgattcataatagtagcaaaccgtaaaatatttagacataaatctactaagaaatttataagacatatatggagaaaattcaattgaataaaccgttattgaagtatataaaataagatctggatgaatagaaagatcataatttttaataaaattttgcatcttaaaaagtgaaccctctccaaatatatgcacatttaataaaattataaatacatcccaatgaggttggttttgaaattttgttaattggaacttaaatttcacctaagaagaaaaaataaagaatagttaagagtgcatgctttgtagacaaattgccttagttagaatcctggctctatcatctattagctatgttatctttgggataacattcatcttttcttatagatatgcttaaaacagtgcctgacatatagtaagcacaaatatccattagctattcttcttattatttatgttattagtattgttaatatttgttattatatggaagactaaatgaccaaagagagtcaagaaatttatgaataagatttatgcgttgttagatattagagccattaaaaaaaaaaaaaccaaagtgccaaaaaacctagcacagtgttaatacaggaataaaaaaatggatcagaggaaccaaacagaaaagccagaaatggatcttaggaaacatgagaatatgatatatgatagatgctaaatgaattcagtataaaaatattaatgtaataaatcatgcttgctattcaagtaaaagaaaatgaggttagattcatgtctcataccaaatataaccataaattataccttgattaaattttttaattaaaaagcaataatatttgaaaagaaatataggatactcaatgtataacctgaaggttgggtagtacttttcaacaaatataggaatttttcacttgaaatactagaagaaaaaaagatagcaaacaaatacaggaattccaatttcaagcagatataatgatttcatgaaatgttaactgtgcacatgatagatggtctatggatagtgcaaaagaaaaagagaaaagaaaaaatgttttttaacatatgcagcaaaaaaggtttttaacatctattacatacaaataaaaatgaatgtataacacagacttcaataaaaataggcatttcacaggagaacaattcagatggccagtatttacaatttcataggtattaaggaaaatacaaattaaaatggcaaattagcaaaaattgaggtgtgattatattaatatctgttggtggtggtgattatggggaaaagggtactttcaaaacttgctaatataaatataattcttttggttgttttgtaaaggaacctgacaatatcttttaaaaataaagaaaacgcatacttttgacctagccatcccattcatgagggtatgtcttagaaaaataagatcacaaaatcatagagatttatgtgcaatgatattattggtaggtcatttttatgaggaggggtgtggatagtaaatgccagggtaaatcacatagcatctaataaacgtatttatgaactacaaaagcttacactttcagtctagtctagtccagactgcaaataaatgtgagcaagtgaattcaagcacagaagtgcttgaaggcaggtttcataaatctactttcttacagtatcctgatattgacttatcgagacagttactgtggggttgattattaaaatatttatgtatctaggtatttttcattcagtagtatgttattcaattagcaacaagtgtggggatttaaagatattcttgtttgtttttactgctgaaacatattctagtggaaatttcgaataaacgattagtcatcctaaaagcaagatacattttctcagaaaagacaaggtaaagaacttgtatatcctccctcaattcgtttataaggtaataagatgaataaaaatatcatagtacaatttagcattgtaaaataaaattaattggtcatctctagtgtggtcgtgcttggaaggtgaaagaagccaagatcttgtctgggaatatcatgtctaccttgacctcacccttaagaatcctagcctttagtttaaaatcacatggctacatacataccaacttcaacaatagtacatctggcaaggtcatgcaaacctgggacttgagcttctgattctaagtccagtgctttttgtgtacatcatctcttgtacataccttatgatgatatgctaataaaagctacgtgatcaggccttaaaaatctgctttttttttgtaatggtagaatggggcatattatcacatcaggtaaacactctattcaaggataaatggaaatgaatgtcatatatagatcattgataaatatctcattacaaaattatgagagttaccaatgtttgagtgtatattatgggccagccctttatattaaattacttcaaatttttacaactgttaaaggaagatattattatacccattttatagatggacaagttagggccagaaaagacttcctcaaagctgttagtccagtaatggagacagggctagaaaacaggtcattttgctctttgactaatgttactactcatgttttgtattttgtttaaagttttattttattttgctttatttattttttgagacaagatcttactctgtcacccaggctggagtgcaatggagtgatcacggttcattgcagccttgacctcctgggctcaagcgatcctcccacctctcaatctccagagtagctaggactactacaggtgtgtgccaccatacctggctaaattttgcattttttgtggggacagggtttcactatgttgcccaggctggtcttgaactcctgggctccagcgattcacctgccttgacctcccaaagtgccagtatcacaggcttgagccaccatgtccagccaagttttattttagaattaaaaaaaattccacttggattgttacattttatctcattgctttatatttatagaattactttataaatgccactttcttaattttcatagttagcactctttatgaaacataaactattatttgacccaggtttttgttagaggaattgagtcagagagctgttaagtaactgagatttcacaataagccagacagaccagggttcaaattctgggtctcacattatccaattcaatattccagctttgttacttattgagcaaccactacaagcacagtttacatgacatctgatagctctcaaaatgaattttacaaacataattcagatttcaactcagcagtgactcaggagaaaggacacttggatgcatttctttatggcatttttcccagggtacacgcaacctggaagatctcccaagtatgggggaaggtttcaccctgaggaatcccattccctctaatctgggacaagggggaggagagtactgtctcttatcagccatctccccagggaggcctgggccctcctggaatgcataccatggcttactgactcaaagtgttgaaaagaccaggcattgggacacacaacactactcttaaaataaaaaaagaatcagagtagcttgtggttataattgaaatggacagagtaacatggtaccaagaaactattagcaattccttccctaaatccctcattttcttaaagcattttctccttttcctcaacaagctttaagttggatttgaagaatgataagactaaaaggagggctgtttctggtctttggaggaatttgatattccattcgatctgagtgtgcaaagcctgagttcacatgaactcttctgatctctttctctaatattttttcaccttattcatatgggaaagaaggaggggaatactttagttccattctccctcctcctatttccttgacttgtttaaaatataaatgttatagacacctaagatagaaatttgactgaaacagcctcttaattattgtcttaaaaaattggtataatgaaattgcatttgtagtctttggacatttaaatccagaagggatattttctttttcttttttaaaaatttaattcaatagtttttgggctacaggtggtttttggttacatggataagtgctttagtggtgatttctgagattttgatatacccatcacctgagcagtgtgcactgtacccaatatgtagtcttttatcccccccccgctccacccttcctttatcgtccccaaagcacattatataattattatgcctttgcagcctcattggttagctcccacttgtaagtgagaacatgcgatatttggttttccattcctgagttacttcatttagaataaattgtctctagctccattcaagttgctgcaaaggccattatttcattccgttttttggctgaatagtattccatagtgtatatatgccacattttctttatccacttgttgattgataggcatttaggttggacccatattttcgcaattatgaattgtactgctgtaaacatgagtgtgctttttttttttccatataatgacttcttttcctttgggtagatacccagcagtgggactgctggatcgaatggtagttctccttttagttctttaaggaatctccatactgttttccacagtggttgtactagtttacaaccccaccagcagtgtaaaactgttccattttcagcacatccatgccaacatctattattttttgactttttaattgtggctattcttgcaggagtaagatggtatctcattgtggttttaatttgcatttccctgataatcagtgatgttgagcattttttcctgtgtttgttatttgtttgtatatcttgagaattatctattctgtcctttgcccactttttgatggaattatttgtttttttttcttgctgatttgtttgagttccttgtagatcctggatactagtcctttatcggatgcatagtttatgaatattctttcccactctgtaggttgtctgtttaccatgctaattatttattttgctgtgcaaaagcttttcagtttaattatttcccatctatttatttttgtttctgttttatttgcttttgggatcttagtcatgaactttttacctaaaccaatgactataagagtttttccaatgttatcttctagaatgcttatgttttctggtcttagatttaagtctttgattcatcttgagttaatttttgtataaggtgagcattgaggatccagtttcattcttctacgtgtggcttgccagttttcccagcaccatttattagatagggtatcctgtccccactttatgtttttgtatgctttgtcaaagatcagttgactttaagtatttggctttatttctgggttctctattctgttccattgtctacttgcctatttgtgtaccagtaccaggctgttttagtaactatagccttgtagtataatttgaagtcgggtaatatgatgcctccagatttgttctttttgcttagtattcctttagctatgtgggctcttttttagttccctatgaattttaggatttttttctagttctgtgaagaattatgatgatattttgatgggaattgtattgaatttgtagattgcttttggcagtatggtcattttcatagtattgattctacccatccatgagcatgggatgtgtttccatttgtttgtgtcacctgtgatttctttgagcagcattttgtagttttccttgtagagatctttaacctccttggttaagtatattttcatgtattttagttttttttttttgtttgttttgttttgttttgttttgtttttgcagctgttgtaaaagggattgagttcttgatttgattctcagcttggttgttgtcagcagggacattttctaaagtatagactgtagttccttatcttctatctgtttcttactgtccccttcagtattcttgtccttttttcccgctattatctttttgaccttttaatatatagatatctacttctacttctgacaatttttgcttctccaattttctttctttttctcctctgcacacatttatttattttcttctatgtacttctttatttttaacttaatatttgattaacttcccttccctgtctcttttccttctttccataaatcttcattaattgcctgcactgagctaggattctatactctctaaatcaataatctattttctatagtcaactgtgttataatcgtactgtcaagataactacttatttttaatacttaaaaatattttgaaattttaaccaatttaattaatacaatgttgagttcaaatttgaaaaaaacaatggaaaactgtaataattctagcaacctcctgctttttaataatgtattagaaaatttgcctctttttcaaaagcctacagtgaatctattcatacaaggcaaaagcaaaccattctcttcattctctttttttctccaaaagatttaagtgttttttgtttgtttgttttgttttgttttttagatattgagtcttgctctgtcatccaggctgcagtgcagtggtgtgatcatagctcgctatagcctcgaattcctgggttcaagcaatcctcctccctcaccctcctgagtagctggggctacaggtgcatgctaccatgcccagctaatttaaaaggaaaaaaattgtgtagagatgggtcttgctatgttgcccaggctggtctcaaacttccaatctcaagcatttctcccacccagcatcctgaagtgctgagattataagtgagccactatgcccaaccagatttagtttttaaaaagagaatacgatttgaaaaaggaaaaatgtgaggcaggagagaagaaatacacacacgagctgttttgtaattgctgtaaaactgaaatcttcagcctcactaaaggagcacttgcatgaacacctctaaattaccttattaccttctaaattaggtgtgaagtctaacttctaaattatgagtgaaatccactgcaattcttgttatttggatggaatcctaggtatgtggtccagttcatgagttgaacaaaagcatgctcatttaggccaggtagaaagaaataaagacctatgttttacatgtctcataaccactgaaggtccttctcataagcagtgcttatgggtattaacgacctctctatattttacttctccagtgcctaagtagccgagtccactgagtcctgctacatctcctccaacatgtcagcatttttttcacaggccttttgttactctagatcagaaatgttgatagcaacagttccttgagggcagcagctagcatgatgccagccaacaggaaccaccaaatggttcttaatataaattactacttattaatctatttactttgtgcatttggagttttgcatgtaaagtcctatttatgtccatatggtagataaatggaacaaatgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagagtatatggcttctagacatccaacatagaactgagtttgtgttatcagtttaagatttggttttgctgtaaggtgcacacactttgaggaactaaaaataattgtctgttcttattctgatcagaatgtgtaatgtgttgtccagttttggatgatgaatttcttatttctaatctcataagaaacttgtcatagatgtgagggagagaattaagaacagagtgtggggaagaaactgtgtacattttgatgggatccattatgtagctcttgcatactgtcttcaaaaataagttacactataaaggttgttttagacttttaaagttttgccattggtttttaaaaaaatttttaaattggctttaaaaatttcttaattgtgtgctgaatacaattttctttattacagaagtaccaacaattacatgtataaacagagaatcctatgtacttgagatataagtaaggttactatcaatcacacctgaaaaatttaaatgttatgaagaaattatctcatttctattaatatgggaactgtgtcttcatctttattactgttctaaggtcaactcaatgtagattttacttgcttatggtttcatattttagctaaatagtaaaataatatggatatacattttgttgtgacttactcatactttccttatttggaacttttatgaatatgatatagagactgaaactacaaggaacaaaatgcaatatcaattatacagttgtggcagcactgctatcaatttgttgatagtggttaacacttagaaaaacattttaaaaataatttcacataagtaatgtaatttattagctgtctctgacattttacagtttggaatagtttattttctttttggtgtcctcaccaaaacccaacatcttcaagggcaggaactgtataatttttgccattgtattttgagcacatagcatggtacttgcctctaaatagatactattgttaaaatattttttaaggtaatattttaaagtgtatgctatggtacagttcagtttgtgacttttgctagtttatgccacttacagttagcaaaatcacttcagcagttcttggaatgttgtgaaaagtgataaaaatcttctgcaacttattcctttattcctcatttaaaataatctaccatagtaaaaacatgtataaaagtgctacttctgcaccacttttgagaatagtgttatttcagtgaatcgatgtggtgaccatattgtaatgcatgtagtgaactgtttaaggcaaatcatctacactagatgaccaggaaatagagaggaaatgtaatttaatttccattttctttttagagcagtatacaaagatgctgatttgtatttattagactctccttttggatacctagatgttttaacagaaaaagaaatatttgaaaggtatgttctttgaataccttacttataatgctcatgctaaaataaaagaaagacagactgtcccatcatagattgcattttacctcttgagaaatatgttcaccattgttggtatggcagaatgtagcatggtattaactcaaatctgatctgccctactgggccaggattcaagattacttccattaaaaccttttctcaccgcctcatgctaaaccagtttctctcattgctatactgttatagcaattgctatctatgtagtttttgcagtatcattgccttgtgatatatattactttaattattattatacttaacatttttatttactttttgtgttagtattttattctgtcttctccttagatagtaaccttcttaagaaaatatatatgctaagtgttttactggtttaatatgcttagactactcatctacctcaatacttccttggagatctcctcctcagtcacacagagctcaggacttatatttccttggaactcctgttagggtccaatgtacatgaaattccctagacagacagacagtcagttatatggcttgatttcaaagtttcaaaatgatttaatggactatcaagtagtttattaggagaacagttattatactcttctaaaaataaagactttaagcaataaagatgtatatgtatataaaatggctgggttattcctagaagtacctttcttagaatttagttaaatttaatatccaagatactatcttttcaaccctgagattgtgaaaagtaacttctatcaatataaactttactacatttgtattgtgttagtgtgttacagtataatctagaacaatgtgtctttctatatgatatatgacattttaatgcctaaaaaaactgatatgtcttagatgattctagtcaggatttacttctagaatagattaaaattctatttgaggagagtcaaattaattatcgaattctcagttgttattattgctgttttatttttagtgaaacagattagtcttaatgtaaacacttgagaaataaattgatggtcaacctaaaatgtaaaaaagaaattaatagaaaatttaaagagcaacaaagctctgacatttaaaagaaatgaagtacaaatctctagggaccttaaagatcatctaataatttcctcattttctagataaataaactgagagaccccgaggataaatgatttgctcaaagtcaaatatctacttaatataggaaatttaatttcattctcagtctgttaacatgcaacttttcaatatagcatgttatttcatgctatcagaattcacaaggtaccaatttaattactacagagtacttatagaatcatttaaaatataataaaattgtatgatagagattatatgcaataaaacattaacaaaatgctaaaatacgagacatattgcaataaagtatttataaaattgatatttatatgtttttatatcttaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggtaggtatacatcgcttgggggtatttcaccccacagaatgcaattgagtagaatgcaatatgtagcatgtaacaaaatttactaaaatcataggattaggataaggtgtatcttaaaactcagaaagtatgaagttcattaattatacaagcaacgttaaaatgtaaaataacaaatgatttctttttgcaatggacatatctcttcccataaaatgggaaaggatttagtttttggtcctctactaagccagtgataactgtgactataagttagaaagcatttgctttattaccatcttgaaccctctgtgggaagaggtgcagtataaataactgtataaataaatagtagctttcattatttatagctcgcaaaataatctgtatggaagtagcatatataaggtatataaacatttagcctcttgataggactaactcacattctggtttgtatatcagtcttgcctgaatttagctagtgtgggcttttttttatcttgtgagtttgctttatacattgggtttctgaaaagatttcttttagagaatgtatataagcttaacatgtactagtgccaatcttcagacagaaattttgttctattaggttttaagaataaaagcattttatttttaaaacaggaaataatataaaaaggagagtttttgttgttttagtagaaaacttaatgccttggatgaaatgagccatgggcagggttgtaatgaattgatatgtttaatagtatagatcatttgtgaataatatgacctttgacaagacacaagccattaacatctgtaggcagaagtttccttctttgtaaaatgagggaataaaatagatccctaaagtgtgtaattttagtatttctaaactttatgaaggtttcctaaatgataattcatctatatagtgtttttttgtgtgtttgtttgtttgtttgtttgagatggagtctcgctctgtcacctaggctggagtgcaatggtgcaacctcggctcactgcaacctctgcctcctgggttcaagctaatctcctgcctcagcctcctgagtagctgagattacaggcatgcaccaccatgccgagctaatttttgtatttttagtagagaaggggtttcatcatgttgaccaggctggtcttgaactcctgaccttgtgatccacccacctcagcctcccaaagtgctggtattacaggcgtgtgccaccacgtccagcctgagccactgcgcccagcccatctatatagtttaatatcaatctaaatgaatttctcagtcctgagcctaaaaatttagttgtaaagaatgatatccttgactaataatagtttctattaatggattgcatctagtgctaggtggcatatatttagtccccacaactaccctggaaggtatttaaaatttttcacatttgcagataaggaaactaaagttcagagttcggcaacatgcttgaattcaagcagctcctaggatgttaatggtggaggttgggttcaaatccagatctgtctgactcaaaaaatgcatactcctaaccagtgcactatatcccaattccataggagcccttctttgtgattcatagcactttcccatgagttttgttgattttgtgagaaacaaaactctttttcctttggactgtctggaatctctctttttcaaatttttgaaatgtatttctatgccaaaagacaaagatttctagaggaatatgcctaggatgagaattatgtaatttaaatcacagctggaaagagagaaagtcctaagttactaagaaatgttcaaacacaaatgagctttcagtctattggaagacctttatagctagaagtatactgaactgtacttgtccatggacccctgaagaaacaggttaaatcaaagagagttctgggaaacttcatttagatggtatcattcatttgataaaaggtatgccactgttaagcctttaatggtaaaattgtccaataataatacagttatataatcagtgatacatttttagaattttgaaaaattacgatgtttctcatttttaataaagctgtgttgctccagtagacattattctggctatagaatgacatcatacatggcatttataatgatttatatttgttaaaatacacttagattcaagtaatactattcttttattttcatatattaaaaataaaaccacaatggtggcatgaaactgtactgtcttattgtaatagccataattcttttattcaggagtgcttttttgatgatatggagagcataccagcagtgactacatggaacacataccttcgatatattactgtccacaagagcttaatttttgtgctaatttggtgcttagtaatttttctggcagaggtaagaatgttctattgtaaagtattactggatttaaagttaaattaagatagtttggggatgtatacatatatatgcacacacataaatatgtatatatacacatgtatacatgtataagtatgcatatatacacacatatatcactatatgtatatatgtatatattacatatatttgtgattttacagtatataatggtatagattcatatagttcttagcttctgaaaaatcaacaagtagaaccactactgatattttattatttcatattacatataaaatatatttaaatacaaatataagaagagtttttaatagatttttaataataaaggttaagagattcgaaagctcaaagtagaaggcttttatttggattgaaattaaacaattagaatcactgttgatattttattatttcatattacatataaaatatatttaaatataaagataagagtttttaatagattttataataaatgttaagagattaaaaaactgaaaatagaaggcttttatttggattgaaattaaaggccaggcatggtggttcatgcctgtaatcccagaattttaggagactgagtggggaggattgcttgagcccaggggtcaagaccagcctgggcaacacagtgagacaccgtatctacaaaataattaaaaaattagctgggcatggtggtgtgtgcctgtatgctaccattaactaaggaggctgaggtgggagaatcgcttgagcctgggaggtcaaggctgccctgaactgtgattgtgccattgcattccagcctgggtgccagagagagaccctatctctaaataaataaataagtaaataaataaacagcaacaacaaaaacactcaaagcaaatctgtactaaattttgaattcattctgagaggtgacagcatgctggcagtcctggcagccctcgctcactctcagggcctccttgaccttgacgcccactctggctgtgcgtgaggagcccttcagccctcccctgcactgtgggagcccctttctgggctggccaaggccagagccggctccctcagcttgcggggaggtgtggagggagaggcgctgggggaactggggctgcgggtgccttgtgggccagcgcgagttctgggtgggtgtgggctgggcaggccccgcactcggagcagccggccggccccgcgagccccaggcagtgaggggcttagcacctgggccagcagctgctgtactcgatttctcactgggccttagctgcctccctgcggggcagggctcgggacctgcagcctgccatgcctgagcctccccccaacctgccgctgcagtgggctcctgcgtggcccaagcctcctgacgagcaccgccccctgctccacggcacccagtcccatagaccgcccaagggctgaggagtgtgggtgcagggcgcagggctggcaggcagctccacctgcagccccagtgcgggatccactgggtgaagccagctgggcttctgagtctggtggggacttggaggatctttatgtctagctaagggattgtaaatacaccaatcagcactctgtatctagctcaaggtttgtaaacacaccaatcagcaccctgtgtctagctcagggtttgtgaatgcaccaatcagcactctgtatctagttaatctggtggagacttggagaacctttatgtctagctaagggattgtaaatataccaatgtgcactctgtatctagctcaaggtttgtaaatacaccaatcagcactctctgtctagctcagggtttgtaaatacaccaatggacactttgtatctagctaatctagtgaggaggtggagaacttttgtgtctagctcagggattgtaaacgcaccaatcagcaccctgtcaaaacggaccaatcagctctctgtaaaaccaatctgctgtctgtaaaatggaccaatcagcaggatgtgggtggggccagataagagaataaaagcaggctgcctgagccagaagtggcaacctgctggggtctgtagaagctttgttcttttgttctttgcaataaattttgctactgctcactttttgggtccgcattgcgtttatgagctgtgacactcactgggaaggtctgcagcttcactcctgaagccagcgagatcacgaacccaccagaagaaagaaactcctaacacatccgaacatcagaaggaacaaactcaggacacgcggcctttaagaactataacactcactgcaagggtccttggcttcattctcgaagtcagtgagaccaagaacccaccaattccggacacaatttgactgcagaaaatggatgtccaaccctgtggtttccctgggccacattggaagaagaaaggagttgtcttgggccacacataaaatacacttactatagcagatgagctaaagaaaagaaaaaagtccatgcgtaatctttgtgatatgtgccaccaccaataagcaaaattgttctcttattcaaaaggttggacacagctgctctagatattttattattaaatatgcaggcaattactgtttaaatgaagatttcctcacagaatgagattaaaagtatatattagtggcttagcattcattttagacaaccattttagagattcaaatcacacacttgcttacagaaattttgttgtcttcaatgtccccattgtggtttctttaccaagcctctactgttcttcacatcaccaagttaaaaaaaaaaaaggggcgggggggcagaatgaaaattgcatggtaggccacaagttcagatcctcatcgacacaagaggtgcctgaagcagtggatgaggcttttctatggatcatgagcagccacataaatgcttaaaagggcctggcagggagcatcagtgggtgatgtggctgggaggctgaatggagagcatttgttcttcagttatctatagaaggcagctgtcactcagcaccagctaagggcttcccatgagggaactggggatcaggtttcccagatctttttatgtaacaggataagacagagatccagctttttttgggtaattatttcctattttaaaatacgggtagttgattaaataaaaacaaacgaatgaacaccatatgggcacaacaaaacacatctgtggcttggattcagcttgtgaatgattactgcagatatttattctagaggacacccctgggtatgtcctaatataaaacctaaatctaaactcaagtcccatgctaccttcagagaataaatgacccagaaaaagaaccacctctcctaaggaagtataaatttgtaaataactgagacccaaacttacaactgtacatttttcttattgttgggctgttgctaacctcaattaagaaggcttgatgatatttgtaaagtgtcatcactccaccatggtccagtaacatctgatcactccaccatggtccagtaacatctgaatggtcaagaaatatctaaacgtatgtaccaaaaatttgtgtatactactgtaccaataaaccatttgtttccatttgatctctgagtgtggtaatacatgttatttgccctgctgttgtaaataaacaaaccaaatggaggcttgatgcaagatgcagtgtagcatagtgccaactctggactccgactactcagggtgtaaattctaactctgttctattaacaccatgaaactgagcaagttagttaaaactcgctgggcccattttctcatttatacaatggagattttaatagtacagctacataggccattttgtggtttaaaatacatcatgattatgaaacacttaatgtagggcttgctacataatgagcaaggtttgttgctgttatcattaatatccttaattctcattattataaaacttgagatagtatgaggtgaacaagttcataacagcaatataatgaaaattttaataattccttttatactttaacaaaaatacgagattgggtaatttattatttttacatgagtaataaatattgcattaaaatatatttaaaatttaccacattaatgtctgccagtcatgccaaatgaccaacatgaatgtgaataaaactcagtctgtgcccatttaatcttaaccaaccctttataattgttaatgatttgaacctctgccttgaaagatcacattacttgattgtcttcaacttatctgaatgtggtagtgatttctgtaaatttataggacctttgtctcatgcagctccatggagttgaacttatgcacctttaaaatggtatatacttaattaattaagtgttgatctgcttcacatgtgtataatattattagctcactaaaccaagaaaacagtggtcctttagggaaagaaactaaattacaacagagaatataaataccatataaatatctattatttattgaactgtcacaattattgcaaaaaattaccttttagtggacaaaacaattgatattgcccttttctggaaaagaaataatgtaatatatgatgaatagttttggccagtatcctctagaccttgccagttaactggctctcaaaattttgaataataaaaacttggtgatagtagaaaaatagtaattttttaaaagtatgtgcacaattatacaactaaacaattcattcaccagtgttcacaattctattgccttctttgaatcaaaatttacatagtttttcttttagactaagctcctttatgataccagtgtgcccatttctcattaccattgaaatgtctcatgagcatgtcacattctggtacaactgctaatccaggatgacagtttagttcttttaaatccaattgagagccttctactcatgaccagagaacctaaagaaaggttaagatacatttattccttggtgtaagtgatttgtctatttttagttttcctaagggtcatatttcaatttagatttttttttataggttaggtaaaataggcttcccttttgcaatatgaaatatgtagtcttttaaaaaatttcttcaaagctattaaactgaaaaaaaattaatttggtctattcagtttgttagcacttaccattttggaaagagagtgactctacttttgtatttggtaacattttccctactacagggcagtatcttttgtaagttcttagatattagcaccaaataaataggcaaaaaaaatctattatgttaattcttagaacccctgcttggcagtgcatcattgactagatggagaagaaatgaaaataatacattaggaagcagtttcctggttcttttgaaaacaactagagagtcttgttgttgactggaatatctgaagatcctgtttaatgctttcattctatgattgttaagaatatgtcatagaactgctgtatcctgtttctttatgtcttcccttctgtttgttgattagaaatccctgagtggctttacattattagtacagtagatatgtagtatattcccataataccactgctgctattgactaatagtaataattttagggcagctttatgacagttggtttatgttttagggtgtcatttgacttgtgaagcattgaaatctgggtattaagcacactgttttctatgtggtatggaatgattcttaaagccctgagaaaatggaaaataaaaatatttttcctttttaccataatcacctatgactgtcactctatcataaactgcataaactttataacctcaaaacattttggaaatgaaatgacagaacttgcttactcaattgcttctatatacaccaaatatttttttaaagtattatgttaagtccttgaaaatattttgttctactcaatagaagcagtttaggttggtagttctatgtggaaaccgtgaggaaataattttatattatgatgactagaccagtctttgaacatcactttggttattgttccattagtaaatattataattatttctgagatttactcaccttcaaagaatgttggcaatgccagcattattaacactcctctagttagaacaaagaggaaatgtaataacaaaacataataatagccaaataaagagtgacttagaatgtacacccttatctaggatcctgagtaattcgattattcttaggaaatacacttttgtgctagaacaaagacttttgaaatagctaatttctgggtttcttttcattttgaattaacttgaatttcaaggaaacaagggtagtttttacagatacagtgcatagaagctctgtgtacaatgaagaaaagtaggaaagtgagaaaaatgccattagatttttcatcgttatactatctgatatgtgaatttaactaaaacttatatacctcattatagtacttcctaatgtaatttcttaatttaagtgttccccataaggtttttttttatataaacttaagtactgttaaatatttaaggcaaattcaggtataaaataagacttgttgatatcttattccaagcatatttgtttctctcctatttatttttattctgtgttcatttccaaaattgttttactcacaactgtttgttttttctgtttcattctgtggtaaaggtatcatttggctaattgtataatttcagtgtcatttctaatattccaattgtgatagtatcaacacaagattaaatttctctacatggtttatgagaatggaatgccaaattgaaatagaacagagcacagatgatctaaatataaaaagaactacaaaaatcacagttgtttaaaaaggttttttgtttgtttatatatggtgcagaacatttgttccttagccaaatgtttccaccttgagaaagctatagagattctatgtagtcctagtaccaataatatgttttaacctgaatgtaccttatctttattcataaactgtgactttttacactgctgaaacttttttttttaagacaatctcactctgtcgtccagtctggagtgcagcagtggtgtgatcttggctcactgcaacctctaccttctgtgttcaagcaattctggtgcctcggccacctgagtagttgggatcacaggtgtacaccaccaggcctggctaatagtttttgatatttctagtagagatgagttttgccacattggccaggctggcctgaaactcctggcctcaagtgatctgcctgccttggcctcccaaagtgttggtattacaagtgtgagccactgtgcctggcctgaaactcataattcatttccattaatattaatctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatatctattttcttgcaataatagtatgattttgaggttaagggtgcatgctcttctaatgcaaaatattgtatttatttagactcaagtttagttccatttacatgtattggaaattcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctggcttttgcacagaggcatgtgccctttgttgaacctccatttgactggcatgcacatgtctcagatattataggttatcatatattgttgctcctaatatttctgtgttagataattagagtagcttggtttgtaagaatgtgatgttggtgggactgtagcagaacaagaaggcccttatgggtcagtcatacctctcttttcaaatatttggtctagctctcttctgggcatcttgttgccaatatatagtattgctcaaaagggcaggagatttgaagtgatcaaggaaaatatattttttctattgattaagtcttttgatggggtagaataatctaatttcatgtaactgctcaaagttatatggtagggggatcccaaatgtattttaaaactatttttatatcatcatatttgaagtaatagaaagtcagagtagcagaataaaggtactaaaaattttaaaaactaataaggtactttgaaagaaatcaattatgttgattcctcattaaacaaatttgcacttaaagactgaggttaataaggatttccccaagttttttcatagcaacctgtgagcactttctctgttgaggcatttatggtatgaaaagatgagtaaggcacagttcttgccctggagaaggtcacaggtgagaggaggagttgacacagaaacatttgatataaagcaaggaataaattccaagactaaaattttcagaaatctaaaaaactcaagataagaaaaacccattatattttctgggtaacaaaatttcagtgttattaacatgtaggaagatcttgatatttattctgaagcccatgtgtgttgctgaaatattgccgcatttgcatatactcatcaccatcctctgttttggagctaagaattttagactcaagatgtctaattaagttgatccattgattttattttttatggaaatctgagacccacagaaggcaggggatttgcccacatttctagaagagtcagacatgagcgatgaggcacagtggaaagaacatgagcattgcctgagctctgagttggcgctataagagcagtgatcatgggcaagtgactcttctgagccttggcctcctcacctgttaagtgaagaaaagaatatttcagaagatctttgtgagaatgaaacaaggcaatttacttgcctgctacatagccaatgggaaatcaatataagttccccgtggttcccttctgtggggttttgttcccacagagggtgcactggccattccacttcttcttttccaagctcctcattccctttaacgctgttcatagttggttccaaaccatttgaaatataataagcaccaggatggttttttctttccaccaaagcaaatttcattttctaaacactgtttataaatatcaatggctattttttcaatttttgattatcatgaaaatatacaaatatgtttaattaaatatgctaaagaatgtattaataaatatgtattaaataattcctacatataaggcctttttgcttggggtatgggtgatacaaaataaatgtggcatgaacccactgacctctagcaatttataacctagaaaaagagttatgatatgtttataagttcctgtgatataagacatgcatatagtcattataacagaggtgcaaacaagatgtatcaagtatgtccagaggaggaagagattaatcccagctggaggaaacactgatgctttcttgcagcaggggcatttgagttgagaaagggaggaaacatagattttgacaatgagagctgaggggaaaggggtttcaggtggagggaaccgcatgtggaaagcagggaggtaggaaagtgtagagtgtgtttaaagaatagaccagtttggctgaaacaggatatttgagcagaggaagcttgtactaggtaggtgggttgaggccaaattatgcaaggcattaaatattaaactaggaattttggactttatcctgcagtttatggggggtaaatgataagattcaatatcactttatttgtacagtattatgttacattttatctaattgtttgtttaattcctgtctagacaatgaattcctcaagggcaaggagcatggcttattcacctcagtaatttcagtgcctagcattgtgcctggtacaaagtggacacttgtatataaccttttttaattgaagcaacaagttgtcaaccttacaaatgtgaatccgtgattcagatgacaggttgaaatgtagattgtctgcgaagagggcagaaagagagtatgacaaaggaggacaagacagtggggcaggcagggagagagagcagccagggtttcggtagaggtatgtcaaaaaggtatggaagtcagaggagaaggagacccctatgttatagaatacaaatggaagggaaatgatgacaacagtaagttgtcattaaatgcaaggttgcaaaagtaagattgtaaagcaggatgagtacccacctattcctgacataatttatagtaaaagctatttcagagaaattggtcgttacttgaatcttacaagaatctgaaacttttaaaaaggtttaaaagtaaaagacaataacttgaacacataattatttagaatgtttggaaagaaacaaaaatttctaagtctatctgattctatttgctaattcttatttgggttctgaatgcgtctactgtgatccaaacttagtattgaatatattgatatatctttaaaaaattagtgttttttgaggaatttgtcatcttgtatattataggtgggattcttaatagattctccaaagatatagcaattttggatgaccttctgcctcttaccatatttgacttcatccaggtatgtaaaaataagtaccgttaagtatgtctgtattattaaaaaaacaataacaaaagcaaatgtgattttgttttcattttttatttgattgagggttgaagtcctgtctattgcattaattttgtaattatccaaagccttcaaaatagacataagtttagtaaattcaataataagtcagaactgcttacctggcccaaacctgaggcaatcccacatttagatgtaatagctgtctacttgggagtgatttgagaggcacaaaggaccatctttcccaaaatcactggccacaaagtgtgacattttggcattggcatcactatttgatggaagccaacctccccccaaaaggcctgtattagaatgaagatggattccctgggtgggttacacttgaaactagcctcacccatgaacactttggcacagattagctagcccattcccccacagtaaggaccataaggaagggacagaagcaaagataagttttagaacaaaagagaggggaaagaaaaaatctagggttttatgagggctgtccctgagtgatagatgtgaataggcctccagggcaggctggctcagaggctgactctttgggttggggtgactgattggtggtgaggatggagaagaaaaggggagtggaggaggtgaaagtgaccttgggacattaggtctccataagtgacaggatttaaggagtgttgtaagctgtggttgttggaccaggtttaagcacagcttcctgagcttcctgactggtttaggtcaagctccagagagcaaatgccacagtctcagtgatctccttggagaaacagttggaataggatgttgcccatgttgggatgagtcattgtccgctcttgctctttccctacccctgcaaaataataatactgtatttgattgaacatataaaacaaaagaaggattatcacataagtatgtatatataaccaacattggcaggtgcagaaaaaccagactgtcagtttgcctcatctgaaatgattgacacaaacaaatatatttactgtcccaagtgaactttggcattttggatatccttcagttgttctgtttaaagatataacttagaagcagctgatggaatatttaaatccatgcgttgaattcatgcattcaaagaaacatgtcctgagtcactaaatgctgacatttgtttttcatgttaagagtgtaaataactggtcccaaatataatattattacatcagataaaaactggaatgtgaacctcttaacttgattgtgaaagtatttgccaatggtgcctcttgataattatttgaggctcacttcagaactcctctggaagggttaatttttaaatagtcattttataaattaacatttttgacatatgtgatggctctcaaattttttcttttatgccagtttgaatcatttctgctcaatttttttttttaattgggatggagtctcactctgttgcccaggctggagtgcagtgatgcaatcttggctgactgcaacctccacctcctcggttcaagcgattctctcgcatcagcctccagagtagctgggattacaggcgcgcaccaccatgcctggataatttttgtattattactagagatggggtttcaccacgttggccaggctggtcttgaactcctgaactcctgacctcaagtgatccacctgcctcagcctcttaaagagctggaattataggtgtgagccactgcaccaggccctgttcaacttttaatgctaagattcatttgttgttgtttcacaagtgattaggcagaggtcttttatattaatttacccattttatttgtaagagagtctcatattaaggaagcataatatatgacaatccaaatacagtacaaatttggttaattttgattttgttaaataattaatcacaggggtccttcaaattgtgagctcctctggttatacttatgttttacctctggttatacttaatttcaaacaaatgaaatttcattctattcatgatatttcagaagcagatctgttgcacaaaataaagcatacctataaattttctttttttaaaaaaaagtctctgttcactctattttctattatttttctctttttaaaatttgaattttattgtggcaagtccacttaacatgagatttaccctcttaacagatttttatgtgtaaaatacaatattgttcaccatgggtaaatgttgcacagcagatctctggaacttattcattttgcactactgaaattttatacctgttgattagtatctccccatttccctctctcccctgtcctgttacccatggttctgttctttgcttctttgagtttgagtattttgatacctcatgtaatcttcattctattttctaactttgacaatgttctgacaaatttgctttccggattggagcactgtatagtgaaaattgaaaatcttggttattttctacagattcccactattttaccttgagcagacacttatcttgaagggtctcagatttgtcacttgtagaatggggaatataaacctgataatggtccctttcagttctaaagttatatcagttgaaaatacatgtgtcacttatggtaacgggtagagaactggctcactgaacagcatatggatattataaagtggttttttttaatcctttctgcagacagttactttatactttattcaaatggattattgtgaagtacatgttagcggactttgtaccttttaaaaatgtatgtatttggtgtaatgtagaaatatagaaatttattaagtatgatttatttcaatgttaagcatgagaaaatatgctccgaaaggttagatagcttgcctaaatgacaagcttgtatttcaagcagaactttctgaatcaaaagactccaagacgaatgcccagctttcaaaaactgtctaaccaaaataaatcctaagattcaccttcatactaaaattatttaaaaatagtttattttaaattaatattcacttaaaatgtatttatcatgcaatactttaaagtgtctgggaaatgaaaatatccaaagatcaaagaacaccatgttttcaaacttcaaaaatgttatcagtgacctaaacaatttttaaaattttcatagagcctatgaaaaatgtacttgcaaatggctactttctgactaggaatagaatggggagagtatttagtccaacaatgatagactggattaagaaaatgtggcacatatacaccatggaacactatgcagccataaaaaatgatgagttcatgtcctttgtagggacatggatgaaattggaaaacatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaataaaaaaaagtttgaggtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgtgtatataaaaggaaactatattacaaagtacacatggattttttttcttaattaatgaccatgtgacttcattttggttttaaaataggtatatagaatcttaccacagttggtgtacaggacattcatttataataaacttatatcagtcaaattaaacaaggatagtgctgctattactaaaggtttctctgggttcccaaatgatacttgaccaaatttgtccctttggcttgttgtcttcagacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatatacatatatatatatagtattatccctgttttcacagttttaaaaaccgatgcacacagattgtcagatagcaattctgtgattgaaggggaaatatgtcacctcttcatactcatattggtgaagggtcctagcttcaaaattaatagattcctaaagaggggaaatgaaacatccgcatttacacacacacacacacacacacacacagagttcctcttgtcggtaagttttgttttttttaaatctctactagataaaatttgttatctaattgtgagttttacacaaagaaaaactgtcacagaaaagaaagacagtgtcacatttttcaaaagaaaaagaagaaaagaaagtgccatgtttttcaaatacaaatgttctggattgattttaggatctttagtgaaaaacaaagtatttcataataagtaaaataaaaatctatgtaggtaaatttgtttctctaatttaagaatttgaatttctgagtatttatgataagtgttgaaataacttcttatatgtgacagtgaatactggcagagcaaatgccaaatcaatgccaaatctgtaggatcatttgattgtaggaacagaattctactcaaaccgaaagcaggcatttgctggagttacagaaaggcctcatggaacaccgagaaggtggtgccattcgactcttaaagaagctgcaacaggcacaagagagtcagctgcagctcttcttcttgagtctatatctgtcctgggtccattcctttttgtggttgcttcattcctttctctctctgaagactggtttttctggtctaccagggctatgccacattgactttatgtagtgtctccattctggcctcctgaatttacaggagagttcctctgtacaaactcaaagtcctggagagaacagaaaacagcttccttttggctcaggggtccaactgcagtctactctgctgctatgaggatagtgggttcaccacctttgttgttctctcagctagggcagtgggaaatgactctatgaaaggaatatacatgggcaggcaaatgtactaatcctcatcagtactgtaattttaagcaactttaaaaaattcttttaagttatttgaaaataagatcaaagaaggctgaattacataaatgaagatttgttaacaattaattcaaaccaatataacacatgctataacatggttgagtgtgattgagtcttgatttattaggggcaataatcaaaacatttaacaatcattatagtacagaacttaccaatcaaatcagatgctcagccggagtggatgttggccacccagctattattatccctggctcaattggtcttcagctgtgttaacttgcaaacattaattaactatctaagcccctcattttcctcaagtgtaaatagacacaataatattacctattccataggtgtggggtgaatagtaaatgtaataatttgtccaaaacacttagtatagtgcctggtccatggtaaatactaaataaatgttatctgacttattattaaaattttatcttctcagcttaaccttcagaacagtaatatattggggtctagataaatcttgcctatatgaaaataatttaatactacatgcagatatatgctgtgtatattatgccttctgttagaggaattgcagaaacaaaaatttcaattaataataagatgaattatttctcccaattgtagaatcttttgacaattttatcatgcattacagatgtaagaactcttgattgggacttgatagtctaactttataataatttaagaacattcctcttagagaatttctatggccataatactgaacacatgaattttaattagctgtcctctttagccctaaaaaaaaaattactgtaatttaacacttaagtgttgttcttcccaggtacagtaatctttttttttttttttttttttttttgcatagagggtaatcttttctctttccaaatggcagaactgttagttttctgactgtccggtgaaattctaagtccacttacttcccaatagcatgcaattagcaaaggtcctccttgcaaaggcacagaacacacctaaacatcttgcagatgctgtttggacactcttcccctgcttttggtctctttgtaaagcagctcatctggatacaggatctcttttccccattgcccattctaatatatgttaccgttattacttatagaataatagtagaagagacaaatatggtacctacccattaccaacaacacctccaataccagtaacattttttaaaaagggcaacactttcctaatattcaatcgctctttgatttaaaatcctggttgaatacttactatatgcagagcattattctattagtagatgctgtgatgaactgagatttaaaaattgttaaaattagcataaaattgaaatgtaaatttaatgtgatatgtgccctaggagaagtgtgaataaagtcgttcacagaagagagaaataacatgaggttcatttacgtcttttgtgcatctataggagaaggagaaggaagagttggtattatcctgactttagccatgaatatcatgagtacattgcagtgggctgtaaactccagcatagatgtggatagcttggtaagtcttatcatctttttaacttttatgaaaaaaattcagacaagtaacaaagtatgagtaatagcatgaggaagaactatataccgtatattgagcttaagaaataaaacattacagataaattgagggtcactgtgtatctgtcattaaatccttatctcttctttccttctcatagatagccactatgaagatctaatactgcagtgagcattctttcacctgtttccttattcaggattttctaggagaaatacctaggggttgtattgctgggtcataggattcacccatgcttaactgagtggtgccaaattgtcctcaagtctgttgtactgatatatatccccatcaagagagtacaagaattctcatagctatgtatcttcaacaacacttggtgtctggtagatgtgaagtgattactaaaaatatagggaagctgcatacataattattggcttttgctgttctcttacattaatttcttattcatgttgattactcatttgtcacctagttttttcttccttaattaaattgtaggaatttatgaattatggattgatcatcagctctatacatttcaaacataatccctcagtcagtggcttggcttatagagtcttttgatgaaaagaagcttttaagtttaataaagttcaatttattgtcttttcctttatgttttgtgcttttggtatcttgattaagaactccttccttatattgggttctcaaatttagcagcataacattttcatactattatttaaatttttttcacattatttagtgatagcacctttcttattcctaaagtgtttatcattgccttctgtctttctgcttgataaatattgccacacatttgtatactttattagtgtgtacaaagaccacattttagttgtgttatttctcttgttttggttttctagaatgcagagccattaatattatagtaatgcttatgtgctaataccatatcaggggcacaaatcccattgcagcgggactgagaaattaaaggaaatgatgcacatttactcatttttgtttaaaaaatcaaatgcatatttttcaatcagactatatggttggtctggatagcttcatcattgaatttttaaagtatttttgtactactgtatttaaaattattcattcaccactgcttttgtagatggtttagaaacccaagttaggaatgactgtgcaacactattattatactctttttaaaattatactttttgcttaagtttctttccttgttctctgagacagtgttcatgttcccaaaccacacacatttattcagctataaaatttgtatgatcaactcctgtcagaacaaacatcattataaaaaatatctccaggaaaaagaaaacccttttaatgctctcttctggttcatgtgtcttcttattttctttaagcattttcataacccattgagctgtaatttaattggaacatgatttatactaaagttggtttctttacctttaacttttttttttagtttgatcagctctctttagcttctgtagttcggtctttaattccattccagtatgcttttggagttgggtctcataaatgtatagaaatgtttctgttgggaaacagcaggagaatattaaataaatattgtgcttacatctatttaattctttgcccaactttctacaactttgactttacatttaagctcctcatgcacttacatgtttctttacctaaaaatatcttttcaccatgggtgtgtacaattcctttgtccttgctgtattaattttcttggtttacatagtagcctctacacattgatgtcaaaacctctgtttggtgcatttctactctgcgtgttcaatctccatgaaagtttctgtaaggtattttcattcctctagtttttcacatgtgcatcctggctttgtgacctgtgctttgatatcgtgcctttcatcttgtggcattgaaggatctttgcaaggacctattgtgttataatacagtctatgaaaaatatcaatatttgcatttgatcacatttaaaaaaatcacattcttttgtttgaatatcaaagctaatatgtgagtgatttccctgccaaatagcacaagtagcctttcctgggtgtttatgggcatttatctggttaatgattcccatcatagtgctgtcacccatgccattgctaaacttatacagtaacttttttgttttcacctcagcatatgttgagagtaggaaatagataggactatgccctcaaattttacgtttatatgatgttaatcctaaaggtccttgtgacttctgaagtaaaaactcagtgttgtcattttacttactgaattgttagctgagtttagagttgagtttacaatggagtaaacaaggtgtttagtttgatgtatgcttttagtctttcagaaaaaaatgtttatacttggaaagaatagtttatttacccatctggcctagtttagacaaaaacacagagtcaaatgtcaacagaattctgaagttataaaaatgacagtgtggctttttttttttttaaccttccacctggtgcttatgcccaagtgcctagctttctttagctctcaactaataaaggtaatgtttagataacatttaacgttaagttgcattgtgtttatgatcacatatctcaaatattggtacacgaaactgtacaacaaccttttttattagattttcctacgaaattccttattatattccctaagatagctttttcccaccttcttcttccttctcccttctcaggtgctccaataattccaacccctgcagccagtgactttattatatctttttttaaaaatctaaaaaaaaaaattgatgcaaccaggaagaattttctcatttctctccaccagttgtaccagcctactgcacctctcctcatgcaccaccttctgcctgtgttcttgctcctatattcaggagcaagtaatatgcaatacctccctctttgtgggatctttctcattagcataaaaatactttcccttgatctccagctactaccccatttctttgacctacatatagcaaaatatttgagaaaggaccactttccatcttttcctcaatctacttccatttttttctcaatccactttcatttcattgttctcctcaacccattctttccacaacctacttcattttatttccatcagccccataactcaggatcaacatcttgccagagccaatttccttgtctcccttaacagctccagcagtatttatgccatggacaaattattcttcttgtgatactttctctcttgcttccatgacactactcccacttcattttctttctacctctctggctcttccttggtcccttttcctggccccttctctctttcagatctctaaacatcagctatatctcagccctgttctactgacactctctagctgttattttctaaacccatgtttcagaaaccatatcttgatgaatcttggaaggccgaggcaggcgaattacttgaggtcgggagtttgagaccagcctggccaacgtggtgaaaccccatctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccgtctcacacacacacacacacacacacacacaaagaaaataaaccatctcttgatgaatcataaatttgtgtctctagtttagacctctatcctgctctctaaatgatgtatccaactatcatcttgacaccatcatatgttcataaaacataattatagaatatctttcagtaggcttgacattttaaggcatgagtttccgttcagtatctccttaaaatatacccagggtctcaggagactattcaaacaggacaaagcttctattctacttactaatgtgtctggccctatttggcaggttggataaaaagtcatctgaacattgtcactttatgaataatatagtttaatagtttgtgaatcacccctgcaatttaaaaaatagtaaaattatcagaatctaatttaataattcctattggaacaccccatgttaggggatttccagttatttcaattgatatctcaatgttttaaagattgtttatttctattactaattcactctttattttaacataaattgtggctatctatctctattcatttcaattatatttctcataccattctatagatggggtgaaaagaaaagtgttaattttttaaaactccatacctcaaatactatatgaatttatagttgttattgctaaagcaattatcttacatcttttcctccaaaacaaagttatgtgctggtttattttctttgtactcataagatgccttccatttttagtaacataagtcttgtctttctcctattcttagctacttaagcattatgtagcttaaataagcactaaagattcctatctgtatgaaaaaataaagattaaataaataagatctagaaagggtgacaaggtgatgcttcaaaatgaaccataccaagccatctagcgattgataaattactcacactcataatcacattgttggaaagaagccattgacaattcagtttgtttcacaactgtctatcacatagtgagcacaactaaaagactactttttgtcttttactgcttgttttgttgatcaagtgactgattgtacaatgaccaacaagaagtctgatgtgtagagaaaaggggaacctggcttttctgccttactcctgatgcctaattctgagcatgtgaatattattctgtttctttaattctccaagtgaagcagcagataaaccatccttgtttccattagctgtctaccctgttcaactgtgtgtttctaataacataagaataagaaagccaccagggtgagcagggaaggcaatgagtctgcaaggcttgtggatagatttctgttagtgaggctctagaaagttcttccaagattgatgcaatctgagaagagttttctgtcaatacaaactccctgggtttctcctttgtccttttactgcctgtgtttgttttgggttccagtaaagatcaagtgactgattgtaccatgaccaacaagaagcctgatgtgtggagaaaaggggaacctggcttttctgcattactcctaatgcctaattttcttgtactgaaagtagtttttgctgtaagaatctgaggggaggagtcatttcttcaatttttttttttggtctccttttaatggtttcttgatcatgtctatccttatttttctgttttcacaaatttttgtggtatattttcctctcatgacctctgtctcaagacttctttccatccatctcttctcatttcatcctgtagagtgtctgtggtaagagccctgcattctactctggccttgccatgtgtggccttgggcaagtcctagcctccttgagggtcttatttttctcatttgtaaaatgaaacagtttgatgagaagttttctaaggttccttcaagctttgacaatctctctcttctggatctttttcccatgaaaaatttcaactcttgattagcatgtaggcagggattattccacatccttataggaatcacatttctgctactgtccctgaatgctagagtccattgattaagttattcactgctgcaattgtcagagctgatcaaagaactctgaaccagtgtgttactagaactaacaaagaaaatgccattatgatgttctagagtcttgaattagtagaagaggtttaataagaaccctaagggattgctagaatgttaaaaacaaacaaacaaaaaaaaaggttgaaaagtttagaaaattcactggtctttgtgcccatcattttacttccagggtttagataatctcatttttgcaatgaaggaatggattagatcacaagttctcatcctagtagcacatgcagaatctttataaaaacacagagtagccaggtgcggtggctcatgcctgtaatcccagcactttgagagcctggggcaggtggatcacttgagaataggagttgaagaccaagctggtcaacatggcaaaaccctgtatctactaaaaattcaaaaattagccaggcatgatggcacatgcctcccagctactggggaggctgaggcaggagaatcgattgaacccgggagatggaggttgcagggagctgagatagctccactgcactccagcctggtgacagggtgagactccatcacaaacaaaacaaaacaaaagaaagcaaaaacacagattactcagggtccactaagaccagtgaagtcagttctcttggtagggggcagggtgactgagcatgatgtttgtaattttaaaagtgctccaggtgattctagcgtgtatcaagcaagacttgtgaaccactgaactacatgctaagactcattttagctctgattttctgtgagtcatagcagagggctcagcaaactttttctataaatgctaagatagtaaatattttcagctttgtgggctgtatcgtctttatgacaactcaactcagtctttgtagagaaaagcagctgtacataatatgtaaactaatgggagtagctagatgtgtcctgtgggccatagttttgctgactcctggtctatgtcatagaatttccttttgaattgatggaccaccagcaaatgatttttgtcctgtatcaatcaatgatacatacataaatctctacaagacatgtaaaggatgaggcttaatgacagagtactttggggaagacataatattgcaaaattaagatgcttagagaaaaatcatattaaaatagtgaaaactgtgagaaggtattttgatttgttgttttggattcctctttttgcaaattcttttgaaatattttcagtggaagctacatagatccaattgtattcaccaagctagattgtaattaagctccagagtaagtaatagatttgatgagtgatgtccaaccttttacatggaagagtaagtttgagtcttcctttgcccattgacacacttagtaccatgtttaccaaagttcttagttattgaaatgggcaccagcatattttgaaacgttggtgttaacttgggatatgccttttgtcatgttgcaaatagattttgtttctgttttgtgaagatcaccatctctgtcacttctgatagaaaaagtgacactgacttctcaagtgatttgacacaggttaaaatatgtaaaccatttctgtagagagcaagctgtaataatatactaaagggctaggtttatagtataatataaataactcatttatgctgttaataatttatagcaacatggcatttgactgactttttatgtgctctagtcatgtaagtaatagatgtggaaacatagaccagagtttcaagaacatgttttgggcagagtctgttttcttgctattatctcttaagtttatgttcatggcctaaagattatgctaatggatctgccttggtcttgggtgtcaggtctgtgttagcgagtattgaaaagcatagtttttgcctactgggaaggatttatgatttaaaagccctaaatctccccttttatgtacttcatacttagaaaatttttcctgtaaactgtgtgacttttttacattgtgccagttttctagatgactctcgtcatatttatttcttgcaatccttctataactatcagttatgaagtctctttatagtgttgccagccaggtctcaggtgtgtgaaatgtattttctattatggattttggggtatgatggcacatagtttgggtgttaatgcctaatcttgatgtactggcttctgaacaaccaaaaggatgaaaggaaatagaacaaatatttttgtgagggagaggagtctggcttcttgacttactctagaaaaagcctgtaagcctcctcttccctccttgtcacacaaagtgacaaagaaaatcaagaattgttttcttcttggcttaaatgcatcccttataaagtaaggctgagatcaggctgtgaagctatctttttgtcaagactgtcataattccaaaacactttgttcttctaatgcttaggttagtaactttaaacatttttataaagatagtgaggtccagttttaaggattgaccccttctcaaggggctcagaagaggttttggagaataataaaattaaataatgaaaccaataatttaaaccagatcatgatccttaagaaaaaatcccatcaaatttgggctaaactctaatatacagaggtctgcacaacttatgtcaagtattcttccccacaaatgaagaatggggttcattgtgtcattggttgggtctcattttggcttcatcttctatttctcaaagtctaagaaaagtgctcctacggaagtgggtgttggctatcatgagactttgctgctggcaggccagcttgctgctctagacagagatatccctcgatcctccttggacaactgttttctgtgcacaggaagcagcaggctggggttaaggagtttgccaatccagtcattctgataattgctgaatatgaatttctatccagcacaatctaggtagctacaatggcacagtagtttttatgtatcaggtgaaaatgtttaataggcactctaaatgagagaaaaggttaagtgaggttaaaagctcaatgaaaacaaatagatgagactaaaaatagttcaataggttgtaacttccatctcatccaaacagcaatgaatattttgaggctgaggcgctgaggggtaaaattgcagcctggactacttgctaatgtagacctacagcactgtcattcttactgcacagacactgctttctgcataggaggtagaataatgaattcatttattattaacaaagatttattaagtgactgcatggtgctaaccactagatggggagggatgttttgaactgtccattgtttgactataacaaggaacgctttgaacgaggttactatcataggcagaatttgtttaacatgaagcctatgagacataagccacaggtcctctcacgtgcaggaactcctttgaaggccctatacttaattttatatgcatagtttggatttggattcttttttttttaagagttccccaaattacttaagcttcaggctccacaaaacctggatctacccctggtagcagctatgaatctttgactatgaaattaagtgtacaagaaatatgactttactttttctgtgattgagtttattttctatttgagcacgcattccactgagtgaaagaaataatatcattgaattcagagattttgctgggttctaagtggagtttacagaatgccatgatattaggaattaaggagtgtgttgccctacatcatcttttgtccgtgctcactgtctctgaggcactgatgttcctatgtgacctagaggggcatggtccaggtagatggagtctgtccttgttctcactgtgagctctcgcttgctgacccttcttcagtttcttccatgcccctgaggggtaaaaagattcaaatctgaagctatatcaagccatctgtgcatagacattccaagcaaccatgttcactctactgctcccatgtcatgcaaggcacaggaagcttcactatggcatgagtatttcctgggctttgccttggaattgaggcacgggcctcctttgttctaaaattccccaaatctacttgaggatagaaccaggatttggttgcaaggcagaacttttcttagaggacctggtatctaaaccctcttgttacccccatttatggaccccatttatggggtgaggagagtgactgcttctaatccatcataatttttgtctatggctactgtttttgcatagacactatgttttgagtccttaggctttggcttttggcgcttaatggccaatattcacatggctcaaaattttcaaatgatccatatctgacttgagtttcaaaagtcagtttttgaaacttaaatgatcagaattgatttgttctgctctggttctgatgtggcctctccttccagaggtactggaggtagaatatccaaggtggaaagcccacgactacaaggaattggttagtaattcataatgttagctgtccacatctattcagtaatggcatttcagtggctgcacaactgaccatggtgaaagtgtctgcacaagccactttttcttcctgtcagaaaatgttctcacccactgaattgaatgactgtctgctcatatgctgtgaatgagtgcccagtcttaagattaaatcacacgttcttggctatgcatatttgggcatgctgtggggagttataataggctgtcttagagtcacattaagcagctagacagacaatgagttggaaagttacattttctaaatttgattggtacattccatttgtcacatttgacattagaagttctggattcaccctctatggtgagcttcactaatggagaatgtaatttgcaatgctcaaacacaagtcctaaacagaaaacattgtatgttacattccagtgctaccaaaatagtggttttgaaagtccttattttctaatactactatgtgtaattttgagtcatttagatagcaacagttaaatgttttatagattgtttggaagtattaaaatgtgaaggatttttgttatatagtgtctttcctatcttgcttaataaaatataagtttagaattgtgtatagaattaacatgcaaaaatatcaagtctcaactttatacagttaatctacatttgtgtatacccttcaattatttcaagagagggatactattcttatgcaggataaatacaataagatattttaaatgaattttaactacatctctggcagtttcatctcaatagtagttgtaattttatctcccagaccttattatagactagcagctctctatgaaaattagtgacagtgtgagtgtattttaattcaaagttaatcaagaatgactgagtcaagagttagctacccctgaaagtaactcataattcagaatttaaaatattacatgtggaacaatcatgactatatgccttttactttctctatcattatttaggttgtgggctttgggtccttttcacatccgttaacagtgggcttgacttcaaaggattattttcttgaatcttgaataattgctgaagacaatttgaagatattttcaagatgaaggaaactgaagcacagaatcactagagtgaaaaaagaacttcacaaacagtgcaggcttgatcaatggcatgggaaaacaggcaatacagttagaattgctaagatggaattttaacgttcaattaaggatctatctctaaactcctctgctttatccaccaatcattccatattaaagatgaagaattgttcccatttcaccttttgataaggaaaaatagaaataacagaagcaaatacacttttgcccacatttttttccaaaaagaataatttttgaagtctaaacgtttggtgtaaataagatgatgtgttaatattgtaaaggaaagctagttaagtttttgactgaataaagccagcatcaataattactagtaagactaaaaataagagcagtaaaattgtgtctaatcagctactaatatctgggaaggattgagccacaggatcaaagatggtatcttttaaaaatagaagttgagtgaattcggtcttcaaattctttctttttattcatttatatttatttactcattagtatattcattcctttattcatgtattgttcaaatatatattgggtacttattatatgccaagttgtttttaaaatcacattccaaattcccgtaagtcataattattcagagatgtatgttttttttaaaaaaaattgaacacctttaaaaattatcaagtccttttatttctgtatgcattaaagataaactttactaaatgttacatgaatagatttataaagcagataaatatttaatttcaaatataacccttatatgcaattatattttccttagcactaaaaatgaatatttaagtaatttatattaaaagtgtaattatttaactgcagatgtatgccaatgacttaaattgtttaaagattatagcaaagttgtttaaaattgtctaatcatgaagagttcacttaaccacctggttgacacataaaattatagttagttactaaggtagttcgagagaaagagaagaatcttcagtagtggttttgaggtgtggtacattttattataatataccggttatacagcattgtgcagtgctgctcatagtagaaataaattttctctttgatgtcatctattcccttgtgtggcttacataactgagaattaggtgatcacaaaaataaacaggcctatacagagcccatttatataagtcctggttatttctcttcagttaaacttttaattatatccaattatttcctgttagttcattgaaaagcccgacaaataaccaagtgacaaatagcaagtgttgcattttacaagttattttttaggaagcatcaaactaattgtgaaattgtctgccattcttaaaaacaaaaatgttgttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttattatatggagtcattatttttaatatgaaatttaatttgcagagtcctgaacctatataatgggtttattttaaatgtgattgtacttgcagaatatctaattaattgctaggttaataactaaagaagccattaaataaatcaaaattgtaacatgttttagatttcccatcttgaaaatgtcttccaaaaatatcttattgctgactccatctattgtcttaaattttatctaagttccattctgccaaacaagtgatactttttttctagcttttttcagtttgtttgttttgtttttctttgaagttttaattcagacatagattattttttcccagttatttactatatttattaagcatgagtaattgacattattttgaaatccttcttatggatcccagcactgggctgaacacatagaaggaacttaatatatactgatttctggaattgattcttggagacagggatggtcattatccatatacttcaggctccataaacatatttcttaattgccttcaaatccctattctggactgctctataaatctagacaagagtattatatattttgattgatattttttagataaaataaaagggagctgaaaactgaattgcaaactgaattttaaaactttatctctctgtggttaattgcaaacacagatacaaaaatatagagagagatacagttagtaaagatgttaggtcaccgttactaacactgacatagaaacagttttgctcatgagtttcagaatatatgagtttgattttgcccatggattttagaatatttgataaacatttaatgcattgtacaaattctgtgaaaacatatatataggatgtgcgaaaagtccctgtgtatcatgtgaaatggcttaaaacagaacaccataggtattcatatcagtgaataccataggtagctgaaagtgttttttcctggggtcgccaagatgaatgccaaaagtgatatcattattataaacaatagccagaataggttggtataaacctggtagaaagccttgataaattgactttctctcctcctgacatcctgccacccctttgctttgctgatgctcatttgtccactaaattaaactcaagcaagccctagtaaagtaatagaatttgtggagtcctcattagtataggaagtttccctgatgtgagattagtaattagagatgtagcaaaatgagaaagaagtaatatgcttagatatttcattttctctgaacctgtatatacaaaataggccatgcgtgttcagtaactattcactgcaaggcactctctaggtactttgggggaattggaaattactcacataaggctatggattgtgccatttgtcaaaagacaaaatgacaacaaatttagtttaaagacctcagtcagctttattttctattctagatttggacagtccttcatttcacaaattggagtaagtgttccaataagttgagcaaaggagcttggctttatagacccaaaaaaagggccaaaggaagcagaaacaaagaacaataagagaattggtcatttcaaagttacttttcttgaaaggtggggacaaggagacagaataatagaaaagtcactgattggttaacattggattaagaattaaaacagaggaaactttaagattgaagtttgaaactgacttgtttgggaaatcaggctgtcttctttcttgatttcttagaaggccggataacaactgagttttgctttggtgaacatgggtgactccatttttacttttagtctggtctgttgaggcctcgtgagagagcttaatctaaaacaatgacttcctataatttttgtttgacacatccaaagagggactctaatatttattgagagcttatcatatcttaagtactgtttaaacacttttatttgctattacatttgatcttattataactctaaaggcagaaatgattgcttttattttccacaatggaggaaactgaggttcaattaagtgagtaaggaagcagggatcttaaacccagataccattgctcctctttaaaggtggaagaacagaaaacatggggcaggggaagagagaaagtttctgtcccaggacatgataatctaaaagggaaaacgtaagatccactgaaacctgaggcagatttattgtggcaataacaaagcttaagtttcacagaccttcatttgcctgagccaactttgaaggccatgtatctaattttgtttttataattctataatctttattcttgaaaagagccctccctccaaatttacaagctttgggcccccaaaatccttgaaatgcccttgaataagagatatccaggtaaatgctatgggaattcagaggaggaagcagttagtatcagttggcggagagttaggctattaagagaaggttttatataggaagtggcatttagaatgaagctttgagaactgagctgtgtatttgaacaagtaaaggtggtgttgcagaattttgctccttagttctattaaaaacccgggttcttgtcacatgatccggaaaatttaggcacacagatacattgaagcatgagtagagcaggattttattgggcaaaaaggaaaaaaagaaaactcagcaaatcgagatggagtcttgctcacagattgaatcccaggccaccacaaaggaactgaagagatcgggcttctcccctgcataaggtgcaaattccccatggctccacccacttccccttagtgtgcatgtggggctccagtccacggtgggcatgcccagacaagccttgggcaggttccctcatctgtgcaaaagcatctgatgtaaacacttgaggggtggttcggagattctctgggacccttttattttcttatctgcctaggcatttggctgtctcagtgggtgggaaagggtgctccaggcaaagggcataacatgaggcaaagggcatgcacagaaaacagtgactggttcagtcaggttgggggatgccaaaggaagtaatgggagacaagattggagcaagatagataagagattgtggattttttttcttttttatctatataaatacagagacagggtctcactatgttgcccaggctggtctcaaactcctggcctcaagtgatcctcccacctcatcctcccaaagtgctaggattacaggcatgaggcactgtgcccaacctccaattttggattttgagagctaaagcaatatagtcgaaaactcagataatccaggtagattttgctattaggtgctatttggttcctggtacagagctaaaacccttggaatttcctaagtgataagagctacaggagcatcttttgttatatgtttccccccctagttcctgaaatagctctagagaaatacaggtgaataacatcctttgttattcatatcaagcccctatcaaccataccccagtttctatttatgaagtggcttttgggaagtccctaaagacaggagtggggaaaggctggttgtcagggggatgggttgaaactttcatcttccccccttgacctccagggagggatgagtggctgaaaattgtgtaaaatcaacaatggccagtgatttaatcaaccatgcctatgtaatgaagccacccgataagccttaactggaactttttggagagcctccaggctggtgaagacattgaggtgctcagaaggtggtattccagagagagcacagaatctctgttccccttcccacattcattttgctatgcatctctcccatctggctgttcttgagaggtatccgtttataataaactggtaacctagtaagtaaactgttaccctgagttctgtgagccattctagcaaattatcaaacctaaagagttcatggatacgtgcaatttacagatgcacagtcagaagcacagatgacaatctgggcttgccattggcatttgaagtgtgttgggaggcagtcttacaggaatgagcccttatcctgtggggtctatgctaataacagacagttgtcagcattgcttggtgtcgaaaacccacattgttggtgtcagaagtattgtcagtaggatagggaaaacagtttgttttctttttttagtggtctttggtcatctttaagagcagggcttctcaaagtgtggtccttgaaccagcatcacctgtaccacgtaagaacttatgagaaatgttcattcttgggccccaacaaagaattaaaaattctgagggtgtgaacggggtctgagtttcagcacaacttcccgaccatgctgatgcattcttgcccaagcatgaaagccctcccttgtttaagaaggccattagggccgggtgtggtggctcatgcttgtaatcgagcactttgagaggacatagtgggaggatcacttgagccctggagttctagacaagcctgggcaacatggcaaaatgctgtctccacaaaaatcacaaaaattaggtgggcgtgtgttgtgtgcctataggcccagctacttaggagactgaggcaggaggatcgcttgagcccaggagattaaggctgcagcgagctgtgatggcaccactacagcctggatgacagagtgagacactgtctcaaaaaaaaaaaagaaaaagaaaaagaaaaaagaaaggaaaatgaaaaagaacgccattaggtataaaggagcaatggtaaaagaccagttgcaaaaggttagggaatgggtggttactgaaataagaagctatgtagaacactagtgttggtggcaggaagtagaaagcaagagcactgctctgtgggggatggtcatagcaaatgcaatatggaggcatttgcctctgcactgaggagaaaactatcttttccaagataggaggaaaggagataagtggaattaaagagaacctttgagcacagagttgggaaactgaaggtatttgtgttgtgctccctcaatcttttaattcaactataagctaaacccatgaaacttgagtagtttcagttatctgacttttttcttctcttttgatacagtgttggctattctgggtcttttgcctctctttatgtacttaagaatcagtttgccaatgtatgcaaaataactggctgggattttgattgtgattggcttgaatctatagatggagttgggaaggactgacatcttgacaatgttgaagcttcctattcatcattatgaaatatttctccatttgtttgattctttgatttcttttatcagaatttagttttcctcatatagtcttttaaaatattttgttatattttgttcaagtattttgtttttgaggaatgccaatgtaaatggtattgtgattttaatttcaaattccaatttttcattgctgttatataggaaaatgattttttttgcatgttagccttatatctttcaactttgctataatcaattattgatagtttcaaggattttttggtcaattattttgaatcttctacatagattatcatcatctgaacttagttttatttcttccttcccaatctgtatacctttatctccttttcttatttcattagctaggacttccagtatgatgttgaaagtagtggtgagaggggatatcttggtcttgttcttgatcttagtgggaaaacttcaagtttcttatcattaagtatgattttagctggagggtttttgtagaagttttttttttttaagttgaagaagtctccttctatttttagtttgctgatttttaaaaagaatcaggaatgggtgttaaattttgtgaaatgcttttctgcaactattgatttgagcactttatttttcttctttggcttgttgatgtgaagtacattaattgatttttgaatgctgaatcaaccttttgtacctgagattaatcccgtttggttgtggtatataattatttgtatacatgttgagttcgatttgctaatactttttgagaatttttgcattggtgttcatgaaaaaatattggtgtgtagttttttgtgacatctttatctgcttatggttttaaggtaatgctggcctcatagcatgagttagggagtatttcctctacttttacatttgagaagagattgcagagaattagtaaaattcctactttaaatattttgtggaattcaccagtgaacccatctggacctggtgctttctgttttggaaggtcattaattattttaaaatagatataggcctattcagattacctattttttctcatgcgagttttagcagattgtctttcaaggaattggtctatttcatttaggttatcaaatatgtcaacgtagagttattcatagtattcttttattatccttttaatgtgcaagggatctgtagtgatgtccccttttttgttttattgatattagcaatttgtgtcacatcttttattttgctttgttagccaggctagagatatctctatttttgatgtttttgatgaaccaactttttgttttattgattttctctgttgatttcgtgatttcaatttcatgatttttaaattatgcttacatttgatttaatttgatcttcttttgctagttatccaaggtggaagcttatattgttaagatccttttgcattcttatgcattcaatgatgtaaatttccctctaagcactgctttttctgcatctcacaaatattcatgagttgtattttcatgttcatttagtttgaaatatttttaaatttctcttgatatttctcttttgacccatgtgttacttagaagtgtgttgtttaatcaccatttttaaaaattttctagctatctttctgttattgatttctagtttaattccattgtggtctgagagcatatattgtataattttaatttttataaaatttgttaaggtgtgatttatggcccagaatgtggtctatcttggtgaatgttccatgtaagctttggaagactgtgtattctgctatatttgaatgaggtagtctatagacatcaattatgtccagttgattgatggtgctgttgaattcaactatgtccttactgattttccacctgctagatctgtccattctttgcagagggacactgaagtctccaactctagtagtgaatattctatttcttgttacagttttatcaacttctgcttcatgtcttttgatgctttgttgctagaaacatacacatgaagaattggtatgtcttttggagcatgacccatttatcctcatataatgcccctcattatttcctcgccctgatgtctgttctctctgaaagaaatatagcctctccaggtctcttttggttggtgttaaaatgacttaactttctttatcccccttacttttagtttatatgtggttttaaatttaaagtgggtttcttgtagacagcaaatagttcagagttgtttttcgatccactttgacaatctttgtcttttaattggtatatttggactattgatattttaagtgattattgatatagttagataaacatctactatatttattactgttttctgtctgttacactacttgttctttgtttatatttttattgtctactctttttctttccattgtggttttaatcgagcattttatatgtttccattttcttttcttagcatagtaattcttctttaaaaaaacattttttagtggttgcccctagagtttgcaatatacatttacaactaatctaagtccattttcaaataatactaaataatttcatgtgtagtgcaagtaccttttaataataaaacactcccagttccaccttccagtctcttgtattatagctataatttagttcacttacatatatgggtatacctaagtatatacattatcatatttatgattgaatatattgatgaaattattttgaaaaaactgttatcgttaaatcaattaagagtaagaaaaatagttctaattttattataaaatgaaataccttcatttattcattctctaatacactttctttctttatgtagatccaagtttctgacctgtataattttccttttctctcttcagcttctttgaacatttcttaccagccagacctactgacaacaattttccccaatttttgtttgtctgatagagactttatttcttcttgacttttgaagaataattccacagggcacagaactctagattggtgatttcttcccctcaaacccttaaatatttcattccactgccttcttgcttgcattgtttctgagaagttagatataattcttatctttgcctttctataggtaagatgttttttcctctggcttctatcaagattttttctttatgaacatgatatgcctttctttttgaacatgatatgcctttctttttgaacatgatatgcctttgtgtcggattttttttggcattattctgcttggttttctctgagtttcttggatatgtggtatggtatctgacactaatttggaaaaattctcagtcattattgcttcaaatatttcttctgttcttttttttcctttattctccttctggtattcccattacatgtatgttacagtttttgtagtcatcccgctgttttggatattctgtttttttcagtttttttttccttcgcatttcagtgttggaagtttctattgacatattctcaacctcagagattctttcttcagctgtgttcagtctaccaatgagtccatcaaaggcattttacatttttattacagaatttttgacctatagaatttcttttgattccatctttgaatctccatttctcttctgcttttcatctgttcttgcatgttgcctactttttccatgaaaacctttagctttttttttttttctttttgaggtggagtctcactgttgcccaggctggagtgcagtggtgtgatcttggctcactgcaacctctgcctcctgggttcaagtgattctcctcctcagcctcccaagtagctgggattacaggtgcctgccaccatgcctgagtaatttttgtatttttagtagagatggggttttatcatgttggccaggcgggtcttgaactcctaacctcaagtgatctgcccaccttagcctcccaaattgctgggattataggtgtgagccaccatgccctgcctttagcatgttaatcatagttgttttaaattcctgatctgttaattccaacatccctgtcatatctgactgtggttctgatgcttgctctgtgttttcaaatggtgtttttttttttttgccttttagtaagccttgtaattttttattgaaaggtggacatgatgtgctgggtaaaaggaactgtagtaaataggcctttagtaatgtactggtaggtgtagcagagggtgagggaagtattctgtagtcctatgattaggttttagtcttttagtgagcctgtgcgcctgcagcttggaagcacttgtgaagtgttttttcaccccttttggtgggacatagtgactagtgtgagcgggagttgagtatttcccttcccctaggtcagttaggctctgaaaaaaccctgataggttaggcatggtaaaatagtctcttttgagggcaggcattgttataagaatagaatgctctggggccaggtgcggtggctcacgcctgtaatccccgcactttgggaggctaaggcaggtggatcacctgaggtcaggagttcgagaccagcctggccaacatggtgaaaccccgtctctactaaaaatacaaaaatcagccaggtgtggtggcacacacctataatcccagctactcaggaggctgaggcaggagaactgcttgaacccagtaagtggaggttacagtgacccaagattgtgccactgcagtctagtctgggtgacagagcaagactccgtctcaaaaaaaaaagaatgctctggcatatttgaaaatggttacttttccctttttttctctgatcttcactgtgagaacctggtaagcatcctataggcaaaattcataaaagtatagaagtcggccagtgacttggacccacttggaattttcttgctctcacatcatgcacactgaatctccagcaatttttcacttacagtttaggttttcctaccctactactggttctctcagaggtttctgcttattggtttctgttttgtaagttgtgattctctgtacctaactgcctgtctcccattttggggggcagtggtttgccctgtgacctcacttctctgacagatctaagaaaagttgtttatttttcagtgtgctctgctttttacttgttacgatgaagccaaccactttcagaatttctacaaaccagatcagaatctggaagtcctgtttttttattttttttatccctttgtttagcatgttacctatcttaacacattttaaataagtgaatgcatagcttatatctacttctaggttatatgcttccttagaataggaattgattcttaaaatgtcgttctgctcacgcctgtaattccagcactttgggaggccaaggcaggcggatcacttggggtcaggagttcaagaccagcctggtcaacatggtaaaaccctgtgcctgcaaaaaatacaaaaattagctgggcatggtggtggccatctgtaatcccagctactagggaagctaaggcatgagaatcacttgaacctgggaggtggaggttgcagtgagctgagatcgcgccactgcactccagcctgggtgacaagagcaaaactccatctcataaataaataaataaataaataaataaataataaaaataaaaaaataaaataaaacaaaaattttattctgagcagtctctgaagaatataaattctactgccttgcctttagaacttataacagcatctcgcaaactatcacaagatgctccaaacatacttcttatgtgctgaattaagaagtcaactcaaatttagtatactagtaatatttttggatatcccaaaacactgccagctcagctttaggctgcccttcttgggggggaaaaaagcagttgaaatttaggacttaagtgggcatctcgtttaatttttaatggatttctatgttgttggttatggtgaagaggtgaaaagaataaatattctgtgcagaaaaattattcagtcttcatgtgaaaacactttgtccatagcaattactttatgaaaaagatgtggtattactttctttgctcttaactgagacctttaatttaaagaacctatactttacaagtttttattttcaatgcatgaaaaatgtagcagctatttcacaacctttacttttaaaatccatttttctttttaatctcaaatagttttttcttaaaaccttttgactttttatctaaattgtaatagccagagcaccttcccacaactagaatatctcatcctttttgtcttttctttttcctctcaaaatgcctactgggaacttaatttggagtcagattcttcatgataaatctggacttaatcaaaattcctcatatggtatattgtatatatcacagtactggatagtcctctgattaaatagatatttgatagtactttaaggtctatacttttggatgaacttaactgctttctccatttgtagtctcttgaaaatacagaaatttcagaaataatttataagaatatcaaggattcaaatcatatcagcacaaacacctaaatacttgtttgctttgttaaacacatatcccattttctatcttgataaacattggtgtaaagtagttgaatcattcagtgggtataagcagcatattctcaatactatgtttcattaataattaatagagatatatgaacacataaaagattcaattataatcaccttgtggatctaaatttcagttgacttgtcatcttgatttctggagaccacaaggtaatgaaaaataattacaagagtcttccatctgttgcagtattaaaatggcgagtaagacaccctgaaaggaaatgttctattcatggtacaatgcaattacagctagcaccaaattcaacactgtttaactttcaacatattattttgatttatcttgatccaacattctcagggaggaggtgcattgaagttattagaaaacactgacttagatttagggtatgtcttaaaagcttatttgcgggaagtactctagccttattcaacagatcactgagaagcctggaaaaacaaatcccggaaactaattattatgtgccagttatataaacaagaagactttgttgggtacaaaccagtgattccttgcctttgaaaaatgtgtcagatatcatgcattaccagcagttcaatgatataaggaaaccagagtaatagctaaaacctttaaagctaaaccaaagatttacaaattgcctcttcatccagtctttcccaacctaaaaactgagttctctaaaaattttagtatttttttctgaagaaaagggaacatggacatttatctaatcctcattagaaatctgactaatgataacaaggatttagacctcaagcacttcttaccaaaattcttgatatgaccttatagcaaattactttcacctgttgaactttcctttcttttattcccctgtacctcacctgcactgggcatattcaagttgcttatacaacactttactattgtgttagaaaaatcatgacacatgatgaatgtgtttgtgcaacatgagctgattcataaatgaaaatgtgcattgaaattccacaatattttaaaattaggagtttatctagcaattgaacaaaattgattaaatccattatttgttagatcagctaaattacataagttcattcatctgctcataaatccatccattcttccatctggctatcccttagtcaattcaaataaatatttatggggcactttgggtaagccaggtgctaagaattcaatgcaaaacaagatagactcccctgtccttgttgaacttatatttttggtacaaacaaaagcaataatcaagaaaaaataaaaaaagtactgattgtgattaataatatgaagaaattcaacagagtattgtacttaacatttgattgatctgattttctcagttgtctgagaacaaacatttgtgaaaatctcattgtagagttcttacgatggatagggggtcaactgtgtcattattgcttatcagcttatcccaaagacctagtttattaccagattgcaaatagtgttcaataaattattcttattaagggttgttatgtactctaaaacatttattgtggtcccttcactggttctggtttacaaacttacttttctatgatgacatagtatagaaattgagagtgaatatttagaagttcatttttattatatatttttgaagtattgatatgtagtgaattagaaatttaaaaagaaaacaaaactgtccttcactacagattgaaaagcattatactaaaagaccatttgctcagttatagtatataaaggccaaatgacttaaaaacaaattatgtaaggagaaggaaacaaccatttattcagtgccactaactgtcagccagttttttcagtggtcagttaatgactgcagtagtgttctaccttgctcaaagcaccctcctcaagttctggcatctaagctgacatcagaacacagagttggggctctctgtgggtcacctctagcacttgatctcctcatgcagtgcatggtgctctcacgtctatgctatgttcttatggtctttaggtaacaagaataattttctttcttttccttactatacattttgctttctgaaattcccttctcgccaatccaggtgaatgtcagaatgtgatttgacaactgtccaaagtactcattcactgaggagtggtaaggccttcgcccaacctgccttctctgggaatatactgctgcctgaacatatcattgtttattgccaggcttgaacttcaccaaattaatttattagggtcaacatctaaatattagaactatttcagattaatttttaagtcgtatccactttgggtactagatcaaattgcaggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaactatttttttttaatgtcactctgatttggtcacaaaggatctctagtctcattgccttagtatcattctacgaattagaatgtgttactgtgtaagagcacttcttgtatatgagagaaatagcaacagttccagtttaaagtgatataaatggaaaccaagaaatgtctttactgggaccaaatctggacagcatttactgtatttttgctggtattttctctagtctttccgggtatattcacatttaatgatcacttttctccctttgtgctaatggacactgaatccattccactaccatagttcttgctaatactactctactttttacacaaaattaaaatgccaggagcacctccaggtagactgactataaatctagactgaaaaaaaagcttgtatttcttaacagattaccttgtggaacatttgctcctttcaactaatgaggcactaaatattgtaactgctcaactggtgcttttaatttatttgtctagactttgtcatgttgccagaagctttatcctggttggagttttgaaaacagtattgtttcttcagaaagaaaaaagggattgtcagatgatctaaaaataaagaaacactggaaatacaagtatcccaaggtgatagcattaggcaagataaaaatgttgaaaagcgaaaaagaactggttgatagagaagtgttgttattcagtagaacctaagtcttgtggtcccatttttaatgaaaaatggtgaattttttggtttttattgttcttgttcacacaaatctgcccattagaataagccaagccctaaaaattaatttcagtttcactgggaatcctttagtttatctactatgtagtagagaggttttgttttattgcatgtttgacgtaggaacgtatatatgcaagacatggaggaaaaccaagtgggccagagttttgaaaattctttatcttttctttctgccaaagtgagtctcccaagtttgtcttttttttttcatttccactcttctatggtttctagcattatataaaccaaacaaaaaaaatacgttcagagattccttcagaaatgctggatgatcttgatatcgatgcttttcatatatgtgtttatgatgctggtttctggggctggctctcagtatcacaaagatgtctgtaaacagaatatgctatttcttctttgtgacaaattttgaacattatgtgaatgtccaagaaagagcaaaagagggcaaacttctcatacatttttgatgtcgaaaccaagagacgcttttattttcctaacttttctttgaaagttcaaattaagtaattttatcctgtcctaaagtttaaaaagaaaaaaaaaaggaagaaggaattaaaaatccaaagaaaattatgtttgtttgcttttctgtttttttcttccttccaactccgagactttgcaagggcatagttctgaagatctctgacactgagacattagagatctctgtatcaatggatcatttgttttcagacatatgaaacaggaactttgaacaagaaatttcccctctttttctcatagtgatcctgagacatcagctgtggaatcacaacacgtcattagttttggcaggtccttgcaggtgttttgttttgttttattaatgttcttccctcctgtagctagacagcaatcttggagaatctgccagcttggaagactattgtgtaaatttcaaggtggagcctcctttaatttgttctgtgttacctgtgagctgtgaggtcatgaagaggagacaatgaggctaatcatgagagccccattggtttaggcaattagaacaacaagatctaaaatggtttattagccttgaattgtgttaagcacataattcataaaaaacagaaaaaatatttttaaatgtatgtctaaatcttcagttacaagtttgaaaggtgacaaactattctgaggaaatgattaggcctattcttgcaacgagtctttatgatctgaaaagaatctatgtccacacataactcccacctcaaagatggggcatcttttgctctgggagatatcaaatgcgaccaaaacaagtgtttgtagatttgaatgatgattcagcagtgtagcagttctcactcattttataataattaacaacttaataattaattattaaactcctacatgcttaacattataagtatgataacttctgtggttacataaaagatatacatagcacttgtccttgatctgtcacagtgaggtcccaatccaacctatgagcttcaaatgaaaagttcaaaattacactcattgtcataagtcagagatcaaaggaagaaaggatttaaccaaaatgataaattaaatataggtgattaaatatagtcatggttcaaggcatgggccagttagggagtgtgatgtgggtaattatgaaaggccagctcccaagccctgttgttgctactcccccacatcagtcatccttcctttttttctacttctactgcagtgccttcctcatcttttcccttgcatccctccattatatgagtcatacaaattagacttttcaaagcaacattaacattgtgtgaatttggggtttttgactaatcccaacattccacccccacattccagtcccacatgggatttggagccttgtttataaacctggcacttctaatatatcttatcttagagtaatccttgtatttgtttaatttccacttagcattgtaaatacttgcaggtatcctagttaagaaagcaaggtttaaacacaaaatcatcaccaattaaagcaggctagataaagaatgtaatagaaatgctagataaaacagattttttcttactaagttttctgtcccttatagagtgcataacacaataacttgcttgataagaattcaatgtacattgttttgtgctgaatcactaaatgcttgatttctgtaacaagagattgtggttccatcagtatctggattttagtctgtgtaatcttaggcaagttatttgatttctctgtgcctctgttttcttgtctgtaaaatgagtataatggtagtaactaattcattgtgtttttgtgaggattaaatgagttaataactagtactcctccctggcacatagtaagtacaatatgctgtgctgtggtggttgttattattttttatagttccttgagcaaaagaaataatgtccccatcttagtataatattggaggtatataccatagaagtgaacaaaagaatatagtttcacaaagaaagtgataattaaggcggttcataaagggtcataaagcttgtagattttagaaatgtgggggcatgaggatgtggagagggtattccaggatgccagacagggagattatggatgagtactaagatgagaactagaaaaagctgaggggcaaaaggtcagaggaggccacaagttagggagtattaggaaaaagaagttaatacttgacaagtgccaacatggcttcacgaggaatgggttgggcctttttgagtgaggaagaggctggtgaaagggtggtggaggacactgctgctgctgatggcatggggtgtaggtggcaggagaggcagggacatgagctaggaaactctccagctatgaagtgatgagtctggagtaatataaggacagtaggggtggagtgctgaacttaagggaggagagaaaaataattggtatggaagtaggtacaatgcaattttattatttctgagcctaaaaatgtgaaatttttgattatttggtcagaccagggaagtattttcttttatgctatctctgaaaatgtatacactaaaaagttgtagtataaaaaggttgtaaagcattaagtaattttagaggaaacaataatttggatattttacatgcaatcatttatatgcaaatatatgtaaatattacaaaattattctctatttgttacaaaccttaaatatttttgactgaggaatattttattcatctaattatagctactttgttctaactaatagatattcttgaaaacaaagcaacacttttttggagacagagtcttgcactgtcacctagacttgagtgtgttaccttgaactccagggctccagtgatcctcccacctcagtctcttgggtaggtggattacaggcccacactaccatgcccagctgtattagtccatcctttcattgctataaagaaataccggaaactgggtaatttataaagaaaataaatgtaactggctcacggttcttcaggctgtacgggaagcatagcagcatctgcttctgaggaggcctcaggaagttttcaatcatggtggaaggcaaataagaagcaggcatgttacacgacgaatcaggagcaagacaaagtgagggaggaggtgccacacactttgaaatgagcagatctcatgagaacagcgccaagaggatggtgctataccgttcatgagaaatccacccccatgatccagttacctcccaccaggccccgcctccaacactgggaattacaattcaacatgagatttgggcagagacacagatccaaaccataccaccagctaataccaaaaaaaaaaaaaaattttttttttaagacatggtcttactatgttctacaggctggtcttaaactcctggcctcaagtgatcctcccaccttggcctcccaaagcactgggaattcagacatgagtaacagtgcctggccaatacttatttttaaacattctctaccataaacttaggatcttgatttgttcacattgaacagatttttattatacagattgaatttataagaaaatgttgcagacattgtcaaaaagggacgtccaaaccactgtgatatttataagcatttgggccacattttgatagaactatacacggagtgtgtgtgtgtgtgtgtgtgtatatatatatacacacacacattatttatatatatgtatatatgtatatatatatatgtatttatatatatatgtgtatatgtatgtacacattatttacctacctactgtgtgagtgtgtgcatatatacacgcacacacacacacacaaatatatatatttcccttctgagacaaagccaaacagcactgtatgcttaaagaaaaacagtcacacttcccacttatgtaatttatattacatccagtcaccacaccagccaaactgctttattgttttttgtttgacatccaatgctaaagcataatgcctgttgcagtgaaatatacatgagcaaccctgagaactcaatatagcctcacgtgttgccactgagttgagttgaggagtcaagctgtagcaaaaaggtttgtcaccgggtgagtaatggtgctcttatttttctctgggtctcaagaagtgctctttatgacatatatggcattaaataaatatcagatatttgcacatcctaactttcctattggtgaagtttcttaaaagagagataaagggccattgtgtgattgatagtttcaggtatatttttgctgcacagtcagtccgagtgtaccacgtagggcaaaccacgtaacttctcagggccttgactgtttcatttgtaaaccagagaaaaggacttgggtgacctccaaagacctttcaaatttggagatgagtttgtggaaagttcaaacagtttagaaaacagaactaagacacccactggcacccctggaagcaagagagtgccaggtactatttgtaatacaggaatgaaatacctaattgtatgaaattgaattctaactgaaccagtttgttcagttaaattttttttttcaattagagtgcttacttcagtatctaacactagacagtaaactgtagacaaaagacctacagaatttctgaatggtatcaaattcaccacacttaaaactttgggatgtctaatttcaaccaacagctttctttcttcataatgttgaatatatgtgtatctattttagctaaatttaatatatatcaatatactttgatagatattttatataaactattagactatagtattatgagtaaaagacccaccatttcccaagcaattataaagaacgatcaaaattttaatgggttgttagtattatttctttaaagattgtgatactgataaatatttggccacattttaatagaattatacatgggatgtgtgtgtgtgtgtgtgtgtgtgtatatgtgtgtgtgtatatatatatggcagtagagatatatatatctacacacatctagatatatatatacatgtatatctatatatacacacatatatctgtgtgtatatatacatatgtatatatacctacatacatatgtacatatacatacatgcatatatctgtacatatatatatagtgtgtgtgtgtgtatatatatatatatatatatattttttttttcctgagccaaaacaaaatactaggttgtaatagctgttctttcagaaggaagaaaaacaacatgtgctgaactctgagtttgatgtttttgtattttacttcctattttcatatcagtccatttatttattcaggaagaatttattgagcatatattatgaacacagcttttgctaaggacagggtatgcagcagttatggcctagtaggagatatggatgttaaaaacaaaatgctcacaaatgcacatataatcttaatactcattgtaagctatgaaagcagagtgtgagtattatgagaccatatgttgggagattttatttggtattgaggatcaggaaagatacccctgaggaagtgatatttaatttgaaacctaaagaaagcagttggccatgggaagaaggtagggaatgagattcccaagcaataggaatccaatgtgtgaagaagctgagggagtgaaagaaagctagtgtggtggcaggaagaaagagaagagaatggagaagggcactaaatgagtcagagaagtaggaggggctaaaccatgtagggtcgtgtaggccatcttaaaggcctgagtgtagtggaaaacctttgaaggtttgttaaaaggtcaatgaaatgttctaatttctgttgtagtgaattgctttgattgctgaatgcgaatggatgggtagagatgcaagagtgaaagggaagaaatcaattaggaggctcttgccctgctccagataggactgataattaattttatttgggaagatcagggagaaagataagtcatgaatgactcccaagtttctggattgaagaaatgaaggtaccatacactgagatgggaaagcctaggggtagagtagctttgagaagaaaggtagcatttccccatttcataaaacatggaagaacaaagaggctggattcctgtttgtagacataccttccaggccagaactgcattactacaacatctttgcaagccacattgcctttcataactctgtgtcagtgttgatgccgtaacatctttggccttccccctaccatcctcccgcagtcctccatgataatgccattattccgtttcaaattgtgtgcttccattggatgtgtgagtctccttgaaagttataatgaggctgtagcccatatgaaatgcttcaactcaggtcctgcataggaagaggaagctaatctctccaggaactgagcctgtggctagagggatggataattgtttaaataaagaatatgctgctgagtactgatgggctctttatgtacccatttggctgctgctgcccaacctttaatctttcctgagctttaaataggaaggaaaaaatggtccacaaaggatttgagccattttgctgtggtgatgaggagcacgggtttagagacaaacactcctgtgtttgaattccagctcctactatctcctagctaagtgaccttggacaagtcacttaccttctccaacctgctgtttcttcatgtacgtaataggatttacctcatgaggttgacatgaagattgaaagaggtaacatatagaatgagcctgtcccaggacatggttcatgataagtctgccataaatgggagctatgtgtcccacccttttggaggagataactgttctgtagcaggtaatatattgtttgatacttggttaacccttacaattatcatttcctgttcttctcaataatgctagaaaccttttatttaaagaaccacaatataaaatgaaaaatatataaaaaaagcaaatggaaaaattctattggcaaggctttttaactttatatactaaataaatccaattgcttaaataatgaactgactcaagttctcagcactgcttcttgtttaattctctttagtttttcagaattctccaataatgacctttgtctactctcttcagtttattcagaaattacttttatttacatagaagtttggaagtggatacacaaacatatccctcacatatcttatgatcctatgagtcatatactcatctcttatattccctctgtaaagcaatgtaggtacctttcaggaaggtgatttttatgtaggttgagaaatatcagcatggaggtcctagctgacctctctagagagtttctgagacatttgacaacaactttttctttaagtcatcagttatgccccggggtatgaaatttctaacatgatcctcagtaaacttggctgccttgctgaggatactctccatctgcctgagagacacagacaccattaattgggaattgacttgacttgtgtggttccttgtggaccagatggccactaaatattctcatttcaaggcaattggtaaaaactacacttcaagaaatttcattcttaattccccttagtggatgttattaaccaaaggcaaaagaaaaaaagggtaaaaaaaatattctaaatgttaatatcaaaaatattattttcaattcaccccaggcacagagaactaagtattattattgctattgcaccggcattccccaatgagacagtgattttcttttaagacatttttaaataatataggcagaattaagtagacggtgatctggtaagtagatgtttcagggtaacagctgtgcaatgctccatgcagggaattagattgtcattttattccttaccaggaacatacattcagttaaacaattatttgacttctgctcttccactgatttctaagttgaggctctctcttgtgcctgtctgatcagataagtagagttgtgccttggtttatagatgagataaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaagtcaaagatcaaggtgccagcaggtttgctgtctcgtgagagcatacttcctggttcattgatggtgctttcttgctgtgtcctcacataatggaaagggcaagacctctctggtgtctcttttacaatggcactaatcccatcatgagggctttgttctcatgacctaatcacctcccacatgtcctacattctaatactatcaccttgggggttaggattttaacatatgaatttgaggaggtggcgggggggacacaaatatttagaccatagcatttcactcctgacctccaaagttcatgtcttcttcacatgcaaaatacattcattccatcccaatagcccccaaagtcttaacttgttccagcatcaacttacaaggctaaagtccaaggtttcatctaaatatcagctaaatcagcacaaacagctaaatcaggtagagtgggacttaaggtgtgattcctctttaggcagattgctctccaactatgaaattgtgaaatcaaacctattatgtactttcaaaataaaatggtgaaacaggcacaggctagacagtcccatttcaaaaaagagaaatagaaaagaaaaaaggagtgacaggtctctataagtctaaaactttaaggcttgagaataatttgctttgctttgcctccaggctcactggggtggtgtcttacctctggacacactggggtggaggctctatcctcatggatttgagtgtctcattctttgtggcaggtctgtgctccaatcccacacctatggctccctgagtgtgcaattgcatgcctggtggttctactggtctgggattgcataggtggcccagccttcatagctccactgggcattgccctaatgtgggctctatgtggtgacctcacccctgggcctctacctgggccctgtgactccctgggttcttgaaatctaggtggaggcagccatccccctacagttgtgctgagtgtagtgcatgagtgctggggtctgctagagctatacctagggtggtggagatgtatggcaatggagtatggggagctgatatggtttgggtgtgtccccacccaaatcttgtcttgaattataatttccataatctccatgtgttgagggagggacctggtgagaggtgactggatcatgggcatggttttcccatgctgttcatgtgatagtgagtgagttctcacgagatccaatggtttcataaggcagttttccctgctcttgcaccctctttcttgcctgtcaccatgtaagacataactctttcccttccgccatgattgtaagtttcctgaggccttcccagccatgtggaactgtgagtcaattaaacctcttttctttataaattacccagtctctttacagcaatgtgaaaatgtgctaatacaggagcaaagactgcagtgtgaggtggcaatgtgaagtctgcaatgtgaggtggcacggggcagttgtagcccctcctttgaaatctttcttccctaccccaggcctctgcactctgaactatgatgggaaaggcagcttggaagatctccaaatggctttggagtcattcttccattgtcttggactataaattctggcttctgtttaggtggctgactaatatccccactgtctgaatgcatagcacctagtttctgttgagatggctagtccatagtaatttacttatcaaatttggccacaccctttgtattctctcctgagcaggctttctcatctttcacaatatggataggctgagaattttccaaattttgaagttctgcttcccttttgatcaataattccattttaaagtcatttctcatcttgaattttactatgagcagtcaagagtaactaagctgctccttcaactttgcttggatatttcctcagtcaaacattcaatttcattgctttcaagttctgccttccacaaaacactaggacacaaacagctcagccaagttctttgacattttataagaaggatagcttttcctccattgtccaataacatgttcctcatttccatctgaaaacccatcagattggcctttaccgtccatatttctgggaacattctgctcatgaccacttaggtattcggtaagaagatagtagctttctctatagctctcctcctctctggagccctcaccagaatggcctttaattgtccattcacagcaatgtaggctttttctagcatgtacctgaaaactcttccagcctctactcattaccttgttccaaagctgcttccacattgagtatttgttacagcagtacccagatcccagtaccaatattctgtcttagtccattggggctactacacgatgtcttataaacaacagtaaaatttatttttcacagttgtggaggctgggaagttcaaaatctggtgccagcagattttgtgtctggtgaaggccttcttcctcacagatggctgtgttctcactgtgttgttacatggcagaagagtgggcaggctagctctctgggatgtcttttataagggcagtaatccaaatcatgggtttagggtagagccctcatgacctaaatcacctcccaaaggccccacctcctaataccagcatctttgaagttaggatttcaacatatgactttggcagggggacagaagctttcagtttatagcaaaccctataggtagcactactttgtcctttcctaatcaatttgcgtcaatgaaacatgaattagaagagacctaggcgactccactatactgggattattcccagtataaattatcatctctccacaccttctcatctactccctatctgagttctgaagctctccactacaagaaggaggctttggtttgacttgatatacttctctgggaaacaggtttagcataaaacagtgatgctcattctagaacacctgcaaatgacaatagttttctttcgaagtcgccaggaatcgtctgcctttgggtatgtggctgtgagcactgccgggcaaaatgccatatgacctagatgaggcatatgccatcctttgaagccattaggacattatataggaaatatattaactaaaatggaataaaattttctaaataacaccttatgtttatccaacaggtggttcattatacttgagagcattatacagaggaatttgatggggaggagagctggagaaattctcgaaattctgggtttctttaacagaatactctagctataaacttataattttaaaaaataagcattatattaaagaaaagggaacataaattattttgttttattaaacttaagtccaaaggtctggattgtggcagaataggatcaggggacctaaaatgttgagcctcaaaggtcttcttagagaacaactgtattccactattagcgcttttggtccttttagcccaatttctgtttatcccaaatgttcttcccttttctgccttccttcacagtggaccctgccaggagctttgaaatgcctgtgagtgttaaacacttacccattgagtgcccaaccttaacatgcccctaataaaatgtacttagattaaccgttttcattatcaaagtttccttattacccaacaaacacaggcgctttaaagaaaacattaactaaattgcaagtgacacattttaagatctttgatatgacttcagagaatgcactataggaacacaatgcaatgggagggaaacttgggagggaagacattagcctttataaaatctgcaagtattgccaaatcaaaataaaatttacaggaaagcaggatcataaatataatctaaaatcttagaacctgtggttatgattttaaatactaatacaatgcaaaatttttacctgtttaggtttttatttcatcagttcatatttaggtatatacttttactgttctccttttttataatttaccattcacaaagatgatgatgttagtctaactttaatgtcatgagtgctttgagtagtagtgctaagtttttgttgagtagtagtgtgcttttttgattagtagtgataggtttttgatgagtaagcctgctagcagcatacaaacaaacaagcaagtatcagcctagagaagcagaaaaggcatttgggtttcaaagtcacaaggcctaggctttagtctaatacagctgataatacaatttgtccaaacaggacatttttgggtgtgtcaaacactaaactggacaggacattatgacaaaagtgcaaagcaggactttccggggcaaaccaggatgtatgtcatctcactgagtcctctctttgtccttgccatgactagtatctctagaggtaaatgaacagagtaatgacaaatagccagacacctgaatcttatcccaacagcacctcctacataattccccattatcccaaatggaaattaaaaatatatacagtgataattccaggccaagaaatgctttatttctagcttggacttggcttccatgtccagtgtagaatcttatccttgctgatctggactgtatctcatgaagccatgacttgtacctagttactagctggaaggcttagaacaaaagctggtccagagagcctcctttttccttatttcctgggtccacacctttaccatggcagtctgcctatcatttgatggaggaatttaaagcaagtccaagggaagggaagagagtttctaaaatctagaacttggatagtttaatttacctatcccaaaacagcttaggcccagacagcttctctccaagattggtgccaaactgaaattaccagctgtgtagaccaaagagaatttcaaaagaaactgaatcccaagagaaaaaaaaaagacttctggcattgtggcccaataaattggtaggattgttgtgacttttcaagtttacatgtaaaatgggcccagcgcagtgcctggcaaatatgggtactaagtaaaagtaactataatcatgtttttttaatctggacttcacttggtcatcctttaaatggtgtctgacagaatcctagttcttgtctcactttacttagtttccctgggaaatttcatgtgtccttttggctttaattaatatctctattttgatgacctccattatctgcctattcccagagctttccacctgatatctcagcacatgaaaagcaccttatgtcaataagtgagttccttccctgccccaccacatacctgtcctgtgttcctaattccactgaatggcatcccatcctccagtttcccaaggccaagacctgggactcatctttcactctcaagttcctccacgggtacccacatgtcacatcctgtcaatgctgtccctggggagtatctgaaatatattcacttttcttcatttccacctgacaccactattaacacttgcacaaatttctgaggttcctggctcatttccctcattgacccccaatagttcattctgctctttgcagctctggtgatctttccaaaccccacatctgatcacttgtttcttcccttcatatggctccttaatgccttctggactaagtccacactgcttaaggtggcttaccaggtccttcatgattttgtctttgtttggctttctacactcactgcccaacttccccttacttcccatgattcagttatactgaatttctttggttctctaaagcacatgtgctttctgttctgcagaggcttttttgttcacttgctattctctacctgggaaactcccccagcccttcactgcctccttctaccatctttcaggcctctccttacacatcacttctttccaaaaatctgccttgacactccaggtctcggtttcctaggtgtaccctataactccacccctttcatagcatttctcactctggctggagatttaccttttaacttgtccatgtcccccactggagtggaagttcctggaggtcagggattatatcctattaattgttgtatttccagtgcctagagtagtcttgcatacatggatggtattcaataaatattggttgaatgaataaggagttctttcatttcatatgtaatagatcatggaaatagccttgtgattgatacacagcaggtattaccatcctcactttagaatgaggactcagagccttgagatgtctgagggccttgactgggacagctggcagatgcaggagcagagctgcatcacccctgtgggctatctcagggttgtctgtaatctaagtacaatgtctgttgattttggactgaaggctttttgggtaattgtttgctttttcaatacttataaaatagtttccatccttactcattgatagtaaggttagttattttagaaaacaagctaaatagcagaaatagtggccttttaagttgaaaatttaccctgaaaaatctacagagtagcaaacagagtatcaaaaggagttgactgtatctatttttataactgccacttatggattattcagtaaaaccacaattcacttttatgattttttttcatgtttctctgtcacaagagcaaactcttgctccataataacattccagaatacagcaatagcaaaagtcaacattttgaatcctttacaaactcttagacatttttttttttttagtttaacatgttacaaaacaaaatttcttcttttttcacagcagtttgggaagtacatactatttattagctcatcagcatgaagctggaaaattctttttcctaaagttctttatatctacaaactgttgatgttttcatttatttatttttaatgctacgttgtaatgaaaatcattggaaaactttagattctagtaattttgaagtcttcttagtttggacaggactgagctaaagtttgtactttttttaatttattgaaaaatggtttctaatgatagtattaacaagattatattgggggcaggacgcagtggctcacacttgtaatcctagcactttgggaggccgaggcggttggatcacctgaggtcaggagttcaagaccagcctggccaacatgtagaaatcccctctccactaaaatacaaaaattagctgggcatggtggcaggcactgtaatcccagctacttgggaggctgaggcaggagaattgtttgaacctgggagtcggaggttgcagtgagcccagatcgcaccactgcactccagcctgggcaatagagcaagattctgtctcaaaaaggaagaaagaaagattatattggggatatatatgtgtgtgtgtgtgtgtgtgtgtatatacacacacatatatatatacatatatacatatatatacatatttaaaggataaaggattctgctgccacagatcactaaatcagatgatctctagcaatttcctgtttgtttgttttttgcccatagtgcttatctctttgaacagtaattttccacttactatttttctccccttttggaccataatttcctttaaggcagagcctcctgttactcatctttgaatctggggtctgtcagagtacctagaatttaataaactctcattaagagccagttgaaagaatatatgactaagcagtcatttacatccaaaagatccgtaggagaattcttatcagcacatgtgattggtaacaataactttgtacttttcaaaaacaattactaatctatcttgctttccattatctcaccaaaacctattagcatgtctggcagaaaatagatacttaataaatttcttaaatgtttactgacttcaattttaagttttattaactatgttgacttttctctaatgaagatgattctaaaaagctttttactatacttcacagtgaataaaacagtgagataggaatattgcaaaatgtcccctgtgttggtcagtcttagtgtcattcattttaaaaattctgttctctaaatattgacagttatatataaatttatgtaattgtttacttctaataaagaatttcatctggggaaaaacatactttgctcagctctttgccacaagtgcaaagtctaagacagtcaaatagctttcctagtacggccttaggaacttagtatatgactggtgtgaatctagagggagcatactgcattctgaccaaaatctccaccctgttactatggccatcactaacttcgcagtattgcagtacttcctgctagcttagttcccaaggcaacttgtgaaggaaaatttttacaaagctgttgtcacacaaaggtagtgtttcagttcctgagcccatgtccttggagttgcccaggctccaataatactaataattactgtacattaggtacttaccatgtgccatattctgtgggagccgctttccacaaattatctctggtaatccttgtaacaaccctttgacatcaatattattattttctccatttttttacatatgagataaatgagacttaaaataatgtgcctgatatcatcagcaaatgagctgaggagggcagattcaaagctgattgtgtttgactctagagctgcagtcttaagccagaccttttcttgctggttaattttactgaaaaaaaaaaaaaaaaaaaaaaaccctcaaatactgctgattgatctaaagtactaacatttctatcagtgttagggaaattttaattttataatttgattttgtgagaaatttatagcatcttgaatactcacatgcaaagtgatatgtcttagataacattttacaatggcagagcttaagccagtgctcagtcattcattcatcctcaagttttgattcatttatcattcatcaaaactctgttttgtttggccacccacattctaggagctcagtacatatttgataaatgaatgaattgttgaggttgacagttacccaggactggcattaggaacacagagctgaagagcacgtttttaccctcaagaagcttacagtctaacgagggaacttgcacaaatactactatcactaggtgcctggttgaatggcttaagagatgatcagggatattcagaaggatatgtcaggctcagcaatggcatcacttgagagcatcaaggtgtttagggaactacaagatgtttggttctgctgggaataagagtgaagggggctccatttggatgcctcatacaccaggtgagagatcttagattttattccaccaggaggagaactaccataggatttaaaacagaaatgatatggtcaaacctacatcttaggaagatccctggggtgtttgtatggtggacttgcaatttgactaattgagatttgtaggatgattcttaagagatgatgatgacccagactgggatcactataatagagttggtaaggaggagaatgatttaaaaagtagttggaagaattctagggatggagataaacatttgaaaattattaacttataggtggtcatcaataccctgaaaatgactgggatctcagaggagagtctggagagttggaaatgacaaagactaatattcaagggggcaggaagagggagagttgttcacacatgacaataggaagaaatggccatagagtgtgtggtttctctcaagccaaggaatagatgttttaagaaaggaaaattcttgtggtgggaagcagtagagatgacagatacacattaatttcttgagatttctagatgactaaatgggcagatgttgaatgatagctaaaggagaacccagaaacaagggagggattttgtttttgttttttaaaaaagatagaccatagcagcttcatagactgaaacaataaaaaagttgaaggcacaaagaaagacacaggtcctctaactccctgcccagtgccctttattcatattctcagcacttgtatttctaagttttatgtttgagtcttcggggatacatcagagtagtcccccttgtctaataaatgtgtttacatttcctgccataccagaaacccttctcaaactttaatgaatttctacaaggtgagattactttaatgagaaaccaaccaaggaaaggagtatcatctgcaatatactttcaaatgttttttgcttgtttgtttcttgtccagctaaaaaaaaaaaaaaaaaacaagccattggtcctaacacaactttcatattctaccccaatatcaaagaggcttaaaatctcctggtcgtgtgatgggcacacagttaattttttgtgaacaaacacagtgttatgggccatttctgaatttatctctgaaatcataagattctttctgagccattatctcattctatattacagtcaggtggagcccatcttacctcctcatactaaattctagacttctcaagggcaggagacaatcatctgtatatctctttggccttcatacactcaggagtacttgccaaaaataaacatttaatgcacatttatttgaataattgataagatccaatacttcaataactttgtcatatttttatagaatgggtttctatatctcatttgcattttcaaactttacttttactgtctagctttaaaaaaaaagcctttgactctaatacagccctcatattctaccccaatatctaagaggctttatatctcctagtgttgtaccactattttaactccagtattttttacttcatagttttacctatttgttacagttagtttttatgaattcaagagatgaatagcaattttccatatgtaatttaaaaaaccccacagttgactattttatgctatcttttgtcctcagtcatgacagagtagaagatgggaggtagcaccaaggatgatgtcatacctccatcctttatgctacattctatcttctgtctacataagatgtcatactagagggcatatctgcaatgtatacatattatcttttccagcatgcattcagttgtgttggaataatttatgtacacctttataaacgctgagcctcacaagagccatgtgccacgtattgttttcttactactttttgggatacctggcacgtaatagacactcattgaaagtttcctaatgaatgaagtacaaagataaaacaagttatagactgattcttttgagctgtcaaggttgtaaatagacttttgctcaatcaattcaaatggtggcaggtagtgggggtagagggattggtatgaaaaacataagctttcagaactcctgtgtttatttttagaatgtcaactgcttgagtgtttttaactctgtggtatctgaactatcttctctaactgcaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtgtgagtttcagatgttctgttacttaatagcacagtgggaacagaatcattatgcctgcttcatggtgacacatatttctattaggctgtcatgtctgcgtgtgggggtctcccccaagatatgaaataattgcccagtggaaatgagcataaatgcatatttccttgctaagagtcttgtgttttcttccgaagatagtttttagtttcatacaaactcttcccccttgtcaacacatgatgaagcttttaaatacatgggcctaatctgatccttatgatttgcctttgtatcccatttataccataagcatgtttatagccccaaataaagaagtactggtgattctacataatgaaaaatgtactcatttattaaagtttctttgaaatatttgtcctgtttatttatggatacttagagtctaccccatggttgaaaagctgattgtggctaacgctatatcaacattatgtgaaaagaacttaaagaaataagtaatttaaagagataatagaacaatagacatattatcaaggtaaatacagatcattactgttctgtgatattatgtgtggtattttctttcttttctagaacataccaaataattagaagaactctaaaacaagcatttgctgattgcacagtaattctctgtgaacacaggatagaagcaatgctggaatgccaacaatttttggtgagtctttataactttacttaagatctcattgcccttgtaattcttgataacaatctcacatgtgatagttcctgcaaattgcaacaatgtacaagttcttttcaaaaatatgtatcatacagccatccagctttactcaaaatagctgcacaagtttttcactttgatctgagccatgtggtgaggttgaaatatagtaaatctaaaatggcagcatattactaagttatgtttataaataggatatatatactttttgagccctttatttggggaccaagtcatacaaaatactctactgtttaagattttaaaaaaggtccctgtgattctttcaataactaaatgtcccatggatgtggtctgggacaggcctagttgtcttacagtctgatttatggtattaatgacaaagttgagaggcacatttcatttttctagccatgatttgggttcaggtagtacctttctcaaccaccttctcactgttcttaaaaaaactgtcacatggccaggcacagtggcttacatctgtaatcccaatactttgggaggctgaggtggggggattacttgaggccaggaattcaagaccagcccaggcaacatagtgaggccccatctgtctttattaaaacaaaacaaaactgtcacagcttctttcaagtgatgtttacaaattccctatggtttagtcacaaggaagttctgaggatgatgtatcacgtcatttctgttcaggcttttgagcctcctggaggtaaatggtttccttactgaaggcttgttattaccatgattatcactaagcttgaagtaacaaattaggggggcagactcacaacctcttgccctgccatggacaagttcaagaatctaagtaaagtcctctattgtctgatcttggatttgctcaacctgaacaagccaaggaggtgtattaaactcaggcacatcctgaccaatttggaattcttaagcttcagatcactgtggaagaggctcaactctttatggtgctgtagacttacgctcattttctaggtaatttataagggacctaatattttgttttcaaagcaacttcagttctactaaacctccctgaagaatcttccagctgctgagtagaaaatcacaactaatttcacagatggtagaacctccttagagcaaaaggacacagcagttaaatgtgacatacctgattgttcaaaatgcaaggctctggacattgcattctttgacttttattttcctttgagcctgtgccagtttctgtccctgctctggtctgacctgccttctgtcccagatctcactaacagccatttccctaggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaa

SEQ ID NO: 2442 - DNA, 48913 bp, Homo sapiens
  source 1..48913: mol_type = genomic DNA
ctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctgttgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggacaaaagccaagaggaggacagttcgctacacagcaatgcatcgaggtatgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaattgttgctcccttgagtgtatcatttgcataggtctcacatgggttttggctctcttatgcaaggtttgtggttaacatcattgatcagactgtgctttctaattctaaaaaattgagcagtgttggtattctttcagtatttttactctcacctggaaaactacctggaagttgtcaggcatttgcttactggtagtggaggttacagctgtacatgaagcatgtactgactgtacttttaaattggtttgtcaagtatactttgaatcatatacctgatggatgtccaaaaatatttaagactctttgaaaagaagatagttacttttaaattagttaccctaaatttcatatcttaatacatgtacataattatgacatcacttccttttaaaatgtgcagctgtagaatgttagtggtgttttaatgtggtagattaatattacttctactgagctgaactgtccctgtaattagtacttggttccttctgccatcagagtttttattgcccaaagtatagtgtttagggaatactacgaaaatcacctttgcagcctgagccacagaagaggaaatgagtttgcaggtcaagtaaactttggtctgagaattactttagtatctggaaagaatgagtgcaagtttaggtaaatctggtaataccctgtttttggaaatagtgcagtagttaatagtggttatataagtttgtattttaatttgaagttaatgctaaagtctgttatactttatcacgatttttgaaaattaaaaactttaaaaaacgcgattttaaaaacatttgattgatatttgtaaaatttctaagtatttaaaacaaagttctaatgatggacatacgagaagtataccatactttttatctgaataatttgcagcttggggataacttaagtaacatcaaagaatgaaaacgggactgtgtgcacacaaagagttcagtgtgttctccacggcaccacgttagcaatttatcttaagaattgaacgagtttattaaatttatctccaaatcgtctgcctttgagccagatttatttttataacctgaggtgcgggtaaatcctacaattttcaggggcgctttaccagatattctaaaaggctggggatgattagaaatggcataatgcagttacttgtgtactagaacaggcagtttaactggcagccattttatgacgctgataatacattaaaaaacgggattttggagaagactgaatctaaactaatagaaatctgaaataccaaagcctatttccttccccctctctgctcttctggggaactctggtgccgacataaaaggcagttcgatagggcacgcagcagctctttgagcccctggcatcttgatgcaggtccagctcagtcacaaaatggctgttcctttgtgccgcagcgctgacagacatactgcattgcactgtgtactcgccaaacagcaggaagttgccgtgccgagttcaaaggccggccggcgccggcgcggggtgctgattggctgtgcgcgcgcctggtaacagcagggtcaacggcggcgccttcggcagcctccgccccgtgacgtcagacggctcccctggggggcggggagagaacgcagtgacgtctggccgcgtgcgcatgtcgggcgctttctcctccccctacccagggagccgcacgccgaggggaaaaggaagggaactctagttgggactttccggtgggcggcttctttcctggacgcgtttgctcctggcagtcttgtccgcccttgcctgtagcggtccgcaccctgtagtgtgttcttttgcccatttccgggaatggtttatcctctttgagaagcggctgcttttggagaaaaagtgcaggcactatttataaattttaaaggcactatttggaaatcttaaaatagaaaatttgcccagttttacattttcccttttcataccttagcgtcccttctccccgcccccgttcagtgtgaagagatgagtgggtttaattttgttacaattgaccaaaacgtttgagtgtcagaggcggatacttttattttagtgaaaacctcttgacgggtgttaacagctgtttaatacatggctcataaacaaagggaagattatttgaacttgtccccatgcgtttttacttggtaccgtacattttctcagttggcatttgatggagaaaaactcaggtcagtatgtgctaagtactatatatttaagattcacagtgggatagtttagtagaaaatagaaaatttcacgttcaataacattaaaaagtggcagaatacagcgttaggcaaccattactatgtaagtaaatgtcagaaaactactcttttaagtgttaatagcacttgctaatgcagggtgactgacagcttggctgatagtggggtcacttggccaaatcttcgcaattatcttccctaggcctccatttcgggaattctgagtcccggtaaacggttgggtttatgctcactgatttgccttgtttggaaacctttacaaggatttctggttaaaacttcatcgttcagcaacgatgtcttaataattaaattacacatactgaatttaagcaagcaagaaattcagtggatttatctactgtggacaaagtttttttcctgccatactagagtttttttagcagttggagtaggctgtcctgtagttagccatagtttagagttattttagtaaagtgtgttacttcaaaggagatgttgacccttcagtgcaggtgatatttgcttgggcgtatgtcaagtttctgaatacagtctgtgaaagttagaattcactatgatagtgagttttgtaggttctcataatctaggttctttgggaagaattatttggatagtttgtgaaaactagctgaaattgctttttctgttacagagaagtgttcatcaaataatttgtacctgattttaaaattatatgctcaaatgtatattgcgtataaaatgctaacagagaattaagtgtttatagaacttgatgaacgtttaactgtagcttccaacttaaagtatacctgccacaagaacgaaagtaataatctcacctccctttttgtgtagagactgaattctaattagttgtgttaatagtatttgctgaatacctttcaattcctaaaactggggtcaaagtagtcaacattgcagttaattatttttgaagaggatatgaactattctgttatttaagatattttaacctaaataccattatgagttaaaatgcataccatgatataacaatttacctattaactgttgacaatcttgcagccaattaagttttttatagaaccagtgttcttaggtatgtttgttgagccttctactttttttccctttgatgtggggaatagcatcaagcagcaagaaaagagtgttgatcgatttctctctctttctctctctctctctgtatccttgccgtttaaaatatgcactttccaactagtatttggccgttagggagttagtatctttgtaaagattaagtcagcagaggaaggtgggcaaataatatttttgataaagacttttggttgtgacagttgtagcaagttattgcttgaggagtgaatctggaagtttatttgaattttaactaaaactcacagattttatcattagtttactctcccttacccccaaataaaacaactgacagttatgagagacctcctgagaccacctggtatttccaaactcctatcatttctcccataaaatttgatacactaagtttgtttctggtataaaaattgagtgactgctctgtgtcagccattaaattttttcttgctatgagccatcttttttttttttttttttttaagatcctttagtttttagctgcttcttggtaaccttagaactttgcttccttgaagaacttggctttcttgatatggtgtcacttgaacaaagaaacttaaaaaaaaattcctctaagagtattttgtgtacaggtgaaagtaactttgtggcttggttacactgggtgtgtcacagctgagtaactccctcctgcacttcagcttgactaagcgttgagttcacatgtatacctttgcaaagctgccattcacaacttgttttggaactttagggttatcagtataaagcctgagtaacaaaacttagtcatccaatgtccaggctggattgtatttttattttgtgatcagtaattcagcacaatgctggaacacattactcacatttgtcttatgacccttttctgtaatcaatggaatctttaattgataaagcaagtctagggggagagacattttttaaaaaaagctcctatatactgaatatatttgagccctgattatgaagtgagggacaaggcttttctttttgaaataaatgatggaggacatagatatgtggtagccattcatgctacataatttagcattttattgttaatatgtttggttatgggtcttcttgtttggtatttcaacatgttctggactggatatcatactgaaaagtatttcagttctcattactgagtccctgtagtttggggaaaatgtgatcactgatcttgaaggagagaatgtttcagaagcatccggctaaggcaggattgtagagatagtcttgattttatactttggatttaattctgatgagtcattttgtcacttgtgtatgcttaactgttacctctgtgcctggcaagagctaggtatgagttcagcttttactttagtcctgaaaatttttgttcccagtttaggccagtgaagaagcacttatgattggacttgtaattttctcattttaaaaatgtagataatggtcatcttcattgggtcatgaagattaaataatatagtgcccataaaatgcttagcaaagagcccatcacattaaaagtgctcaataaatgtaagcttttagtaaggttattttattcttactgtttgtttcatcttactttcttgcacccctccttcatatcctaagttcttcttcaggagctaggttggccctgaggaactcgctggttgtcttggcctaccaggagagtttgtttaggccagttacaggagagatttgtgagaatgattttaggaggcaagtcctcatttagtcagcttgggtgcgttttacagttcatcctctcttagaattttttttttttttttttttttttgagaagagccagccttttgagagagcatatgactcttcctggactacaacagcttcttgtgtgaatcacagcccggcttttgccagttagtctgagtagataactacccacccccactcccccaagctgataattattaccctggtttatcctctgtctcatttcccctctcaagctgttagagaatgaatactgaatactgtggtgcactgctccatggatataaatgtaacagcagtaatatttacaaccaatgtctaattggctgtagcttgctttcagtgttcagtctaaaccataggactatatatttgtcttagcataatgccgaacatgcaagtctgcttaaactatagtcttaagatttgtgtgttttgggtttcctctacttcctctatttcctgtcttttttgggttataggtcagatgggttctactttttattcccatttcagactgtggagagcttctaaaaataccagtgtccatccctgcccctaggatctagttaatttttaaaagctctctgtgtttcaaatttgcatgtgtttctgtatgtttgcagtatctccgtgtgttttcaaatcttctgatggagcacttcgtgtactttaacccttggtctttccattgcctgtcccatttttaaattccctttttagtcttaatagctgcttgagttaggacctctggaagcaaaagtgggataggatgctgacggggaattgtaggcttgatggaagaggatgtttctatattaaatgtcatggcagatccagttctaggcatacctttaaaatgtatacacaggctgggcgtggtagctcactcctgtaatcccagcagtttgggaggcccaggcaggcggatcacttgaggtagggagttcgagaacagcctggccaacatggtgaaaccctgtctctactaaaaatacaaagattagctggacatgatggtgggtgcctgtagtcccagctgcttgggaggctgaggccggacaatctcctgaagctgggaggcggaggttgcagttagatgaactgacacaccactgcactccagcctgggagacagggtgaccaaaaaaaaaaaaagaaaaaagataaaaaatgtatatgcaggtgggctttctcccctcaagattctgaattccttgtaagtgtcttctagtcgctttaagctcttgtggtcgtctcttccttagtgtactctccttacatcctttggaagtttagattctagaattatttacttggaatgcagttacattccattctaaacttcctttcccttgggtttataaaaacattggtgggttgtgaattgtgaccgacattgaaaaaatacaaaagaatgtggtaataaactccagggtgtatcccatttgtatgggttgtttctaagtctagcagtgcctgctagctggtaatctttcactttggattttttgttgttgttgggacagagtctcactctgctgtgctgggattacaggtgtgaaccatcatacccagcctcgtggtggtattatagatgcctgaggctggataatttgttattgtggggagcgtctcatacacagtgcggtgctgcaatcccagtctcaggtgggattttcccacctctgcctcccaaggagctgggaccacaggtgtgtaccaccccacctgtctaatttttgtagagatgggtttggaccatgttgcccaggctggtctctaattcttgggctcacctagacctccgaaagtgctgggattacagatgtgagccaccgtacctggccttcactttggattttatcaggaaggaatattgtacatggtgaacattttgtagaaaaataccaaagtagatttatatttattgagtgcttactctgggtaagggactgttttaagggttttacgtgtgtgtgtgtgtgtgtgtgtgtgtgtgtatgtatatatgtatatatatacacatatatacatatatataaattttttcttttgagacagggtttcactcccatctctcacactggagtgcagtggtacaatttcggttcactgcaacctccaccctccaggctcaagcagttctcctgccttagcctccctagtagctgggactacaggcacatgccactgcacttggctaattttttgaattttttgtagagagggggtttcgccacgtttcccaggctggtgttgaactgggcatgaaccaccatgcctggctatatgtatattttatttaatatgaaagtcagtatagcaaaaatgttagtaaccctcctaaagttaaccaactcactaaatgaatgattacatagtcctcttcctttaaaggcctgtgggtgaccttaggtcctgctgatcttatttatttttttgagacggaatctcactgtgttgcctaggttggagtgcagtggcgccgtctcagctcattgcaacctccgcctcccaggttcaagcgattgttctgcatcagcctcccgagtggttgggatcacaggcgtttgccaccatacacccagctacttcttactatttttagtagagatgggatttcaccatgtcggtcaggctggtctcagactcctgacctcaaatgatcttgccacctccgcctcccaaagtgctgggattacaggggtgagccactgcgcctggtccctgccgagcatttactacccatgccgttctgttccttcagttccattgtgtgcttaccaaggattagtagatacatcttgaatttgtttatgctggttgtacggtcatgtgttgcttagcaatggagatacattctgagaagtatgtcgttaggtgatcttgtagttgtatgaacatctcacacaaacctaggtatagcctactgcacacttatgctgtagcctgttgctcctaggccacaactgtatagagcatgttacagtactgaatgctgtaggtgattgtaatacaatggtaaatatttgtgtatctaaacagaaaaggtacagttaaaatacagtattacagtcttatgggatcactgttgtatatgacaccagtcattgacctaaacttccttatgtggtgcatgatacttgtaactttgcattttaattaaatagcaagtcagtaggcgaaatgattgtgagagattgtttcagtgaaaactaagttgaatgctttaggaagactaaataatagcatgtatactacctcctaagaatctagaacttgttctgattgctttgtatgtgttagtttatgtaattctcaccactcctgaggtacatatgcttatcgctatttgctagatgagaaaattgagtcacaaggagagtagatggtagaattgggattcaaacagtggcagtttgactccagcattgattaagcatcttgtgaaaagttgctgtcaaattaatgggtaagaggaaacttagccgggtgtagtggttgattcttgtaatcccagcactttcggaggctgaggctggcagatcacttgaggccaggagttcgagaccagcctggccaacatggtgaaaccctgtgtctactaaaaatacaaaaattagctggatgtggtggtgcactcctgtaataccggctattagggaggctgaggcagagacgcttgaacctgggaggcggaagttgcagtgagctcagatcgcaccactccactctagcctgggcagcagagtgagactgtgtccccccaacccctgcccaagaaaaaatcaacatcaacaaaaaaagaggaaactaatgtatatgagactgcggaaaatagtaaaaatcttgcataattctgtagtttgcttctttttaaacactttgcattttaaagaagcagactcaaaatcacagtgcactgtgggtgtgattgatgccagtcacacattctgctgttcaaaaggccatgactctacatcaaaagattctagttaaaatgttgccctgaagtgatgctcatggggatagtataagaaacaaatgtgcaaagatgggtagatgggaggtactggaggcctcggaacttcacctttgtgcagtttgtcgtccattggcacacatgaactttggatttggccacacgttttgaagatttgtgctttgcttcaagtttgtttttttttgttcgaaacttagttcccagacaggttttgcatgagaatcacttggagaattttaaaagccaagctccctgtctgattggatttgggagccatgtagtaggtttgaggaattgtccaaagctctgggtgggtctgtggcatagctaggcttgagaactgttgtgtttatctgccgtctcggggaatagttcttgagtgtgttgtgtgttgacaatcttgaggcggagtctcgctctgtcgcctgggctggagtgcagtggcgcagtctcggcttactgtaacctctgccccctgggttcaagtgattctcctgcctcagcctcccaagtagctgggattacaggtgtgcaccaccgtgcccagttaatttttgtatttttgttttgttttgttttgagacggagtctcgctttgttgcctgagctagagtgcaatggctcgatcttggctcactgcagcctccacctcctgggttcaagtgattctcctgcctcagccttctgagtagctgggaccacaggtgcccgccaccacgcctggctaattttttgtatttttagtagagacaggggtttcactatgttggccaggctggtctcaaactcctgacctcgtgatccgccaaccttgtgatccgcccgcctcggcctcccaaagtgctgggattacaggcgtgagccactgcgccaggccctgacaaactaaaatgatcagtgtgtcttccatttagatgcaggttggcattcaaatagaggcaatatatgactggtgaattgtaatttcaaaggaaagcagtaatggatcaaactcttgcactgttctctttcccttgcttaaaaaaaagtctgttccctctgaatctagctttatatagacgtttaaatccttaagtttacttgctaaaaatcacctggggtgcttgttcaacatattcccaggcttcttgcttgaaagttaaaaaattcagcaattctagggttgtgtccaagaatctgtatgttgaacagcaacctcagttgattcttgtactgaggcaagtttgggaataaggtcagtgtgggacggggtttcgatcttttctgttctgttctgctgctttttagctgtagaatcttgggcaggagtgtctgagcctgtttcttcatcttttaaaatagagtaagggtagtacttgtctcttagggaaggaagttcaaattaaataaaatgatacttctaggcagtggtctttaactagtggcaggtttgtccccttccattaccctggacatttttgcttgtcactctgggggtgggggtgttactggcctctagtgggtagaggccagagatgctccccaacatccaagagtgtgtatgagacagctccccacaataacaaattatccagcctcaggcatctataatgccaccactaggctgggcacggcggttcacgcctgtaatcccagcactttgggaggctgaggtgggatcccttgagctaggagttcgagaccagcttgggcaatttagggagatgccatttctacaaaaaatgtaaaaattagccgggtgtggcagtatgcacctatagtcccagctatttggaaggctgaggtgggaggattgcttgagtccaagagcttgcggctgcagtgagctgtgatcacattacgtgcactccatcctgggcaactgagcaagaccctatccaaaaaaaacaaaaaccctatgattgagaaaccgtgcttgccttggtaaatgttggttgttagtaataaagttgagtccctttgcggtttcttctctggcctgatccagggacccctcttactcccatgacgttatgggcatacgtttcacatttattattgggattggtaatcagatcttttaatctcctttgaactttgggagttgctgaaagcaccatatattttataaaagtctaaagtttataacctaaacaatagctaactaaagacaagactcacagggctgaaaggaactcttggtcaaattggtccatctgtccttagggctttaatgggtgtaaatacattgcccgaggtggttaagtattcttttgttaatgaattctggggagaactccccttgtaactgcttttcacagcttggttatttacaaagacttttgattttacctgaatagaaagcttcttttgtcttttgtgtattagcacattgccagatcctgattaggtaggtatttgtgaagtgccttaactaatttgtaccttaaccaggcttcttgctagaatacatgtttctctaatgtatgcctgggtgctaatagtttggtgctatggaaactacttatatttggttattggggagcagaagtagtatgcatgatgaggctaaggtgatgcctgcctggcttcagctgtgaattttagaaatacactgattaaaggtaaatttttttttctgtccttactgctggatttcttaatctgggaggtacttgatggaatttagcctttttatcccttgaaattataagcagcattttgtgtgcactttttcttatacatgtacctttttctgctgtcaaaagacaacatttcaacacattgagtataaagatctaattggattttattattgattaacaaattaggtagcaccccatctataaaaaaataggtgcccattgggcatggtggaacaatcggtttttataaggttgagcaggaacaggaaaacaacatagtacaaaaatgtgggttaacatcaggttacttgaggttattttccttataagggttaaagcagagggaacttccttatgccagctcacactgtctgtctggggatttgggtatcttctttcctgaaggtaaggtaaacaatttagaagtttaacatgagtgactctattttggtttggtctgttagggtctaggagctcggtccaaattagtggccttccatagattctgtttaacactggaaggagggtccgtagtgttgcgtgtgttagggtgactgctgagagcactgctgaatcctggggaggggcctgcaccttagaactgatcagttctacagtgttagaaacagacctcttttgtcagaaattaagaattcagaaaagttcaaaggatataattaaagtttttttttttttgagacagagtctcgctctgttgcccaggctggagtgcagtggtgcgatctcagctcactgcaagctccgcctcccgggttcacgccattctgctgcctcagcctcccgagtagctgggactacaggcatgtgtcaccatgcccggctaactttttgtatttttagtagagacagtgtttcaccgtgttagccaggatggtctccatctgaccttgtgatctgcctgcctcggcctcccaaagtgctgggattacaggcgtgagccaccacgcccggcctaataaagttttaaaataaaaaagttagacatagctagggtcacttttatgattttggcatataaagagttggcacttataaaatgtacatggttatgtaaatatgttttgtgttttaaaaatttaatagttttgaaattttctttttgatattgtgaaaggaaaataaatctcggtatctccaaattactaagccaaagggaaaagtcaagctgggaactgtgtcaggcaaacctgcctcccatttttttcctaaataagatagctagaaaaataaaaatgctacatacctccctaacaatttgcccacagggaaattccttgtggacaaagaactcaaagccatcccctctgttcacctaagacaaatgcgtatctgattgcttcctctgccctgttgttttgctaagccagactgaggcataaatgactatgcctctactctcttctcacatggaacttgtgtattcagtgaaaggctaatcaagagacttaaaagaatgcaactgtttgtctattatctacctatgacctggaagccccctcccctgcttccagttgtccggcctttccaggccaaaccagtgtgcatcttacacatattgatgtctcatgtctccctaaaatgtgtgaaaaccaagctgtgccccatcaccctgggcacataccatcaggacctcctgaggatgtgtcacgggcacgtccttaaccttggcaaaataaactttctaaattgattgagctctgtttcagatacttttgggctcacagtatttacagacataattcagccctaatctagctgctgcatttagttgcatagtgtgaatatttcacattttacttttacattttcataaatgggtatatggattatttaggttttgttatgaacagagctctgaatatttatttgcctcgtcctatacaagtttgataatttgtctacgttacatgcccacaaattgaattacaggattcatacacttttttatttttttgagttggagtctcaccctgttgctcaggctggagtgcaatggtgcaacctcagttcactgcaacctccaactcccacgttcaagcgattctcctaccttggcctcccgagtaactgggactacaggcgcgtgccaccacgcccagctaatttttgtatttttagtagagacggggtttcaccatgtggtccaggattgtctcagtctcctgacctcctaatctgaccacctcggcctcccaaattgctgggattacaggcatgagctactgctcctggctgattcgtatacattttaagggttactggctattcttacaattatttaatactaagagactctaatttctgcaaagcagatgagtgcaaaataaccagttataatgtttcccaagttaacagaggtttagttatttttaaaaatgagtttattggccatttcagtttcttctccgtaattgcgtatccattttctttgtgcagtttttggttggatttttgataggtaattcttcatatgttgtgtatctatatactttgttatgtgtacattgaaattttgtttcccagtccgtctgggaaacaagttacttgtcttttaaccttgtttatagtaataacttattctgaagaagcacaggacttgaaccaaaggtggagagtttaaagaactacatccagtattctttaccaataagaaatgtgtggccaggcgcagtggctcatgcctgtaatcctagcactttgggaggccaaggcgggcagattacctgaggtccggagttcaagaccagcctggccgacatggtgaaaccctgtctctactaaaaatacaaaacaattagccaggtgcagtggggcatgcctgtaattccagctactctggagactgaggcaggagaatcgcatgaaccctggaggcggaggttacggtgagccgagatcacgccactgcactccagcctgggctacagagcgcgacttggtctcaaaaaacaaacaagcaaaaagaaaaaaaaggtgtgaccagtcagtcttctttgcttttccatcttaagacacatagaagtgactgagaaggaatagttatgcaatgacatcggtttaataatcagttcaactgaagaatgtatgtaaataagggcagtgatacctaacgctgatagttgatagtgtggattgcataattcagactgtggggtgatatcttacacacgcacatacacacacacactcttgggctttgtcttctttataggtaaggattaggagaattttgacatatgcctgacacaaaagtgctccgtaaatattagctattgtatcactggcaggaagttagcctggaaataagttttatggaattccagtgtagattgctttgtgattgttttgccagattttgctttcacccacaaaaacactaagctctgccaaccagttcggccattttgtaagttagcaaaataaacactaaagtgaaatggcggcttttgggcggggctcccacaggctggctccttttaagtggaatgttgctgtgctgccctcttgtggccatttgggaaaccgcgattaaaaatggaacagtaagtgttaatggcacttcgtttcaaagtccagttccaagaaggttaatcactccgtttttacctacttcagaaagtattttgaagagataccaaattctttttatccacaagcaaaaggaagtggtaaacctttttctcatcagcatttatttttgattggaatctgaattcccagttttgacttgtttttttatctgtgtgttgtattttccttttaattatttgttaagtaaaaaattataaaagttgtttgcaatttagatgttgaataattttcagatagttgtttttcgtgaagattctgtatatatgttggatagtcattcctgaaaatccaatgtttaattgccctgtaactagtaagccactggtagtcagctaattttattactttgttatttaggtgaaggcttaaaggactccactcactaactcagtttgaccctttctattagtcttgtgggctttctgcctcctctactaaaccagcactaaagctacagcttagtactaatagtatttactattataattattaggtattaatggcaattctacatagtcttttaggaaatgtcgtttttttaagggaataatatgaatatatatatacgtatatatacacatgtacgctatatatacacacatatatacacatatacatatatatacatacacacatatatatacatacatatatatatatattttttgagacagagttttgctgttgatgcttgggctggagtgcagtggtgtgatctcggctcactgaaacgtccacctcctgagttcaagcgattctcctgcctcagcctccaaagtagctgggattacaggtgcatgccaccatacctggctaattgtttttttagtacaggctgggtttcaccgtgttggccaggctggtcttgaactcctgacctcaggtgttccacccgcctgggcctcccagagtgctgggattacaggcttgagccaccatgctcggcccataattacactttttttttttttgagacggagtctggctgtgtcatccaggctggagtgcagtggcacgatctcattttccatttccagtttatttagtgattattcctcttacgagaagtatgaaaattaagtaatgactttgttaaggcttttttttttcttctttaagcagttcccctcattagtacttgtattcagtcttacatctgattctggttccaaaaacaatttaaaaacacttttttttttttggagacggagtcttgctttgttgcccaggctggagtgcaatggcacgattgcggctcactgcaacctctgcctcctgggttcaagtgattcttctgcctcagcctcccgagtagctgggactacaggcacactaccatgcccagctaattttttgtatttgtagtagagatggggtttcaccgtgttagccaggatggtctcccatctcctgacctcatgatcttcccatctcagcctcccaaagtgttgggattacaggcgtgagccaccgcgcctggcctaaaaacactttttaaaaacactcattcaaatctttgctggttttgtgtagggtgggatgtacttgccgcccttggtttggatttggctctcatgattagacttactttagacaattaactagtttagacattaaaaatacttaaggtatataatgaagtgctgtgaattcactattaagcttcactactaagtttcagtcataaaatgtcactagtatcattccctgagagcatctgcctccctcaacccctaaaggcaaatatagttgtgaacttggtgttaatcttttcttgggtttgattttcattgttgttatttttgaaattacacaagtaatccatggaactcacaagtatacttcaaataacccatccctaacagagtaaaccagtgttagcaatgtggtgattaaaatgcatttatacacatagatatatgctgacagaaaaacggcttttttttttccccagaaggtattgttgtgtgcattgttacatttctaggaatcactctcctacacaaactcaaaaacacatagctgcacaagaagatacgtagaaagaaagatatttatggttacagtcaacagtttccaaatacaaatactctactcagaaatatggaaagtgtatcagagatatttgcaacttattgattaagtgaaaaatctgaaaataacctaaatgtaccgttaataggggaatgttatataaaatgtagtgaatttatagtataaaccagttcaaagggaatgagatgggcatccatatagacatatcctgatgcgggcattggcattccattacatcctatctgcagtgcttcccacttttcaacacagaacactataaacatttctagttgggctgttctagttatcttcagtaaactaatgctgccttttgtgggtctctagttggtaaagattttcagtctttttgttgctgttggagttttctgtttcctagtagtgtgtagacctgttgtctgtgacagttttattggtggtgattgccaaaacatgattctattcttaaacttttgtctggagttaaacattatagtagttgaaaaactaaatacgttatttcaaaggggaggcaaattgcacattctagcaaatgaatgtgcaattgaatccttctctaatataccaggcacaaagaacatcaaaggagatatgcttagtttgcaagtttattggggaggttgacaagcggccagattactcgatagtatgggacaagtggaggcaaggtagtgtagatgttaacagctgccggagctttggagtgagtctttctaggtcagcatgtgtgtcattgctaaaagtatagagagccagcagggcatggtaattgaagctcagacttgagatgtggctgcctgttttccatctcggtggtggtaactgctgtgacatatgtcagtattgtggaagtatctgataggtattgagcttaggataggagaccaaaggatgttttctgggagaaggtgatacctaagcccacaaaattagagaggtatttaatttgctgtgtccgcagtgggtgcaggagctagaggggagcaatgctaggtctagagtctggagcagtgggggtgagggaagaaatgattaagtcatgtgccttgagaaattgtcagaggccaggttttatagggcatgctgaaattggatgttatcagtgaccagaagacccggatgcctgggaggtgaacaagccttcagctgcctttgctatgggaatacagtttccaggtactgccttgcctaacatccctttcaagtagactgccctttctattaaataaatcccttccttacttacaaggaaattctggagctgtctctgtacctgtctgtccatgaacaaatagtggaggcaaaactaataaattccagctagtgtcatggattgtggggtaacgactcactaatgggtgttagctggggagaattttgtgttagaaggggaatctcagcttggatgtgatatgctcagatttcctgtttgggtagggctttggcatttatagggcactgctttcatagctgccattagatgttcttatgacactactggtagatgtcacataggttgacacaagttaaaagatgacacaggcctgaggtgagctaggactgaaatggaagctgcgatgccagagcccacagcttttaagtgttcctatcactatccagctctcctcttccttttttctttcctgttgacaacctgcctggtcacaggtataaagtaaatgactcagatgctttagtcacctggactagtcagcttggactgtgcaaggggttaaggagtcagtaattgtaatgaggtcttgaaactgttgagtcacttgttacaaggaagcctgttttgggaccttgtgtaacagggataagagttaataatgttttctgagtctctaatcttttggccccctatggtaaaatagaaagaaatgagctttagatccacacttggattggaatcccggcccctcaccctcttcctcaatttctagttttgtccattggccaagttacataaaagaggtcagtttttttcgtcattcatatggtgataataatgcctaatagtattgtccttgggaataagcaaaataatacatataaagtacttagcctagtgtctgatacctgttaggtgatcaggaagttacatggtttttctcatctttccccacttcccagtattgagaacctcccctcgacccctgctctcccattttttctcattgcttcctcatggtaactgaaaggcctccgtattgtaatgtgctgtggatcgcatggtgttatttgcagcagtcccagtttgcagtgtactgccctgtgcacctctagaagatgcagtgatggtaaatatagaacttccccttaccctttcaggttttgtgccacgtgtcttatctcctggcttctgaactcagggacttttctgttaatgttactgtaggttctgggtttttccttgcccccctcagagcaaagatgggtagtttttaagcaagagtaaacagtccacctcttgctgtagagtccatccgtttgaggtctttttgcttcagagtatcttcccctctaccagcatgcccctcagttgctttttcaccattagaggaagatgaggatattgttttctctgtgcttgagattgatactctatcacccctcagtctctgtggtttctgttttgttcctttagatgacatctacctacttaggttgctgctccctatgggatgtttggaatgaagaagggaagggagatgtgtggaggccagtagccgtctttattgggttgggtgttctcattagcatcagagtgccctttttgtttacttacttctgttaagtctaccacttctggatctcactgcagattataaggcagggcctctggattgaagttaatgtgtataaatttttataaagctcctcagatgagcctaatttgctcctattagtgagaaccacgattggataattgcaaccagtttgcattcttcctctttgggtgagatgctttgttttttttgtttttgttttttggagacagggtctcactgtgacacccaggctggagtacagtggcgtaatcatggctcactgcatcctcgacttcctaggctcaaatgatcctcccacctgagtttcccgagtagctgggatcgcaggcatgcaccatcatacccagctaatttaaacattttcttgaagagatgggttttgcatattgtccaggctggtcttgaactcctgggctcaagcaatcttcctgcctaggcttcccaaagtgttgggattataggcttgagccactgtgtccagcttgttttttttttttttttttttctggagaccaagtctcgctctgtctctaggctggagtgcagtggcgtgatcttggctcactacatcctttgcctcccaggttcaagcgatccttctgcctcagtctcccgagtagcttagactgcaggtgtgtgccaccacagccagctaatttttgtatttttaatagagatggggtttcaccgtgtggtccaggatgctctcgatctcctgacctcgtgatccgcccgcctcggcctcccaaagtgctgggattacaggcatgagccaccgcgcccggcctgcttggtttggttttgttctgtgttttgtttttttcttgttgagaggggaatgatacttaacagataagacttcgtggattcatatatatctggtttcaaatcttactgtgttaactaggtgtgagagttaaatacttatgagcctcagttcagcctcatttgaatgaaggggacagtaatatccatgttcagagtttctgtcaagagcctgtccatagaaataacctgttctgtagcatcatgtaaacattcaggaaagggtagctattggggattttgagaatggtagcaataacgttatttggaatgtaaaagtataaatgtgaatttgaagattttggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaaggtatctactttgccctgcagtacaaatgtgctgctagcctaggacaagctagcagacctttgttgttcatgaaaactcattagtatatcttgatgatgaaacctacagccattttttctagtaatatacagtagtatatctgaggatacaaatgaagacttctttctgctctattaaggaaaataaatgacctgaaccatccaattatagggaggaaagacaaatttttatacgcttggtttttaactttatttatttatttttgcaacagagtcttgctctgttgcccagcctggagtgcgcagtggcacgatcttggctcactgcaatctccgcctcccaggttcaagtgattctcctgcctcagtcacccaagtagttgagattacaggtgtctgccaccacgcccagctaatttttgtatttttagcggagactgggtttcatcatgttggccattctggtcttgaacttctgacctcaggtgatccacctgcctcggcctcccaaagtgctgggattatagacctgagccaccatgcccagcctaaaatatatttttaaggttaaagtgagcagttccggaaagttaataatatgtagttataggttggatggacctacaagccagtcagaatgattgcactgtgcctttgataatcattatcctaaaatgagaacttctaaggaaggctcttggttttctatgtacacctccttttcacatggtagctctctgtccccctccaaaagcttattactcatgtaagagtactcagtagtgagtaactccacatagtagatttttcatggaggagttgacttagatatcggctctcaaaaggacaaataagaacacaagataattttaggatgtaaacattataatatatgctgtaataaagtcataatagttgagctagaatgcctggctggtatcttgaagtgataaaactagttgatgtagtaacactgaaatgattttgccctcccagttaataagggctccataaaaacctgtgttgagtaaaaactttcatagctctagcagagggccaggtgtgggcatggatagacaggctagagtaaagcgcactttccctccttcctttctctgccaggttttttcagagtgttttatgtttactgcctctacctatatttcctaccatttggttattcctaactccttctgtttggaccttttgtcctttaactccaaggtgatgctaaggccgttacagaatctgtggactttgggttatgtgattacattggattctagttgtaaaatgcctattctgggccatcttttcttttgaagccttgattttcttcagcttacttcatcatttttatgttgttgttgttgttgttaaagtcattgttgataatgtcctttcttagtgacattgttggatcatttttcataaagatgagacagggtcttgctctgtcccccaggctggagtgcagtggtgcaatcacagctcactgcagccttgatcttctgggttcaagtgatcctcccacctcagcctcccaagtagctgggactacaggcacgtattgacacacctgtctaatttttaaattttgttgtagagacaggatctccctacgtagcccaggctgatcttgagctcctgaactcaagccattcttctgcctggacctcccagggtggtgggattacatgcctggccctacacttttaaatacaaacatttcacaagtctcagctagtggcttcttttgtgcatgttctgaaccttacttttccaaatattctcatgacgttagctgtcacctgtaatttgataacccatatttctcatctcagcttttgctacttgcttaatttctgttacaccttttcatgtcagtgttccacaatccattcaaattccttttgcttatgtgtgattctgttaaaagaatacagaatatacttagtagtagttatctctggggaagaaagtgaaaatgatttttctcctcaactaatctgtcttttaaactttttaaatcactggtgaggattgttacaggtcttaaaggttgttacaggtctacaaaaatcaggtcttaaaggcaaagggctaattactgctacagaataaaaaatagatgtgttagagaaagggtggcagtggttctcattctgagaacttctagctaagtgttagcaatgcctcatctgcgtttatctgggatgttacatgacctgaggaacttaaagaaaaatacaaattcctgattcttacttaattagacttaatgggggctttgccgcttgtattttcagtttcacaggtgtgggttagtgcagtcaagactgaaactcaaagcagtagggaatttaaaatgtatcagtaaatactttgtctttagtggaagcagccgctgtcttacctttctgtattattcagctgtatattttaatgatgggtaagcggtgtaccatatagatttatagctgttaagtaatgaagacattgttaaactaatatttcctaggataatatgcctattttaaaaaaaatggcgctttattgtctcataaatagaactagcaaaacaacccttttgatacttggttacttgaattctcttcaattgcaataaacgtttgataataataatgggggtcaagaaaaaagattaatgcgtggtctcttaattttacagatgtgggaagaatatcctgatgtttatggggtcaggcggtcaaaccgaagcagacaagaaccatcgcgatttaatattaaggaagaggtaaggaaaaaatgttttaagggcatgcatttaaactccctatcttacttcattctttctgactctggtatgtattaccattaaaaagactgaacttcaggcatgagggttaagtgactctaatatgagctatctatgaccagatacagtaaggcaagaagttaataatcaaataaaagaatctaaccagaaagatcatataatagtgaattttttagtagagtattatacagaactgacctcaaaatggtttattttttaagttgtctctcatagtgaaaattgattatatatagcaagaagtttacctttttaagcccctaacttctaaatctcctagatatttattaaatgggtaacttgtttggtaaacaaacagagcaatagaaatagtttgggatttattcctgaaagaggagggagtgcttaattaatgtatctacttttatttaacttcttaaatttggtttccttgctcatttttagtgtgagatataataaaatgagtttcaaacatacttactctaattgtgagagattgatcagtgatttttttaaattggtattctataccaggcttggttgtctatagaatcagacttctttcacctttctcattttgtgtgatatttttgtggattcttattctgaattaggtttatagactagatcctgaagagagattcttttgtctcaatgaaatgtctactttctgctttcttgggaggactttgctagtcttagctatataacgtacttctgatgaaagttaaatattgatagccacaggtcagtgagttgggtgtgggtttttaaataaatgtaccttaaaaatctaattcaccctaacatctgcattacatttgtgatgttttattttgagtgacctctgagctgttttgcctttgcttttgttttccatagtgtctcgcactaggttactgagccatgtttgttaaaaccaatcacatagttgtagaaatctttccctcttttacatattaattaacacattctctgtagggtacaagattaacagcaataggaatagtttgccattttccttaattgtggagagaaagagctactgaaatgtctgtgactgtaagctttccttggcctagtgctgttagcagagcactgttggctcatgagtgaacatactcttaaatgagtctaaaatgaatacatcagtagttggtgcctttaaggcacactgactaaatgttgtggcatttttatttgatagtctcaatctgcagtatccagtatggtccccactactcacatgtggcttttaaaattcgcattagttaaaaataaaacttccatttctcagtcacaccagtcacattttaagcgcttggtagtcacatgtggctgatgggtactgtattggacattgtagatacaggacatttacatcgttgcagaaagttattggatattgctgttctggaagtcaagctgagataaatatttcctggctttagagataactcagtgatagcagagagatattaattttcaaatcaaaagaagagggagttccaccaagcaagtgcttaggtttctttgtgtctaaaagctcatattgaataatggtatattgagtagactgttgatccaggagatagtgttgtcccgaagaactgtgaattaaagtctgtaatcatttttcccccctcacacactgaaggcaagtagcgggtctgagagtgggagcccaaaaagaagaggccagaggcagctgaaaaaacagtaagtctttcatgggggaaattattcaatctagtagtttcaaacttgtcagcatttctaggactgccttcgttgtgtctttagtctactccaggtcccttagtctgcttctgtctctcttactagctcgggtgactgtctaccttgacctgttgcaatagcagcagcagcattggaaactcaagattctcagtttaacacatggaaggggtccacgtatactcgagcttttgcttgggataaatctcagcttcttccatcgggttaacccaattagcccattgatttttttcagaaaaatatgtataaataacaagtacacaggtatttggtattgtagtaagcaaggaacaaatgtagatttgctatttttatggcaaaattatattggctgaacatccattttggtaagaaattacatattgttgtttctgtataattttaatgttgcagttcataagccagaaaaatttaatttgtggacttaatgtggagtttctttataacatagatttatatgttgattttttaatttaaaaagttcgatttatatgatatgaaattatttgattttttttgagaaataatttttaaagtcattttttggagagggtgtggatcccgttgacaatctgaattctatagcttctctcaaaaatgtagatattcaaaactttgtataccagttcaggggttctcatgttaaacagttgtccatggcttctattaagagctctaggtacatatgctctgttgtaaaatattattactctttagtaagtggcctaaggcaagtcatttgagattttaaaacccatttcctcatctccaaaaaaaaaaataataccatctacccaacaggattattagaaactatgctaagattttgtgacattaaataaatgtagggtattacagagccttacagaaaagtacttaattttgccctgctagagcgcattcagttttcatttgtgttttggagaaatagtaactgtaagcaaacctgcacttggcatcttagaaggcttttgttctgccccagtctcctggtctgcttgggagactattatctgcttactggtctaatggccttttgagtatctttcctgaaatgtccaccttgattacaccctgggaaatccatgcatgtaatcattacttcaccatctggctacattcctttggtctcttgactgcaagttaaatggtgctatgcttgaattcttgacttcctattttaatggccttatttgtgtgtgcagaagccagcgtttttttcagtcactgtataatacattgcgcttactctggttactggctcatagtcttgtcagcctttttgttttgttttgttttgagacagggtctcactctgttgctcaggctggagtgcagtggcttgatctcagctcactgcagccttggcttgctggacttaattgacccacctaagccactcgagtagctgggactacaggcatgtgctatcatgcccagctaagtttttaaaaatttattgtatagatggggtctcactatgtttctcaggctggtttcaacctcctgagctcaagcagtcctccagcctcggtctcctaggattacaggtgtgagccactgtgccccgccacttatcagtcttaagaattccccaaagttggcaaccttcagtagcatatatggacctttcttttcctgagtagaacctcttagttccttgcagagtgggatctgtcttctttttcatattgcttccctaccctagggctgttcataggaactgccttgggctgagatagttcccctcatgttcctgtgtttgggcactgggctagccttcgtttctgctattctctggccagctggtgagtattgtggatttacagagagctcttctcctgagtcaccagttgagattcctgaaagattaattaggggaggtcttgtagctgctgacactcaagttgcaaggcactttaggagccttctgtgatccaagctgagcaagtgtaacataacctaatgtgtggtcacatgcatttcagaattcagactcactcagagagtgaaaggtttgaaatattggcacaaagaaatgcttttctgaaaccctgcagattttattcacacattttagagtttttaaaaagggaccattttgtaaaattggtttaaaaaaattaattccaaactttaggaaagttgcaagaataaaagtgcagtacaaaggacaccttatatactttacccagattaccatttttcctccatttgctttattattatgggtgctgtttatttaagagagagggtcttgctctgtcacctaggctagagtgcagtggtgcaaccttggctctctgcagcctcaatctcctgagctcaagtgatcctcctacctcagcctcccaagtagctgggacgacaggcgtgcaccaccatgcctgattttgtatttttgtagacatagaggtctcactacgttgccctggctgttctcaaactcctggcctcaagttatcctctcaccttgctctccaaaagtgttgggattagcatacgtgagccactgcacccagcctgtgtatatttatatatatacaaacataatgttttttatgaactatttgagactaaaattcataaaattttaccttttatccctttaccttaaatatgtaaggtgtatttcttaaaaataaggattttctcttttataagcacagtacagtacagattcaacttagatttaaaacattgctgacgtacttttttttttttttttttgagacgcagtctggctttgtcgccaggctggggtacagtggcgcaatctcggctcactgcagcctccgcctccggggttcaagcaattctcctgccttagcctcccgagtagctgggactacaggcgtgcgccaccacgtccagctaattttttctatttttaatagagacggggtttcaccatgttggccaggatggtctcagtctcttgacctcgttatcagcctgtcttggcctcccagagtgctgggattgcaggcttgagccaccgcacctggctgctgatgtacttttgtctgattcatatttcagttttgtcaattaacccaataaagtctttcataatatttttccatctctactacaggatctagtttagggtcagttacatacaattagttgcacatctttttttttttttttaattgtactttaagttctagggtgtatgtgcacaatgtgcaggtttgttacatatgtatacatgtgtcatgttggtgtgctgcacccgttaactcgtcatttacattaggtatatctcctaatgctgacccttccccctcccccccaccccatgacaggccacagtgtgtgatgttccccaccctgtgtccaagtgttctcattgttcaattcccacctatgagtgagaacgtgcggtgtttggttttctgtccttgcgatagtttgctcagaatgatggtttctagcttcatccatgtccttacaaaggacatgtctgatttctttaattgggagcactttcacagccttcttttgcttttaggacattgatgtttttgaagaatgcagtcttgcaagggactgtgttctttgcagaattacgaagagaccaattaccccgtcacgatttgtattaggtttttattttttgggatggactctcgctctgtcgcccaggctggagtacgatggcgcaatctcagctcactgtgactcaagtgattctcctgcctcatcctcctgagtagctgggattacaggcatgcgccactgtgcccagctgatttttgtatttttaatagacatggggtttcaccatgttgcccaggctggtcttgaactcctgacctcaggtgatccacccgcctcagcctccctaagtgctgggcttataagatgagccaccgcgcccggcccctttttttttttttttttaagttaaagagacagggtcttcctctattggtgcacatgtgtggccatagctcactgcaaccttgaactcctgagctcaagtgatcctcttgcttcagtctccccagtagctgggactgtaggcacgtacaaccacatccagctgtattcatacttttaaagcttagaagaagttatacagcacaatggacctgcacaatatttaaaatatttttaaattagttagcatcatttaattgagagtgcataacaatctgtgtttttagcttcttttgagaaaatttggtaatgctggcttatgtaacagtgatggaccaggagttctccattttgccttgtttgcagttctcatctggcccctgtgagtatttgagattgtaatctctgacttagagtcatacaaacaaacaaaacattgaactttttttaaccaactcagatgctgttttgattaaactctttttttcatgcattacctcttaatgttatccaaattgcgcagtgttgtataagatttttgttgacttctggtcctggtggttttgttttgtttttgtttttgagacggcgttttattcttaccaggtgggagtgcagtgcagtagcacattcacagctcactgcagctttgacctcctgggctcaagtgattctcccaccttagcctcctgagtagttgggactgcaggcgcacaccaccacaccaagctaatttcttaattttttgtaaaggctgggtctcactctgatgcccaggctggccttgaactccttggttcaagccatcctcccaccatggcctcccaaagtgttgggattacaggcatgagccactgtgcccggcccttttccagtgttttgaattggagattgtcacatacctgtaacacagtggaagggaatccctattagcctcagatttctgttgatcattggaatttttttttcaaaagcatgctttcttggggaaatctactgaagactgaggaaacaaaagtagctacttccctcttccagatgtcttctaagtggaggaaaaaggagttttcttttttacagacagttaatagcaagccttaccaactcttggtcaaagttctggctcattatatttaaaagtagcttttgttcatttcctactttacagttgattagatttgatttgtctgtcttaggatttgtgtctagccaaccaccttttcccaataaaggaagaaaactatacacatttaaattgcattttgactttttccatgtctatttacattgccttggggcctcttggctaaatcttggtatttttctccctagttctcaaaatttcgggaaaaatttagttgaattatgtgtttttacagtatctaggggggactctgttaatggcctctaaagctggatattgtaagtttcctttgatagacattttttgctcacgatctcatatcttaaactattctttattgtagactgacttacaatgtatggcttagtggtggagtcttgataagatttgcattttataagaggccagtaatgtaggagaggacagcagtttcacatgtgggagagccttatacatctgtagggttgggaagtaatttctttgtaacagctcagtcacttttttcacttcacccattcttcacagtgacttagtattgctggtccttactatcttttttctcgttcttgaaaatgaaaagaaaacgtgaaagaatccaaccaatttcaaatatacatacacacacacttaggccttttaaaccttgagtttttcaaatactcccaggacgtgtaagcctggctttaatgtttcctgattctttggtcctcagtgagttatgattgaaagtagcagggctgagggttggtgatatggccaagcaactcatttcctcactgcacttcagtttccttctctgggaggagaactttggactagttgatttgctaagttttttttttctttctttctttcttttttttttttttgagaacagagtctcgctttgtcacctaggctggagtgcagtggcccgatctcggcccactgtaagctccacctcccgggttcacgccattctcctgcctcagcctccagagtagctgggactacgggcgcccgccaccacgcctggctaattgttttgtatttttagtagatacggggtttcaccacgttagccaggatggtctcaatctactgacctcgtgatccgcccgcctcggcctcccaaagtgctgggattacaggcgtgagccaccgcgcccgaccttttttgcattcttatattgggagattctaagtcctcctggttgttcataagtctgtaaatctgtaatctaactggaaaactctagcctcaacacatccattctctgtgtttgctgtctgctatacttatagaagtggacctcattggtggccctggtttaggttctcaattcctgggggagatatggtaattagaatttattggtgaatctttcttatctgaaggactagctgttcatattccttcaagcatgcttctacttctctccagtttgactgtgtaagccccctctgaggggtaaactgttgtggacttggtctgagggagactgcagactcatgctggtctcccacttactgtaaacatcttcctttcttccttcctggtgatcaccttatattccttggattcttagcaaacatttattgtactatgctccggggaagcagaattagaccagtgtccagagtgtatatacgaaggtctttgttttaaagagactgaaggatattaggcaatactaacaggcctttctgtcttaccagaagcacccctacccgtctgactgatagactaattgcgcattctttcattgatttttttttttttaacctaacaaagaaacatctccatttgcctgactttggctaaactctggtacaaagacgaacaaaaagtcttggtgtacaaggacccatctactggggaaatgcatatggaaacacgcagtgctagtagaagttgaataatattcataaaattgctccactgaccgtccgtggaaggcctgaattgttgttttttccccctaaggtctccaccaattcaggtttagggtgaccgttgtagcttttaggaaggttctcaatctgcacatcagccacctcctttcaataagctttcaccattacttgacctgttctcccatgaagaatattgatttgacatttgtcttgttgtagctgttgtctttagtatgacctcattccctataaagtgacccataggcaaattggtaattgtttgatttacagagaagccccaggcacttgcctgtcagttttttcctaggtatttcatgcctagcagctattacatgtttcttccctcttctctgtaggtgagaaatgagtggggtccctgcaatatcttgttggattttcaagtaaactaaaactgtttgggatagtaggacgcctgtaggttatggctctttcaagccttctaagaattcaaggagcaaaggaacatctactgtatctaataattattaaaaactacatctttagctgaacagattagttatatgataggtttattgttgaaaaataattttagggactgtttccttaaatgtattctagagacttaaaatatctagtatagtggttctcagagtttctacccagtatcagcattacttgaatttgttgaaattcatattttttaggcctcaactgagacctactgcatcaggagctctgactagggcccagaaatctttttttttttgatggaggaggggcagataggggcagggtttcactcttaaccgcctagggtggagtacagtggcaaaatcacagctgactgcaacctcaaactcctgggttcaagtgatccttccgcctcctcagcctccttagtaactaggactgtagacatgctccaccaggcctggctcaattttaaaattttaactttaatttttctggagaggtgtcttgtattgctcagcttggtcttgagctcctggactcaagtgaaactcccaccttggcctcccaaagtgctgagattacaggcatggaccatctcacttggcccagaaatcttttttaacaagccctttaggtggtcctgataacattttaaaattttggaagcactgatcttgtgcatgttatggtttcaatcttgtcaataagagtagtaaatgaaaaaagtacatatatatccatttttatttatttttgttactggagataaaataggaatcgatattatgtagtccaggaaggatcacaattcaagtttaaatggagctagaatctcttttagcatgtctaaaatgtgcatgttctgccctttggatagtaaaattgaaattggttttgtcggattatttatcttgaaggattcttttagaaaaaaattactttgttttgcttttgatcacagagaaaaatggaaacaggaaccctcagaagatgaacaggaacaaggcaccagtgcagagagtgagccagaacaaaaaaaagtaaaagccagaagacctgtccccagaaggtgcactgtttgcttaagatctctacttgggatgagcttaatctgctgtagattgggaaggataatgtcgtgctgaaatgagagctttaatgagatgcattgtgttttgattctgcgttttagatatctgtggttcactttcagccagcctacattgcaggtcttactgcttctttcttcgcagactggctatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatttttgataagacagatggcagcctaagatagtgatgacaggaaaagggagtcagaagacaggccccagggaaaattacctccttgtagtattgcttagaatggactcagcaaactatgccctttgggccaaatttcatccaccacctattttcatatggcctgtgagctaagaatagtttttatagatgaacatttctaatttacagtttaaggatagagagcactaaatttgaactccaattaagtgaaatgttatcccctcaaaaacaattctgttctcattagtagatatatattgcagtaaatgtacctgattatttcattttgaattatttaaaaaaatttgtgaaaatttattttctttcattatgtaaggacctatacattggtccccattttgcctcttggctggcagagcctaaaatatttactctctggccatttacagaaaaagtttgccaacctctggcctaggacattgtacttaccccccaacaccagcaggggaatttgtcaactgaattttatcttattttatctcagcttaataagtttatctcagaactgtcacgccagttctgtcttttagaattttgctcattatttattacatcgttgatcatctgtttaggtttggttatgagaaaggtatgggaggtatgagagaaagagataataaatgtgatcatgagtatccatttctctccctctctgacttctttcacctttttatcactgatggaatatttggggatttccttaggtgagcttctagactgtggctttcaatcctggccatctccctggtctgtccaagttaattctgtgatagggcacacagtctctcaggtagtattccaggtatattttatacacatacagtaaaaacttatgtatagttacttcttgtgctttactttcttcacacagataatagcatcctctgctgcttgttctgtaggtttctttatcctggaaatcctttcgtattagtatacaaaaaactctttttttttttctatgagtacatggtactgtttagtttccagttgaagaatatttagagttttcttaatgttttgttgttgcaaataatgctatagtgaatactttattatgcctgtttaggtgtatatcaataggattaattcctacaagtaaaactgttaattcctacaagtaaaatagtttgatagctatttccagtttgcccaccaaagagatactatcatgaacaacatgctgtgtatgtgtttttatatcaggtaatcctgatgaacatttgtgaaacattcacgttctttcccataaatgattgaggattatcagcattagaatgaccttcctgttggaaatccagatttctagtgaattagaatttcagggagtagggcccaagaatatgcatgtttaacattccccaagtgaaatgttacattctgatgtatgaaccactgctctgggaaatactgttatataaagtagacaccaaatgataaagtgaagacttagccttttgtttctcttctcattttagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttaggtaagttgtaccccagaagtgtttcactggtgtgatgtgataaagtagttggttagattttggttctcataagtccggggttgtgcacttaatagataaaaataacagcctatgtcctgaagttgttttcagaaatctggttagctttcttgcaaaaagagtggtattgagccaaggggaataggaaaagagtagcaatagctcatttgaagccttcattcctaaaaaacaccacaagttcgtgtcctgtccaatggtgacttagtggcattatcttcatttcataacatttttttccattaaagatatttggattatattcctacttctgaattgctctttgaatcacagacgtttttctgaggttcagcttaacgtattgctacttgaatctgattttatcaagtactaataggatatgaagcattaataggaattatcattagtgaaataggccaggctcagtggctcatgcctgtaattccaacactttgggaggccgaggcaggcagattgcttgagcccaggggtttgagaccagcctagacaacagggcgagaccctgtctctacaaaaaataagaaaaagccgagtgtggtggcggcatgcacctgcagtcccagctacttgggaggctgaggtgggagaatcctgggagatggaggttgcagtgagttgagatcacgccactgcactccactccaggcaaaaaagctagatcctgtctcaaaaagaaaaaggaaaatgaaataaaggaacagatatatgcaaacactagtagtttactttatagaaatcaagtatttttttttttagattttacagatttgttcttcatagagatggtgaaaatgaatcctagagatattcataacttattcaatgtatccagttaataattccaaagctaggactgggctttgagtatgctagtgtatagcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgctgggattacaggtgtgagcctccgcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttctttttttgtgtggtagtctacttgtttacataataatctgatactaaaaaatgaaaaaaatagaagtgtccttatagttttctatatcttgcttatacaaatcagtataaatatagaatttttattttcaaattgagttagactccctacagttgtttaggagcattcatcagcactttaggaaaaaaaagtaagctttgagcctactgtaaatggcagatctataaaacaacatgcttttggaaccaaaagggtatggtttcttattctagtgacggttatgtgtggcagtttaattctgaagagatcatttctcatttattcagcattattcctcttgcagttacaaagaagatgatgactttgagactgactcagatgatctcattgaaatgactggagaaggagttgatgaacagcaagataatagtgaaactattgaaaaggtcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaagcaaatccacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtcttggagagagggatttgttttccgagttagtaagggaccaaaacaaaaggatgttgctgctctgtttttattgtttttgaataagggatttctttgatttcacctgcaaatttaggaatatgtaaaaagtggtttacatttttaaaatacttgaaatttttgattgagtccgttctgtgttgtttgtgagtttgtacttatttcaagttgaagtattttggtgcttcatccacaaagggagtcttcagataattgcattcttgggaagctttttaatatctggtgtaatatactctctttcaagtgtacttaatccttttgcagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggtatattttccatcatggattaaagaaatgtatttgcagcctgaaagaagggaaggttttaaaataatgcatggagatcacagctatctagaatctcagattttgctttgatcatctaaacatggagccatttacaattctattttataagattgtgaccttcagatactatatttttatatgtggctaccaagtttttggagttaactagcttatggagcgttattcacacattctttagttttcacaataagtgcatgagatttgtactgttattacccattttgtagatggggagaatacggcacacagcaattctgcaagtggactcaggttttgaattctgatgccctgaatccagagcttattctcttaagcaccttgttattttcctgtagttaggctggggtggcttagatgtagagagttaatattctggaactctctgggttatgatatacttaaaacaaattctggttttatacaatttgcagaaatgatgtgaaggaaattattaggttaactactgaaactgtgatagtcctcgtgtgtttagtttacttacagccttgaatgtctgggtgttgtatatgggaaatatgtggagctatagcacacaaaaacctaaactgggtaataatggtatcaagctcagcctgaagacatacctgtctgtgtggtgtgattagcctatttttgtgtctggaatgtgcatagatttttgtgtctggaatgtggacagtaattctggttttactactgtgcaaaatgtgctactttagtaaattacatgttttttctttgactcaaaactgaaaatatgtaccccttagatggtgaggtaggcttgtaaagcagttagaaatttgaaatcctctgaaatataataattctaatattaagttgctgctgttgtcatctgaaaggttttggtaataagaataactagttttccaagtcatgtttaatcaatcctaaaacccatatatatataagaaaaggcgtacagttttattatcctgatttgttgagatgtatgaatttgccacatgaatctatcacataaaagagttatttttgggtctctttttagacaggacacatcagaggcaggtaactggtatatccttctatgagtgtaaggttttcagtgttctctaaaagtgttttttttgtttgtttgttttgttttgtaaaatctctggcgtaattactagtaaagattacttaaggggcagatgggagtaaaaaataggttttcttttccacctttgacttttgctttgatgtatgtggatccccagactttagtttatgtgtactttttctgtctgtctgccattcaggttagggaaagtttctcctgaagatgtagaatatttcaattgccaacaggagctggcttcagagttgaataaacagtatcagatagtagaaagagtaataggtaagtacatggtaactcacttcagccatatttgaacttgaggaatagtggcttttgcttttggaagtaatgtaaattttaaaaatgcactttggagactagacacgtgctaggtttattttaaaggaaaagctaagaagatttgctggtaaatttggatgtgggggatgagagaaagaggtgttaagtatgacctcaagatttgtggcctaaacatgtagaagtttagaggtaccatttaccgaagtggaaagatgaagggaagagctgatcattggagtggagaccaagagcttagtttgatatttgtaagtttgatttacttcttagtcatctaagtggagaatatagtgaaggctggagcatatgtgaacctggagcttaggactctttagtctgggctggagatttaaatttggaaatttatcagtatttagtatttaaaggccaagattgaacaggaccatcagaaatagagtatcacgtggtaagaagaagtagtctgagagcatttcagcttttggaagtcagaaagaagctagcaaaggagactgagaaagaacagtcggtgagacaggaggagagctgagagagagtggtgtactggaagccaagtgattcacatagccaggagagaggaaatgctgtcagtcaaggacgattaggactgagacttgatctgtgaatttggcactggcaaaacgcatccatggagtggtgagggtgcggcctgattagggtaggttcaagagaaaatgagaggggatagcaagtataaacaactcgttgggggagttttcttacaaaggggaacagagaagtggagtgtcagcctgagagagagatgagaaaaagaatttttttcttcttcttcttcttcttttttttttttttgagatggtgtcttgctctgttgcccaggctggagtgcagtggcgtgatctcagctcactgcaacctctgcctcccgggttcaagtgattctcctgcctcagccttcccagtagctgggattacaggcaccccccacccccaccacgcccggctaatttctatatttttagtagagacagagtttcaccatgttggccaggttggtcttgaactgctggcctcaagcaatctgcctgccttggcctcccaaagtgctgggattacaggcgtgagccactataatcccattttttttttttcttttttaaggtgtgaggtagtagaatatatttacattttattcatagaacccaaaatctttcattcttcattgtgtttataacttttctgtcttattttttatttgtttagctgtgaagacaagtaaatctacattgggtcaaacagattttccaggtaagcaagaaattttatttataaatgttcttcaacatttcagaacagtgtatgttttgcagattattttgttttgccacatgatgttttattgattatgcataaaacagaatgtcatttttcacttttaattgacagttgctaatctataaattttttttatatgaaatagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggtatggtgatggttggcttttgttttttcagggagaagatatactgataaagaggattggacacatatgtgctgagaaaatattacaaaatgaaatgatgattgccattttgaagtgaaagaaggtgatttaaatatgacattaaagcaaaaggagagaatgaattatttcatggctttgctgacttgtttaatcttgcaatttacataattagaaatagagatatttgagagaatacttgaaaggatttaggcacttttattttattttattttattattttattttgagacagagtttcgctgtgtcgcccaggctggagtgcactggcactatcttggctaactgcaacctctgcctcctgggtttaagtgattctcctgcctcagcctcctgagcagctgggattacaggcacgcaccaccacttccagctaattttttgtatttttagcagagatggggtttcaccatgttggtcaggctggtctcaaactcctgacctcaaatgatccacccaccttggcctcccaaagtgctgggattacaggcgtgagccaccatgcccagttgcatttaggcactttaaaagagaagtgaagccagttgcagtggctcacacctgtggttccagctacttgggaggctgaggcggcaggattgcttgagcacaggagtttgaggccaacctggggaagattgtgatacccgttctctaaaaaaaaaaaaaaatagagagcgggaagtgatagaaaaggcgagtgtctttgaattctaagttagaaattaaatatataggcttatttgctagattggctgaataaatcctttccttggaatttattccatcaggaaactgatgtgcttgggtcctcagtaatgaaatatcagacaagtgatacgtctctgagaagttgacattcatgttaatggcactagaattctatctgtgaaaaccagtatttaattgccaaagagtgtgatagggaaaatgtggtcagagaagcaccaatgtagaagtctctgagctccagtggtcattgaatgggttttaagaggaagttgtggttgttgaactgcatctggcccttgtataatggattggtgctgctggctatacagacaagagggggcccagggtattgccctcctgtgaaaggtatcaagagaaagattcttatagttcaataggagaactactagaccccaggggtgaggagaagaggaatgatgttgacaagtacatcaaggtcaaagtgtgtgtgtcttggctacctcgaagggtattttgactttatctcctaggtattcgtacagctgagtacagtggcattatgaaatagttttatttagaaagcttcatgtaatagcagtatataggagactctggagtaagtaattattaaagccagaaggtccagccagtaagatgtcattgaagtccacgaatgaagaagtagtgtgaggacaagggaagtaacagtggcgtggaaggagtggatgggagaacagttatggggtaggtttggtaggagtggatggatggctgggttttggagttgagagtaagcagtcggattccattcactgccagccgccctcatagagaactgaacacatcaataaccttatcaaatattcttattagaatgatacttctcataatgtgtgctatagagcactaatcttcagagaaaagtcccctgaaaaaagactttttggccatgtaactttgagatacatccctgaatgaatttctcctgtaaattcacgctatggacacacatttcagactttgaaaagtcatgagtaaagaaattgtataactttttgatcggttgtttcctaaactgatttggccacagaatccacattttatgcaaaccatagagactgacctcactagaatgctatcctttaagcttctgggggtgaaaacaaccttcccttcagaagcttgtttctgaagggaaaaccaaattcacgcaattaaagggtttaaggtagatgggcggcatttctgaatttacaaatcctgttatggtgaagatcaactgtatttagcatatgacagctggaggcaatgttttgtactctttagaatcagataacagaaagatagttgtttctgaaaaataggagactctgactgccatataatagacaagacctaaagtgctatttaatgatgttcatagatttatttcaggaaaggggcaagttaactaaaaatattttatttgaggatgaactaactctggcttatggaatattaaccatgaagaaaggggtgatggagtgaggtggtgattcacacacatgaaatttaagtttttggccaggcgcggtggctcacgcctgtaatcccagcactctgggaggccgaggtgggcagatcacgaggtcaggagatcgagaccatcctggctagcatggtgaaaccccatctctactaaaaatacaaaaatagccaggcgtgggtggtggcgggcgcctgtatgtagtcccagctacttgggaggctgaggcaggagaatggcgtgaacccgggaggcagagcttgcagtgagccgagattgggccactgcactccagcctgggtgacagagcaagactccgtctcaaaaaaagaaatttgagtttttatgctttgatgccgaatatgtgaattgtggctagcgttttaacatagtagcagtaagaacattttctcagacttgggcttttgtttttcaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagagaa

SEQ ID NO: 2443 - DNA, 127687 bp, Homo sapiens
  source 1..127687: mol_type = genomic DNA
ctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctgttgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggacaaaagccaagaggaggacagttcgctacacagcaatgcatcgaggtatgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaattgttgctcccttgagtgtatcatttgcataggtctcacatgggttttggctctcttatgcaaggtttgtggttaacatcattgatcagactgtgctttctaattctaaaaaattgagcagtgttggtattctttcagtatttttactctcacctggaaaactacctggaagttgtcaggcatttgcttactggtagtggaggttacagctgtacatgaagcatgtactgactgtacttttaaattggtttgtcaagtatactttgaatcatatacctgatggatgtccaaaaatatttaagactctttgaaaagaagatagttacttttaaattagttaccctaaatttcatatcttaatacatgtacataattatgacatcacttccttttaaaatgtgcagctgtagaatgttagtggtgttttaatgtggtagattaatattacttctactgagctgaactgtccctgtaattagtacttggttccttctgccatcagagtttttattgcccaaagtatagtgtttagggaatactacgaaaatcacctttgcagcctgagccacagaagaggaaatgagtttgcaggtcaagtaaactttggtctgagaattactttagtatctggaaagaatgagtgcaagtttaggtaaatctggtaataccctgtttttggaaatagtgcagtagttaatagtggttatataagtttgtattttaatttgaagttaatgctaaagtctgttatactttatcacgatttttgaaaattaaaaactttaaaaaacgcgattttaaaaacatttgattgatatttgtaaaatttctaagtatttaaaacaaagttctaatgatggacatacgagaagtataccatactttttatctgaataatttgcagcttggggataacttaagtaacatcaaagaatgaaaacgggactgtgtgcacacaaagagttcagtgtgttctccacggcaccacgttagcaatttatcttaagaattgaacgagtttattaaatttatctccaaatcgtctgcctttgagccagatttatttttataacctgaggtgcgggtaaatcctacaattttcaggggcgctttaccagatattctaaaaggctggggatgattagaaatggcataatgcagttacttgtgtactagaacaggcagtttaactggcagccattttatgacgctgataatacattaaaaaacgggattttggagaagactgaatctaaactaatagaaatctgaaataccaaagcctatttccttccccctctctgctcttctggggaactctggtgccgacataaaaggcagttcgatagggcacgcagcagctctttgagcccctggcatcttgatgcaggtccagctcagtcacaaaatggctgttcctttgtgccgcagcgctgacagacatactgcattgcactgtgtactcgccaaacagcaggaagttgccgtgccgagttcaaaggccggccggcgccggcgcggggtgctgattggctgtgcgcgcgcctggtaacagcagggtcaacggcggcgccttcggcagcctccgccccgtgacgtcagacggctcccctggggggcggggagagaacgcagtgacgtctggccgcgtgcgcatgtcgggcgctttctcctccccctacccagggagccgcacgccgaggggaaaaggaagggaactctagttgggactttccggtgggcggcttctttcctggacgcgtttgctcctggcagtcttgtccgcccttgcctgtagcggtccgcaccctgtagtgtgttcttttgcccatttccgggaatggtttatcctctttgagaagcggctgcttttggagaaaaagtgcaggcactatttataaattttaaaggcactatttggaaatcttaaaatagaaaatttgcccagttttacattttcccttttcataccttagcgtcccttctccccgcccccgttcagtgtgaagagatgagtgggtttaattttgttacaattgaccaaaacgtttgagtgtcagaggcggatacttttattttagtgaaaacctcttgacgggtgttaacagctgtttaatacatggctcataaacaaagggaagattatttgaacttgtccccatgcgtttttacttggtaccgtacattttctcagttggcatttgatggagaaaaactcaggtcagtatgtgctaagtactatatatttaagattcacagtgggatagtttagtagaaaatagaaaatttcacgttcaataacattaaaaagtggcagaatacagcgttaggcaaccattactatgtaagtaaatgtcagaaaactactcttttaagtgttaatagcacttgctaatgcagggtgactgacagcttggctgatagtggggtcacttggccaaatcttcgcaattatcttccctaggcctccatttcgggaattctgagtcccggtaaacggttgggtttatgctcactgatttgccttgtttggaaacctttacaaggatttctggttaaaacttcatcgttcagcaacgatgtcttaataattaaattacacatactgaatttaagcaagcaagaaattcagtggatttatctactgtggacaaagtttttttcctgccatactagagtttttttagcagttggagtaggctgtcctgtagttagccatagtttagagttattttagtaaagtgtgttacttcaaaggagatgttgacccttcagtgcaggtgatatttgcttgggcgtatgtcaagtttctgaatacagtctgtgaaagttagaattcactatgatagtgagttttgtaggttctcataatctaggttctttgggaagaattatttggatagtttgtgaaaactagctgaaattgctttttctgttacagagaagtgttcatcaaataatttgtacctgattttaaaattatatgctcaaatgtatattgcgtataaaatgctaacagagaattaagtgtttatagaacttgatgaacgtttaactgtagcttccaacttaaagtatacctgccacaagaacgaaagtaataatctcacctccctttttgtgtagagactgaattctaattagttgtgttaatagtatttgctgaatacctttcaattcctaaaactggggtcaaagtagtcaacattgcagttaattatttttgaagaggatatgaactattctgttatttaagatattttaacctaaataccattatgagttaaaatgcataccatgatataacaatttacctattaactgttgacaatcttgcagccaattaagttttttatagaaccagtgttcttaggtatgtttgttgagccttctactttttttccctttgatgtggggaatagcatcaagcagcaagaaaagagtgttgatcgatttctctctctttctctctctctctctgtatccttgccgtttaaaatatgcactttccaactagtatttggccgttagggagttagtatctttgtaaagattaagtcagcagaggaaggtgggcaaataatatttttgataaagacttttggttgtgacagttgtagcaagttattgcttgaggagtgaatctggaagtttatttgaattttaactaaaactcacagattttatcattagtttactctcccttacccccaaataaaacaactgacagttatgagagacctcctgagaccacctggtatttccaaactcctatcatttctcccataaaatttgatacactaagtttgtttctggtataaaaattgagtgactgctctgtgtcagccattaaattttttcttgctatgagccatcttttttttttttttttttttaagatcctttagtttttagctgcttcttggtaaccttagaactttgcttccttgaagaacttggctttcttgatatggtgtcacttgaacaaagaaacttaaaaaaaaattcctctaagagtattttgtgtacaggtgaaagtaactttgtggcttggttacactgggtgtgtcacagctgagtaactccctcctgcacttcagcttgactaagcgttgagttcacatgtatacctttgcaaagctgccattcacaacttgttttggaactttagggttatcagtataaagcctgagtaacaaaacttagtcatccaatgtccaggctggattgtatttttattttgtgatcagtaattcagcacaatgctggaacacattactcacatttgtcttatgacccttttctgtaatcaatggaatctttaattgataaagcaagtctagggggagagacattttttaaaaaaagctcctatatactgaatatatttgagccctgattatgaagtgagggacaaggcttttctttttgaaataaatgatggaggacatagatatgtggtagccattcatgctacataatttagcattttattgttaatatgtttggttatgggtcttcttgtttggtatttcaacatgttctggactggatatcatactgaaaagtatttcagttctcattactgagtccctgtagtttggggaaaatgtgatcactgatcttgaaggagagaatgtttcagaagcatccggctaaggcaggattgtagagatagtcttgattttatactttggatttaattctgatgagtcattttgtcacttgtgtatgcttaactgttacctctgtgcctggcaagagctaggtatgagttcagcttttactttagtcctgaaaatttttgttcccagtttaggccagtgaagaagcacttatgattggacttgtaattttctcattttaaaaatgtagataatggtcatcttcattgggtcatgaagattaaataatatagtgcccataaaatgcttagcaaagagcccatcacattaaaagtgctcaataaatgtaagcttttagtaaggttattttattcttactgtttgtttcatcttactttcttgcacccctccttcatatcctaagttcttcttcaggagctaggttggccctgaggaactcgctggttgtcttggcctaccaggagagtttgtttaggccagttacaggagagatttgtgagaatgattttaggaggcaagtcctcatttagtcagcttgggtgcgttttacagttcatcctctcttagaattttttttttttttttttttttttgagaagagccagccttttgagagagcatatgactcttcctggactacaacagcttcttgtgtgaatcacagcccggcttttgccagttagtctgagtagataactacccacccccactcccccaagctgataattattaccctggtttatcctctgtctcatttcccctctcaagctgttagagaatgaatactgaatactgtggtgcactgctccatggatataaatgtaacagcagtaatatttacaaccaatgtctaattggctgtagcttgctttcagtgttcagtctaaaccataggactatatatttgtcttagcataatgccgaacatgcaagtctgcttaaactatagtcttaagatttgtgtgttttgggtttcctctacttcctctatttcctgtcttttttgggttataggtcagatgggttctactttttattcccatttcagactgtggagagcttctaaaaataccagtgtccatccctgcccctaggatctagttaatttttaaaagctctctgtgtttcaaatttgcatgtgtttctgtatgtttgcagtatctccgtgtgttttcaaatcttctgatggagcacttcgtgtactttaacccttggtctttccattgcctgtcccatttttaaattccctttttagtcttaatagctgcttgagttaggacctctggaagcaaaagtgggataggatgctgacggggaattgtaggcttgatggaagaggatgtttctatattaaatgtcatggcagatccagttctaggcatacctttaaaatgtatacacaggctgggcgtggtagctcactcctgtaatcccagcagtttgggaggcccaggcaggcggatcacttgaggtagggagttcgagaacagcctggccaacatggtgaaaccctgtctctactaaaaatacaaagattagctggacatgatggtgggtgcctgtagtcccagctgcttgggaggctgaggccggacaatctcctgaagctgggaggcggaggttgcagttagatgaactgacacaccactgcactccagcctgggagacagggtgaccaaaaaaaaaaaaagaaaaaagataaaaaatgtatatgcaggtgggctttctcccctcaagattctgaattccttgtaagtgtcttctagtcgctttaagctcttgtggtcgtctcttccttagtgtactctccttacatcctttggaagtttagattctagaattatttacttggaatgcagttacattccattctaaacttcctttcccttgggtttataaaaacattggtgggttgtgaattgtgaccgacattgaaaaaatacaaaagaatgtggtaataaactccagggtgtatcccatttgtatgggttgtttctaagtctagcagtgcctgctagctggtaatctttcactttggattttttgttgttgttgggacagagtctcactctgctgtgctgggattacaggtgtgaaccatcatacccagcctcgtggtggtattatagatgcctgaggctggataatttgttattgtggggagcgtctcatacacagtgcggtgctgcaatcccagtctcaggtgggattttcccacctctgcctcccaaggagctgggaccacaggtgtgtaccaccccacctgtctaatttttgtagagatgggtttggaccatgttgcccaggctggtctctaattcttgggctcacctagacctccgaaagtgctgggattacagatgtgagccaccgtacctggccttcactttggattttatcaggaaggaatattgtacatggtgaacattttgtagaaaaataccaaagtagatttatatttattgagtgcttactctgggtaagggactgttttaagggttttacgtgtgtgtgtgtgtgtgtgtgtgtgtgtgtatgtatatatgtatatatatacacatatatacatatatataaattttttcttttgagacagggtttcactcccatctctcacactggagtgcagtggtacaatttcggttcactgcaacctccaccctccaggctcaagcagttctcctgccttagcctccctagtagctgggactacaggcacatgccactgcacttggctaattttttgaattttttgtagagagggggtttcgccacgtttcccaggctggtgttgaactgggcatgaaccaccatgcctggctatatgtatattttatttaatatgaaagtcagtatagcaaaaatgttagtaaccctcctaaagttaaccaactcactaaatgaatgattacatagtcctcttcctttaaaggcctgtgggtgaccttaggtcctgctgatcttatttatttttttgagacggaatctcactgtgttgcctaggttggagtgcagtggcgccgtctcagctcattgcaacctccgcctcccaggttcaagcgattgttctgcatcagcctcccgagtggttgggatcacaggcgtttgccaccatacacccagctacttcttactatttttagtagagatgggatttcaccatgtcggtcaggctggtctcagactcctgacctcaaatgatcttgccacctccgcctcccaaagtgctgggattacaggggtgagccactgcgcctggtccctgccgagcatttactacccatgccgttctgttccttcagttccattgtgtgcttaccaaggattagtagatacatcttgaatttgtttatgctggttgtacggtcatgtgttgcttagcaatggagatacattctgagaagtatgtcgttaggtgatcttgtagttgtatgaacatctcacacaaacctaggtatagcctactgcacacttatgctgtagcctgttgctcctaggccacaactgtatagagcatgttacagtactgaatgctgtaggtgattgtaatacaatggtaaatatttgtgtatctaaacagaaaaggtacagttaaaatacagtattacagtcttatgggatcactgttgtatatgacaccagtcattgacctaaacttccttatgtggtgcatgatacttgtaactttgcattttaattaaatagcaagtcagtaggcgaaatgattgtgagagattgtttcagtgaaaactaagttgaatgctttaggaagactaaataatagcatgtatactacctcctaagaatctagaacttgttctgattgctttgtatgtgttagtttatgtaattctcaccactcctgaggtacatatgcttatcgctatttgctagatgagaaaattgagtcacaaggagagtagatggtagaattgggattcaaacagtggcagtttgactccagcattgattaagcatcttgtgaaaagttgctgtcaaattaatgggtaagaggaaacttagccgggtgtagtggttgattcttgtaatcccagcactttcggaggctgaggctggcagatcacttgaggccaggagttcgagaccagcctggccaacatggtgaaaccctgtgtctactaaaaatacaaaaattagctggatgtggtggtgcactcctgtaataccggctattagggaggctgaggcagagacgcttgaacctgggaggcggaagttgcagtgagctcagatcgcaccactccactctagcctgggcagcagagtgagactgtgtccccccaacccctgcccaagaaaaaatcaacatcaacaaaaaaagaggaaactaatgtatatgagactgcggaaaatagtaaaaatcttgcataattctgtagtttgcttctttttaaacactttgcattttaaagaagcagactcaaaatcacagtgcactgtgggtgtgattgatgccagtcacacattctgctgttcaaaaggccatgactctacatcaaaagattctagttaaaatgttgccctgaagtgatgctcatggggatagtataagaaacaaatgtgcaaagatgggtagatgggaggtactggaggcctcggaacttcacctttgtgcagtttgtcgtccattggcacacatgaactttggatttggccacacgttttgaagatttgtgctttgcttcaagtttgtttttttttgttcgaaacttagttcccagacaggttttgcatgagaatcacttggagaattttaaaagccaagctccctgtctgattggatttgggagccatgtagtaggtttgaggaattgtccaaagctctgggtgggtctgtggcatagctaggcttgagaactgttgtgtttatctgccgtctcggggaatagttcttgagtgtgttgtgtgttgacaatcttgaggcggagtctcgctctgtcgcctgggctggagtgcagtggcgcagtctcggcttactgtaacctctgccccctgggttcaagtgattctcctgcctcagcctcccaagtagctgggattacaggtgtgcaccaccgtgcccagttaatttttgtatttttgttttgttttgttttgagacggagtctcgctttgttgcctgagctagagtgcaatggctcgatcttggctcactgcagcctccacctcctgggttcaagtgattctcctgcctcagccttctgagtagctgggaccacaggtgcccgccaccacgcctggctaattttttgtatttttagtagagacaggggtttcactatgttggccaggctggtctcaaactcctgacctcgtgatccgccaaccttgtgatccgcccgcctcggcctcccaaagtgctgggattacaggcgtgagccactgcgccaggccctgacaaactaaaatgatcagtgtgtcttccatttagatgcaggttggcattcaaatagaggcaatatatgactggtgaattgtaatttcaaaggaaagcagtaatggatcaaactcttgcactgttctctttcccttgcttaaaaaaaagtctgttccctctgaatctagctttatatagacgtttaaatccttaagtttacttgctaaaaatcacctggggtgcttgttcaacatattcccaggcttcttgcttgaaagttaaaaaattcagcaattctagggttgtgtccaagaatctgtatgttgaacagcaacctcagttgattcttgtactgaggcaagtttgggaataaggtcagtgtgggacggggtttcgatcttttctgttctgttctgctgctttttagctgtagaatcttgggcaggagtgtctgagcctgtttcttcatcttttaaaatagagtaagggtagtacttgtctcttagggaaggaagttcaaattaaataaaatgatacttctaggcagtggtctttaactagtggcaggtttgtccccttccattaccctggacatttttgcttgtcactctgggggtgggggtgttactggcctctagtgggtagaggccagagatgctccccaacatccaagagtgtgtatgagacagctccccacaataacaaattatccagcctcaggcatctataatgccaccactaggctgggcacggcggttcacgcctgtaatcccagcactttgggaggctgaggtgggatcccttgagctaggagttcgagaccagcttgggcaatttagggagatgccatttctacaaaaaatgtaaaaattagccgggtgtggcagtatgcacctatagtcccagctatttggaaggctgaggtgggaggattgcttgagtccaagagcttgcggctgcagtgagctgtgatcacattacgtgcactccatcctgggcaactgagcaagaccctatccaaaaaaaacaaaaaccctatgattgagaaaccgtgcttgccttggtaaatgttggttgttagtaataaagttgagtccctttgcggtttcttctctggcctgatccagggacccctcttactcccatgacgttatgggcatacgtttcacatttattattgggattggtaatcagatcttttaatctcctttgaactttgggagttgctgaaagcaccatatattttataaaagtctaaagtttataacctaaacaatagctaactaaagacaagactcacagggctgaaaggaactcttggtcaaattggtccatctgtccttagggctttaatgggtgtaaatacattgcccgaggtggttaagtattcttttgttaatgaattctggggagaactccccttgtaactgcttttcacagcttggttatttacaaagacttttgattttacctgaatagaaagcttcttttgtcttttgtgtattagcacattgccagatcctgattaggtaggtatttgtgaagtgccttaactaatttgtaccttaaccaggcttcttgctagaatacatgtttctctaatgtatgcctgggtgctaatagtttggtgctatggaaactacttatatttggttattggggagcagaagtagtatgcatgatgaggctaaggtgatgcctgcctggcttcagctgtgaattttagaaatacactgattaaaggtaaatttttttttctgtccttactgctggatttcttaatctgggaggtacttgatggaatttagcctttttatcccttgaaattataagcagcattttgtgtgcactttttcttatacatgtacctttttctgctgtcaaaagacaacatttcaacacattgagtataaagatctaattggattttattattgattaacaaattaggtagcaccccatctataaaaaaataggtgcccattgggcatggtggaacaatcggtttttataaggttgagcaggaacaggaaaacaacatagtacaaaaatgtgggttaacatcaggttacttgaggttattttccttataagggttaaagcagagggaacttccttatgccagctcacactgtctgtctggggatttgggtatcttctttcctgaaggtaaggtaaacaatttagaagtttaacatgagtgactctattttggtttggtctgttagggtctaggagctcggtccaaattagtggccttccatagattctgtttaacactggaaggagggtccgtagtgttgcgtgtgttagggtgactgctgagagcactgctgaatcctggggaggggcctgcaccttagaactgatcagttctacagtgttagaaacagacctcttttgtcagaaattaagaattcagaaaagttcaaaggatataattaaagtttttttttttttgagacagagtctcgctctgttgcccaggctggagtgcagtggtgcgatctcagctcactgcaagctccgcctcccgggttcacgccattctgctgcctcagcctcccgagtagctgggactacaggcatgtgtcaccatgcccggctaactttttgtatttttagtagagacagtgtttcaccgtgttagccaggatggtctccatctgaccttgtgatctgcctgcctcggcctcccaaagtgctgggattacaggcgtgagccaccacgcccggcctaataaagttttaaaataaaaaagttagacatagctagggtcacttttatgattttggcatataaagagttggcacttataaaatgtacatggttatgtaaatatgttttgtgttttaaaaatttaatagttttgaaattttctttttgatattgtgaaaggaaaataaatctcggtatctccaaattactaagccaaagggaaaagtcaagctgggaactgtgtcaggcaaacctgcctcccatttttttcctaaataagatagctagaaaaataaaaatgctacatacctccctaacaatttgcccacagggaaattccttgtggacaaagaactcaaagccatcccctctgttcacctaagacaaatgcgtatctgattgcttcctctgccctgttgttttgctaagccagactgaggcataaatgactatgcctctactctcttctcacatggaacttgtgtattcagtgaaaggctaatcaagagacttaaaagaatgcaactgtttgtctattatctacctatgacctggaagccccctcccctgcttccagttgtccggcctttccaggccaaaccagtgtgcatcttacacatattgatgtctcatgtctccctaaaatgtgtgaaaaccaagctgtgccccatcaccctgggcacataccatcaggacctcctgaggatgtgtcacgggcacgtccttaaccttggcaaaataaactttctaaattgattgagctctgtttcagatacttttgggctcacagtatttacagacataattcagccctaatctagctgctgcatttagttgcatagtgtgaatatttcacattttacttttacattttcataaatgggtatatggattatttaggttttgttatgaacagagctctgaatatttatttgcctcgtcctatacaagtttgataatttgtctacgttacatgcccacaaattgaattacaggattcatacacttttttatttttttgagttggagtctcaccctgttgctcaggctggagtgcaatggtgcaacctcagttcactgcaacctccaactcccacgttcaagcgattctcctaccttggcctcccgagtaactgggactacaggcgcgtgccaccacgcccagctaatttttgtatttttagtagagacggggtttcaccatgtggtccaggattgtctcagtctcctgacctcctaatctgaccacctcggcctcccaaattgctgggattacaggcatgagctactgctcctggctgattcgtatacattttaagggttactggctattcttacaattatttaatactaagagactctaatttctgcaaagcagatgagtgcaaaataaccagttataatgtttcccaagttaacagaggtttagttatttttaaaaatgagtttattggccatttcagtttcttctccgtaattgcgtatccattttctttgtgcagtttttggttggatttttgataggtaattcttcatatgttgtgtatctatatactttgttatgtgtacattgaaattttgtttcccagtccgtctgggaaacaagttacttgtcttttaaccttgtttatagtaataacttattctgaagaagcacaggacttgaaccaaaggtggagagtttaaagaactacatccagtattctttaccaataagaaatgtgtggccaggcgcagtggctcatgcctgtaatcctagcactttgggaggccaaggcgggcagattacctgaggtccggagttcaagaccagcctggccgacatggtgaaaccctgtctctactaaaaatacaaaacaattagccaggtgcagtggggcatgcctgtaattccagctactctggagactgaggcaggagaatcgcatgaaccctggaggcggaggttacggtgagccgagatcacgccactgcactccagcctgggctacagagcgcgacttggtctcaaaaaacaaacaagcaaaaagaaaaaaaaggtgtgaccagtcagtcttctttgcttttccatcttaagacacatagaagtgactgagaaggaatagttatgcaatgacatcggtttaataatcagttcaactgaagaatgtatgtaaataagggcagtgatacctaacgctgatagttgatagtgtggattgcataattcagactgtggggtgatatcttacacacgcacatacacacacacactcttgggctttgtcttctttataggtaaggattaggagaattttgacatatgcctgacacaaaagtgctccgtaaatattagctattgtatcactggcaggaagttagcctggaaataagttttatggaattccagtgtagattgctttgtgattgttttgccagattttgctttcacccacaaaaacactaagctctgccaaccagttcggccattttgtaagttagcaaaataaacactaaagtgaaatggcggcttttgggcggggctcccacaggctggctccttttaagtggaatgttgctgtgctgccctcttgtggccatttgggaaaccgcgattaaaaatggaacagtaagtgttaatggcacttcgtttcaaagtccagttccaagaaggttaatcactccgtttttacctacttcagaaagtattttgaagagataccaaattctttttatccacaagcaaaaggaagtggtaaacctttttctcatcagcatttatttttgattggaatctgaattcccagttttgacttgtttttttatctgtgtgttgtattttccttttaattatttgttaagtaaaaaattataaaagttgtttgcaatttagatgttgaataattttcagatagttgtttttcgtgaagattctgtatatatgttggatagtcattcctgaaaatccaatgtttaattgccctgtaactagtaagccactggtagtcagctaattttattactttgttatttaggtgaaggcttaaaggactccactcactaactcagtttgaccctttctattagtcttgtgggctttctgcctcctctactaaaccagcactaaagctacagcttagtactaatagtatttactattataattattaggtattaatggcaattctacatagtcttttaggaaatgtcgtttttttaagggaataatatgaatatatatatacgtatatatacacatgtacgctatatatacacacatatatacacatatacatatatatacatacacacatatatatacatacatatatatatatattttttgagacagagttttgctgttgatgcttgggctggagtgcagtggtgtgatctcggctcactgaaacgtccacctcctgagttcaagcgattctcctgcctcagcctccaaagtagctgggattacaggtgcatgccaccatacctggctaattgtttttttagtacaggctgggtttcaccgtgttggccaggctggtcttgaactcctgacctcaggtgttccacccgcctgggcctcccagagtgctgggattacaggcttgagccaccatgctcggcccataattacactttttttttttttgagacggagtctggctgtgtcatccaggctggagtgcagtggcacgatctcattttccatttccagtttatttagtgattattcctcttacgagaagtatgaaaattaagtaatgactttgttaaggcttttttttttcttctttaagcagttcccctcattagtacttgtattcagtcttacatctgattctggttccaaaaacaatttaaaaacacttttttttttttggagacggagtcttgctttgttgcccaggctggagtgcaatggcacgattgcggctcactgcaacctctgcctcctgggttcaagtgattcttctgcctcagcctcccgagtagctgggactacaggcacactaccatgcccagctaattttttgtatttgtagtagagatggggtttcaccgtgttagccaggatggtctcccatctcctgacctcatgatcttcccatctcagcctcccaaagtgttgggattacaggcgtgagccaccgcgcctggcctaaaaacactttttaaaaacactcattcaaatctttgctggttttgtgtagggtgggatgtacttgccgcccttggtttggatttggctctcatgattagacttactttagacaattaactagtttagacattaaaaatacttaaggtatataatgaagtgctgtgaattcactattaagcttcactactaagtttcagtcataaaatgtcactagtatcattccctgagagcatctgcctccctcaacccctaaaggcaaatatagttgtgaacttggtgttaatcttttcttgggtttgattttcattgttgttatttttgaaattacacaagtaatccatggaactcacaagtatacttcaaataacccatccctaacagagtaaaccagtgttagcaatgtggtgattaaaatgcatttatacacatagatatatgctgacagaaaaacggcttttttttttccccagaaggtattgttgtgtgcattgttacatttctaggaatcactctcctacacaaactcaaaaacacatagctgcacaagaagatacgtagaaagaaagatatttatggttacagtcaacagtttccaaatacaaatactctactcagaaatatggaaagtgtatcagagatatttgcaacttattgattaagtgaaaaatctgaaaataacctaaatgtaccgttaataggggaatgttatataaaatgtagtgaatttatagtataaaccagttcaaagggaatgagatgggcatccatatagacatatcctgatgcgggcattggcattccattacatcctatctgcagtgcttcccacttttcaacacagaacactataaacatttctagttgggctgttctagttatcttcagtaaactaatgctgccttttgtgggtctctagttggtaaagattttcagtctttttgttgctgttggagttttctgtttcctagtagtgtgtagacctgttgtctgtgacagttttattggtggtgattgccaaaacatgattctattcttaaacttttgtctggagttaaacattatagtagttgaaaaactaaatacgttatttcaaaggggaggcaaattgcacattctagcaaatgaatgtgcaattgaatccttctctaatataccaggcacaaagaacatcaaaggagatatgcttagtttgcaagtttattggggaggttgacaagcggccagattactcgatagtatgggacaagtggaggcaaggtagtgtagatgttaacagctgccggagctttggagtgagtctttctaggtcagcatgtgtgtcattgctaaaagtatagagagccagcagggcatggtaattgaagctcagacttgagatgtggctgcctgttttccatctcggtggtggtaactgctgtgacatatgtcagtattgtggaagtatctgataggtattgagcttaggataggagaccaaaggatgttttctgggagaaggtgatacctaagcccacaaaattagagaggtatttaatttgctgtgtccgcagtgggtgcaggagctagaggggagcaatgctaggtctagagtctggagcagtgggggtgagggaagaaatgattaagtcatgtgccttgagaaattgtcagaggccaggttttatagggcatgctgaaattggatgttatcagtgaccagaagacccggatgcctgggaggtgaacaagccttcagctgcctttgctatgggaatacagtttccaggtactgccttgcctaacatccctttcaagtagactgccctttctattaaataaatcccttccttacttacaaggaaattctggagctgtctctgtacctgtctgtccatgaacaaatagtggaggcaaaactaataaattccagctagtgtcatggattgtggggtaacgactcactaatgggtgttagctggggagaattttgtgttagaaggggaatctcagcttggatgtgatatgctcagatttcctgtttgggtagggctttggcatttatagggcactgctttcatagctgccattagatgttcttatgacactactggtagatgtcacataggttgacacaagttaaaagatgacacaggcctgaggtgagctaggactgaaatggaagctgcgatgccagagcccacagcttttaagtgttcctatcactatccagctctcctcttccttttttctttcctgttgacaacctgcctggtcacaggtataaagtaaatgactcagatgctttagtcacctggactagtcagcttggactgtgcaaggggttaaggagtcagtaattgtaatgaggtcttgaaactgttgagtcacttgttacaaggaagcctgttttgggaccttgtgtaacagggataagagttaataatgttttctgagtctctaatcttttggccccctatggtaaaatagaaagaaatgagctttagatccacacttggattggaatcccggcccctcaccctcttcctcaatttctagttttgtccattggccaagttacataaaagaggtcagtttttttcgtcattcatatggtgataataatgcctaatagtattgtccttgggaataagcaaaataatacatataaagtacttagcctagtgtctgatacctgttaggtgatcaggaagttacatggtttttctcatctttccccacttcccagtattgagaacctcccctcgacccctgctctcccattttttctcattgcttcctcatggtaactgaaaggcctccgtattgtaatgtgctgtggatcgcatggtgttatttgcagcagtcccagtttgcagtgtactgccctgtgcacctctagaagatgcagtgatggtaaatatagaacttccccttaccctttcaggttttgtgccacgtgtcttatctcctggcttctgaactcagggacttttctgttaatgttactgtaggttctgggtttttccttgcccccctcagagcaaagatgggtagtttttaagcaagagtaaacagtccacctcttgctgtagagtccatccgtttgaggtctttttgcttcagagtatcttcccctctaccagcatgcccctcagttgctttttcaccattagaggaagatgaggatattgttttctctgtgcttgagattgatactctatcacccctcagtctctgtggtttctgttttgttcctttagatgacatctacctacttaggttgctgctccctatgggatgtttggaatgaagaagggaagggagatgtgtggaggccagtagccgtctttattgggttgggtgttctcattagcatcagagtgccctttttgtttacttacttctgttaagtctaccacttctggatctcactgcagattataaggcagggcctctggattgaagttaatgtgtataaatttttataaagctcctcagatgagcctaatttgctcctattagtgagaaccacgattggataattgcaaccagtttgcattcttcctctttgggtgagatgctttgttttttttgtttttgttttttggagacagggtctcactgtgacacccaggctggagtacagtggcgtaatcatggctcactgcatcctcgacttcctaggctcaaatgatcctcccacctgagtttcccgagtagctgggatcgcaggcatgcaccatcatacccagctaatttaaacattttcttgaagagatgggttttgcatattgtccaggctggtcttgaactcctgggctcaagcaatcttcctgcctaggcttcccaaagtgttgggattataggcttgagccactgtgtccagcttgttttttttttttttttttttctggagaccaagtctcgctctgtctctaggctggagtgcagtggcgtgatcttggctcactacatcctttgcctcccaggttcaagcgatccttctgcctcagtctcccgagtagcttagactgcaggtgtgtgccaccacagccagctaatttttgtatttttaatagagatggggtttcaccgtgtggtccaggatgctctcgatctcctgacctcgtgatccgcccgcctcggcctcccaaagtgctgggattacaggcatgagccaccgcgcccggcctgcttggtttggttttgttctgtgttttgtttttttcttgttgagaggggaatgatacttaacagataagacttcgtggattcatatatatctggtttcaaatcttactgtgttaactaggtgtgagagttaaatacttatgagcctcagttcagcctcatttgaatgaaggggacagtaatatccatgttcagagtttctgtcaagagcctgtccatagaaataacctgttctgtagcatcatgtaaacattcaggaaagggtagctattggggattttgagaatggtagcaataacgttatttggaatgtaaaagtataaatgtgaatttgaagattttggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaaggtatctactttgccctgcagtacaaatgtgctgctagcctaggacaagctagcagacctttgttgttcatgaaaactcattagtatatcttgatgatgaaacctacagccattttttctagtaatatacagtagtatatctgaggatacaaatgaagacttctttctgctctattaaggaaaataaatgacctgaaccatccaattatagggaggaaagacaaatttttatacgcttggtttttaactttatttatttatttttgcaacagagtcttgctctgttgcccagcctggagtgcgcagtggcacgatcttggctcactgcaatctccgcctcccaggttcaagtgattctcctgcctcagtcacccaagtagttgagattacaggtgtctgccaccacgcccagctaatttttgtatttttagcggagactgggtttcatcatgttggccattctggtcttgaacttctgacctcaggtgatccacctgcctcggcctcccaaagtgctgggattatagacctgagccaccatgcccagcctaaaatatatttttaaggttaaagtgagcagttccggaaagttaataatatgtagttataggttggatggacctacaagccagtcagaatgattgcactgtgcctttgataatcattatcctaaaatgagaacttctaaggaaggctcttggttttctatgtacacctccttttcacatggtagctctctgtccccctccaaaagcttattactcatgtaagagtactcagtagtgagtaactccacatagtagatttttcatggaggagttgacttagatatcggctctcaaaaggacaaataagaacacaagataattttaggatgtaaacattataatatatgctgtaataaagtcataatagttgagctagaatgcctggctggtatcttgaagtgataaaactagttgatgtagtaacactgaaatgattttgccctcccagttaataagggctccataaaaacctgtgttgagtaaaaactttcatagctctagcagagggccaggtgtgggcatggatagacaggctagagtaaagcgcactttccctccttcctttctctgccaggttttttcagagtgttttatgtttactgcctctacctatatttcctaccatttggttattcctaactccttctgtttggaccttttgtcctttaactccaaggtgatgctaaggccgttacagaatctgtggactttgggttatgtgattacattggattctagttgtaaaatgcctattctgggccatcttttcttttgaagccttgattttcttcagcttacttcatcatttttatgttgttgttgttgttgttaaagtcattgttgataatgtcctttcttagtgacattgttggatcatttttcataaagatgagacagggtcttgctctgtcccccaggctggagtgcagtggtgcaatcacagctcactgcagccttgatcttctgggttcaagtgatcctcccacctcagcctcccaagtagctgggactacaggcacgtattgacacacctgtctaatttttaaattttgttgtagagacaggatctccctacgtagcccaggctgatcttgagctcctgaactcaagccattcttctgcctggacctcccagggtggtgggattacatgcctggccctacacttttaaatacaaacatttcacaagtctcagctagtggcttcttttgtgcatgttctgaaccttacttttccaaatattctcatgacgttagctgtcacctgtaatttgataacccatatttctcatctcagcttttgctacttgcttaatttctgttacaccttttcatgtcagtgttccacaatccattcaaattccttttgcttatgtgtgattctgttaaaagaatacagaatatacttagtagtagttatctctggggaagaaagtgaaaatgatttttctcctcaactaatctgtcttttaaactttttaaatcactggtgaggattgttacaggtcttaaaggttgttacaggtctacaaaaatcaggtcttaaaggcaaagggctaattactgctacagaataaaaaatagatgtgttagagaaagggtggcagtggttctcattctgagaacttctagctaagtgttagcaatgcctcatctgcgtttatctgggatgttacatgacctgaggaacttaaagaaaaatacaaattcctgattcttacttaattagacttaatgggggctttgccgcttgtattttcagtttcacaggtgtgggttagtgcagtcaagactgaaactcaaagcagtagggaatttaaaatgtatcagtaaatactttgtctttagtggaagcagccgctgtcttacctttctgtattattcagctgtatattttaatgatgggtaagcggtgtaccatatagatttatagctgttaagtaatgaagacattgttaaactaatatttcctaggataatatgcctattttaaaaaaaatggcgctttattgtctcataaatagaactagcaaaacaacccttttgatacttggttacttgaattctcttcaattgcaataaacgtttgataataataatgggggtcaagaaaaaagattaatgcgtggtctcttaattttacagatgtgggaagaatatcctgatgtttatggggtcaggcggtcaaaccgaagcagacaagaaccatcgcgatttaatattaaggaagaggtaaggaaaaaatgttttaagggcatgcatttaaactccctatcttacttcattctttctgactctggtatgtattaccattaaaaagactgaacttcaggcatgagggttaagtgactctaatatgagctatctatgaccagatacagtaaggcaagaagttaataatcaaataaaagaatctaaccagaaagatcatataatagtgaattttttagtagagtattatacagaactgacctcaaaatggtttattttttaagttgtctctcatagtgaaaattgattatatatagcaagaagtttacctttttaagcccctaacttctaaatctcctagatatttattaaatgggtaacttgtttggtaaacaaacagagcaatagaaatagtttgggatttattcctgaaagaggagggagtgcttaattaatgtatctacttttatttaacttcttaaatttggtttccttgctcatttttagtgtgagatataataaaatgagtttcaaacatacttactctaattgtgagagattgatcagtgatttttttaaattggtattctataccaggcttggttgtctatagaatcagacttctttcacctttctcattttgtgtgatatttttgtggattcttattctgaattaggtttatagactagatcctgaagagagattcttttgtctcaatgaaatgtctactttctgctttcttgggaggactttgctagtcttagctatataacgtacttctgatgaaagttaaatattgatagccacaggtcagtgagttgggtgtgggtttttaaataaatgtaccttaaaaatctaattcaccctaacatctgcattacatttgtgatgttttattttgagtgacctctgagctgttttgcctttgcttttgttttccatagtgtctcgcactaggttactgagccatgtttgttaaaaccaatcacatagttgtagaaatctttccctcttttacatattaattaacacattctctgtagggtacaagattaacagcaataggaatagtttgccattttccttaattgtggagagaaagagctactgaaatgtctgtgactgtaagctttccttggcctagtgctgttagcagagcactgttggctcatgagtgaacatactcttaaatgagtctaaaatgaatacatcagtagttggtgcctttaaggcacactgactaaatgttgtggcatttttatttgatagtctcaatctgcagtatccagtatggtccccactactcacatgtggcttttaaaattcgcattagttaaaaataaaacttccatttctcagtcacaccagtcacattttaagcgcttggtagtcacatgtggctgatgggtactgtattggacattgtagatacaggacatttacatcgttgcagaaagttattggatattgctgttctggaagtcaagctgagataaatatttcctggctttagagataactcagtgatagcagagagatattaattttcaaatcaaaagaagagggagttccaccaagcaagtgcttaggtttctttgtgtctaaaagctcatattgaataatggtatattgagtagactgttgatccaggagatagtgttgtcccgaagaactgtgaattaaagtctgtaatcatttttcccccctcacacactgaaggcaagtagcgggtctgagagtgggagcccaaaaagaagaggccagaggcagctgaaaaaacagtaagtctttcatgggggaaattattcaatctagtagtttcaaacttgtcagcatttctaggactgccttcgttgtgtctttagtctactccaggtcccttagtctgcttctgtctctcttactagctcgggtgactgtctaccttgacctgttgcaatagcagcagcagcattggaaactcaagattctcagtttaacacatggaaggggtccacgtatactcgagcttttgcttgggataaatctcagcttcttccatcgggttaacccaattagcccattgatttttttcagaaaaatatgtataaataacaagtacacaggtatttggtattgtagtaagcaaggaacaaatgtagatttgctatttttatggcaaaattatattggctgaacatccattttggtaagaaattacatattgttgtttctgtataattttaatgttgcagttcataagccagaaaaatttaatttgtggacttaatgtggagtttctttataacatagatttatatgttgattttttaatttaaaaagttcgatttatatgatatgaaattatttgattttttttgagaaataatttttaaagtcattttttggagagggtgtggatcccgttgacaatctgaattctatagcttctctcaaaaatgtagatattcaaaactttgtataccagttcaggggttctcatgttaaacagttgtccatggcttctattaagagctctaggtacatatgctctgttgtaaaatattattactctttagtaagtggcctaaggcaagtcatttgagattttaaaacccatttcctcatctccaaaaaaaaaaataataccatctacccaacaggattattagaaactatgctaagattttgtgacattaaataaatgtagggtattacagagccttacagaaaagtacttaattttgccctgctagagcgcattcagttttcatttgtgttttggagaaatagtaactgtaagcaaacctgcacttggcatcttagaaggcttttgttctgccccagtctcctggtctgcttgggagactattatctgcttactggtctaatggccttttgagtatctttcctgaaatgtccaccttgattacaccctgggaaatccatgcatgtaatcattacttcaccatctggctacattcctttggtctcttgactgcaagttaaatggtgctatgcttgaattcttgacttcctattttaatggccttatttgtgtgtgcagaagccagcgtttttttcagtcactgtataatacattgcgcttactctggttactggctcatagtcttgtcagcctttttgttttgttttgttttgagacagggtctcactctgttgctcaggctggagtgcagtggcttgatctcagctcactgcagccttggcttgctggacttaattgacccacctaagccactcgagtagctgggactacaggcatgtgctatcatgcccagctaagtttttaaaaatttattgtatagatggggtctcactatgtttctcaggctggtttcaacctcctgagctcaagcagtcctccagcctcggtctcctaggattacaggtgtgagccactgtgccccgccacttatcagtcttaagaattccccaaagttggcaaccttcagtagcatatatggacctttcttttcctgagtagaacctcttagttccttgcagagtgggatctgtcttctttttcatattgcttccctaccctagggctgttcataggaactgccttgggctgagatagttcccctcatgttcctgtgtttgggcactgggctagccttcgtttctgctattctctggccagctggtgagtattgtggatttacagagagctcttctcctgagtcaccagttgagattcctgaaagattaattaggggaggtcttgtagctgctgacactcaagttgcaaggcactttaggagccttctgtgatccaagctgagcaagtgtaacataacctaatgtgtggtcacatgcatttcagaattcagactcactcagagagtgaaaggtttgaaatattggcacaaagaaatgcttttctgaaaccctgcagattttattcacacattttagagtttttaaaaagggaccattttgtaaaattggtttaaaaaaattaattccaaactttaggaaagttgcaagaataaaagtgcagtacaaaggacaccttatatactttacccagattaccatttttcctccatttgctttattattatgggtgctgtttatttaagagagagggtcttgctctgtcacctaggctagagtgcagtggtgcaaccttggctctctgcagcctcaatctcctgagctcaagtgatcctcctacctcagcctcccaagtagctgggacgacaggcgtgcaccaccatgcctgattttgtatttttgtagacatagaggtctcactacgttgccctggctgttctcaaactcctggcctcaagttatcctctcaccttgctctccaaaagtgttgggattagcatacgtgagccactgcacccagcctgtgtatatttatatatatacaaacataatgttttttatgaactatttgagactaaaattcataaaattttaccttttatccctttaccttaaatatgtaaggtgtatttcttaaaaataaggattttctcttttataagcacagtacagtacagattcaacttagatttaaaacattgctgacgtacttttttttttttttttttgagacgcagtctggctttgtcgccaggctggggtacagtggcgcaatctcggctcactgcagcctccgcctccggggttcaagcaattctcctgccttagcctcccgagtagctgggactacaggcgtgcgccaccacgtccagctaattttttctatttttaatagagacggggtttcaccatgttggccaggatggtctcagtctcttgacctcgttatcagcctgtcttggcctcccagagtgctgggattgcaggcttgagccaccgcacctggctgctgatgtacttttgtctgattcatatttcagttttgtcaattaacccaataaagtctttcataatatttttccatctctactacaggatctagtttagggtcagttacatacaattagttgcacatctttttttttttttttaattgtactttaagttctagggtgtatgtgcacaatgtgcaggtttgttacatatgtatacatgtgtcatgttggtgtgctgcacccgttaactcgtcatttacattaggtatatctcctaatgctgacccttccccctcccccccaccccatgacaggccacagtgtgtgatgttccccaccctgtgtccaagtgttctcattgttcaattcccacctatgagtgagaacgtgcggtgtttggttttctgtccttgcgatagtttgctcagaatgatggtttctagcttcatccatgtccttacaaaggacatgtctgatttctttaattgggagcactttcacagccttcttttgcttttaggacattgatgtttttgaagaatgcagtcttgcaagggactgtgttctttgcagaattacgaagagaccaattaccccgtcacgatttgtattaggtttttattttttgggatggactctcgctctgtcgcccaggctggagtacgatggcgcaatctcagctcactgtgactcaagtgattctcctgcctcatcctcctgagtagctgggattacaggcatgcgccactgtgcccagctgatttttgtatttttaatagacatggggtttcaccatgttgcccaggctggtcttgaactcctgacctcaggtgatccacccgcctcagcctccctaagtgctgggcttataagatgagccaccgcgcccggcccctttttttttttttttttaagttaaagagacagggtcttcctctattggtgcacatgtgtggccatagctcactgcaaccttgaactcctgagctcaagtgatcctcttgcttcagtctccccagtagctgggactgtaggcacgtacaaccacatccagctgtattcatacttttaaagcttagaagaagttatacagcacaatggacctgcacaatatttaaaatatttttaaattagttagcatcatttaattgagagtgcataacaatctgtgtttttagcttcttttgagaaaatttggtaatgctggcttatgtaacagtgatggaccaggagttctccattttgccttgtttgcagttctcatctggcccctgtgagtatttgagattgtaatctctgacttagagtcatacaaacaaacaaaacattgaactttttttaaccaactcagatgctgttttgattaaactctttttttcatgcattacctcttaatgttatccaaattgcgcagtgttgtataagatttttgttgacttctggtcctggtggttttgttttgtttttgtttttgagacggcgttttattcttaccaggtgggagtgcagtgcagtagcacattcacagctcactgcagctttgacctcctgggctcaagtgattctcccaccttagcctcctgagtagttgggactgcaggcgcacaccaccacaccaagctaatttcttaattttttgtaaaggctgggtctcactctgatgcccaggctggccttgaactccttggttcaagccatcctcccaccatggcctcccaaagtgttgggattacaggcatgagccactgtgcccggcccttttccagtgttttgaattggagattgtcacatacctgtaacacagtggaagggaatccctattagcctcagatttctgttgatcattggaatttttttttcaaaagcatgctttcttggggaaatctactgaagactgaggaaacaaaagtagctacttccctcttccagatgtcttctaagtggaggaaaaaggagttttcttttttacagacagttaatagcaagccttaccaactcttggtcaaagttctggctcattatatttaaaagtagcttttgttcatttcctactttacagttgattagatttgatttgtctgtcttaggatttgtgtctagccaaccaccttttcccaataaaggaagaaaactatacacatttaaattgcattttgactttttccatgtctatttacattgccttggggcctcttggctaaatcttggtatttttctccctagttctcaaaatttcgggaaaaatttagttgaattatgtgtttttacagtatctaggggggactctgttaatggcctctaaagctggatattgtaagtttcctttgatagacattttttgctcacgatctcatatcttaaactattctttattgtagactgacttacaatgtatggcttagtggtggagtcttgataagatttgcattttataagaggccagtaatgtaggagaggacagcagtttcacatgtgggagagccttatacatctgtagggttgggaagtaatttctttgtaacagctcagtcacttttttcacttcacccattcttcacagtgacttagtattgctggtccttactatcttttttctcgttcttgaaaatgaaaagaaaacgtgaaagaatccaaccaatttcaaatatacatacacacacacttaggccttttaaaccttgagtttttcaaatactcccaggacgtgtaagcctggctttaatgtttcctgattctttggtcctcagtgagttatgattgaaagtagcagggctgagggttggtgatatggccaagcaactcatttcctcactgcacttcagtttccttctctgggaggagaactttggactagttgatttgctaagttttttttttctttctttctttcttttttttttttttgagaacagagtctcgctttgtcacctaggctggagtgcagtggcccgatctcggcccactgtaagctccacctcccgggttcacgccattctcctgcctcagcctccagagtagctgggactacgggcgcccgccaccacgcctggctaattgttttgtatttttagtagatacggggtttcaccacgttagccaggatggtctcaatctactgacctcgtgatccgcccgcctcggcctcccaaagtgctgggattacaggcgtgagccaccgcgcccgaccttttttgcattcttatattgggagattctaagtcctcctggttgttcataagtctgtaaatctgtaatctaactggaaaactctagcctcaacacatccattctctgtgtttgctgtctgctatacttatagaagtggacctcattggtggccctggtttaggttctcaattcctgggggagatatggtaattagaatttattggtgaatctttcttatctgaaggactagctgttcatattccttcaagcatgcttctacttctctccagtttgactgtgtaagccccctctgaggggtaaactgttgtggacttggtctgagggagactgcagactcatgctggtctcccacttactgtaaacatcttcctttcttccttcctggtgatcaccttatattccttggattcttagcaaacatttattgtactatgctccggggaagcagaattagaccagtgtccagagtgtatatacgaaggtctttgttttaaagagactgaaggatattaggcaatactaacaggcctttctgtcttaccagaagcacccctacccgtctgactgatagactaattgcgcattctttcattgatttttttttttttaacctaacaaagaaacatctccatttgcctgactttggctaaactctggtacaaagacgaacaaaaagtcttggtgtacaaggacccatctactggggaaatgcatatggaaacacgcagtgctagtagaagttgaataatattcataaaattgctccactgaccgtccgtggaaggcctgaattgttgttttttccccctaaggtctccaccaattcaggtttagggtgaccgttgtagcttttaggaaggttctcaatctgcacatcagccacctcctttcaataagctttcaccattacttgacctgttctcccatgaagaatattgatttgacatttgtcttgttgtagctgttgtctttagtatgacctcattccctataaagtgacccataggcaaattggtaattgtttgatttacagagaagccccaggcacttgcctgtcagttttttcctaggtatttcatgcctagcagctattacatgtttcttccctcttctctgtaggtgagaaatgagtggggtccctgcaatatcttgttggattttcaagtaaactaaaactgtttgggatagtaggacgcctgtaggttatggctctttcaagccttctaagaattcaaggagcaaaggaacatctactgtatctaataattattaaaaactacatctttagctgaacagattagttatatgataggtttattgttgaaaaataattttagggactgtttccttaaatgtattctagagacttaaaatatctagtatagtggttctcagagtttctacccagtatcagcattacttgaatttgttgaaattcatattttttaggcctcaactgagacctactgcatcaggagctctgactagggcccagaaatctttttttttttgatggaggaggggcagataggggcagggtttcactcttaaccgcctagggtggagtacagtggcaaaatcacagctgactgcaacctcaaactcctgggttcaagtgatccttccgcctcctcagcctccttagtaactaggactgtagacatgctccaccaggcctggctcaattttaaaattttaactttaatttttctggagaggtgtcttgtattgctcagcttggtcttgagctcctggactcaagtgaaactcccaccttggcctcccaaagtgctgagattacaggcatggaccatctcacttggcccagaaatcttttttaacaagccctttaggtggtcctgataacattttaaaattttggaagcactgatcttgtgcatgttatggtttcaatcttgtcaataagagtagtaaatgaaaaaagtacatatatatccatttttatttatttttgttactggagataaaataggaatcgatattatgtagtccaggaaggatcacaattcaagtttaaatggagctagaatctcttttagcatgtctaaaatgtgcatgttctgccctttggatagtaaaattgaaattggttttgtcggattatttatcttgaaggattcttttagaaaaaaattactttgttttgcttttgatcacagagaaaaatggaaacaggaaccctcagaagatgaacaggaacaaggcaccagtgcagagagtgagccagaacaaaaaaaagtaaaagccagaagacctgtccccagaaggtgcactgtttgcttaagatctctacttgggatgagcttaatctgctgtagattgggaaggataatgtcgtgctgaaatgagagctttaatgagatgcattgtgttttgattctgcgttttagatatctgtggttcactttcagccagcctacattgcaggtcttactgcttctttcttcgcagactggctatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatttttgataagacagatggcagcctaagatagtgatgacaggaaaagggagtcagaagacaggccccagggaaaattacctccttgtagtattgcttagaatggactcagcaaactatgccctttgggccaaatttcatccaccacctattttcatatggcctgtgagctaagaatagtttttatagatgaacatttctaatttacagtttaaggatagagagcactaaatttgaactccaattaagtgaaatgttatcccctcaaaaacaattctgttctcattagtagatatatattgcagtaaatgtacctgattatttcattttgaattatttaaaaaaatttgtgaaaatttattttctttcattatgtaaggacctatacattggtccccattttgcctcttggctggcagagcctaaaatatttactctctggccatttacagaaaaagtttgccaacctctggcctaggacattgtacttaccccccaacaccagcaggggaatttgtcaactgaattttatcttattttatctcagcttaataagtttatctcagaactgtcacgccagttctgtcttttagaattttgctcattatttattacatcgttgatcatctgtttaggtttggttatgagaaaggtatgggaggtatgagagaaagagataataaatgtgatcatgagtatccatttctctccctctctgacttctttcacctttttatcactgatggaatatttggggatttccttaggtgagcttctagactgtggctttcaatcctggccatctccctggtctgtccaagttaattctgtgatagggcacacagtctctcaggtagtattccaggtatattttatacacatacagtaaaaacttatgtatagttacttcttgtgctttactttcttcacacagataatagcatcctctgctgcttgttctgtaggtttctttatcctggaaatcctttcgtattagtatacaaaaaactctttttttttttctatgagtacatggtactgtttagtttccagttgaagaatatttagagttttcttaatgttttgttgttgcaaataatgctatagtgaatactttattatgcctgtttaggtgtatatcaataggattaattcctacaagtaaaactgttaattcctacaagtaaaatagtttgatagctatttccagtttgcccaccaaagagatactatcatgaacaacatgctgtgtatgtgtttttatatcaggtaatcctgatgaacatttgtgaaacattcacgttctttcccataaatgattgaggattatcagcattagaatgaccttcctgttggaaatccagatttctagtgaattagaatttcagggagtagggcccaagaatatgcatgtttaacattccccaagtgaaatgttacattctgatgtatgaaccactgctctgggaaatactgttatataaagtagacaccaaatgataaagtgaagacttagccttttgtttctcttctcattttagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttaggtaagttgtaccccagaagtgtttcactggtgtgatgtgataaagtagttggttagattttggttctcataagtccggggttgtgcacttaatagataaaaataacagcctatgtcctgaagttgttttcagaaatctggttagctttcttgcaaaaagagtggtattgagccaaggggaataggaaaagagtagcaatagctcatttgaagccttcattcctaaaaaacaccacaagttcgtgtcctgtccaatggtgacttagtggcattatcttcatttcataacatttttttccattaaagatatttggattatattcctacttctgaattgctctttgaatcacagacgtttttctgaggttcagcttaacgtattgctacttgaatctgattttatcaagtactaataggatatgaagcattaataggaattatcattagtgaaataggccaggctcagtggctcatgcctgtaattccaacactttgggaggccgaggcaggcagattgcttgagcccaggggtttgagaccagcctagacaacagggcgagaccctgtctctacaaaaaataagaaaaagccgagtgtggtggcggcatgcacctgcagtcccagctacttgggaggctgaggtgggagaatcctgggagatggaggttgcagtgagttgagatcacgccactgcactccactccaggcaaaaaagctagatcctgtctcaaaaagaaaaaggaaaatgaaataaaggaacagatatatgcaaacactagtagtttactttatagaaatcaagtatttttttttttagattttacagatttgttcttcatagagatggtgaaaatgaatcctagagatattcataacttattcaatgtatccagttaataattccaaagctaggactgggctttgagtatgctagtgtatagcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgctgggattacaggtgtgagcctccgcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttctttttttgtgtggtagtctacttgtttacataataatctgatactaaaaaatgaaaaaaatagaagtgtccttatagttttctatatcttgcttatacaaatcagtataaatatagaatttttattttcaaattgagttagactccctacagttgtttaggagcattcatcagcactttaggaaaaaaaagtaagctttgagcctactgtaaatggcagatctataaaacaacatgcttttggaaccaaaagggtatggtttcttattctagtgacggttatgtgtggcagtttaattctgaagagatcatttctcatttattcagcattattcctcttgcagttacaaagaagatgatgactttgagactgactcagatgatctcattgaaatgactggagaaggagttgatgaacagcaagataatagtgaaactattgaaaaggtcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaagcaaatccacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtcttggagagagggatttgttttccgagttagtaagggaccaaaacaaaaggatgttgctgctctgtttttattgtttttgaataagggatttctttgatttcacctgcaaatttaggaatatgtaaaaagtggtttacatttttaaaatacttgaaatttttgattgagtccgttctgtgttgtttgtgagtttgtacttatttcaagttgaagtattttggtgcttcatccacaaagggagtcttcagataattgcattcttgggaagctttttaatatctggtgtaatatactctctttcaagtgtacttaatccttttgcagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggtatattttccatcatggattaaagaaatgtatttgcagcctgaaagaagggaaggttttaaaataatgcatggagatcacagctatctagaatctcagattttgctttgatcatctaaacatggagccatttacaattctattttataagattgtgaccttcagatactatatttttatatgtggctaccaagtttttggagttaactagcttatggagcgttattcacacattctttagttttcacaataagtgcatgagatttgtactgttattacccattttgtagatggggagaatacggcacacagcaattctgcaagtggactcaggttttgaattctgatgccctgaatccagagcttattctcttaagcaccttgttattttcctgtagttaggctggggtggcttagatgtagagagttaatattctggaactctctgggttatgatatacttaaaacaaattctggttttatacaatttgcagaaatgatgtgaaggaaattattaggttaactactgaaactgtgatagtcctcgtgtgtttagtttacttacagccttgaatgtctgggtgttgtatatgggaaatatgtggagctatagcacacaaaaacctaaactgggtaataatggtatcaagctcagcctgaagacatacctgtctgtgtggtgtgattagcctatttttgtgtctggaatgtgcatagatttttgtgtctggaatgtggacagtaattctggttttactactgtgcaaaatgtgctactttagtaaattacatgttttttctttgactcaaaactgaaaatatgtaccccttagatggtgaggtaggcttgtaaagcagttagaaatttgaaatcctctgaaatataataattctaatattaagttgctgctgttgtcatctgaaaggttttggtaataagaataactagttttccaagtcatgtttaatcaatcctaaaacccatatatatataagaaaaggcgtacagttttattatcctgatttgttgagatgtatgaatttgccacatgaatctatcacataaaagagttatttttgggtctctttttagacaggacacatcagaggcaggtaactggtatatccttctatgagtgtaaggttttcagtgttctctaaaagtgttttttttgtttgtttgttttgttttgtaaaatctctggcgtaattactagtaaagattacttaaggggcagatgggagtaaaaaataggttttcttttccacctttgacttttgctttgatgtatgtggatccccagactttagtttatgtgtactttttctgtctgtctgccattcaggttagggaaagtttctcctgaagatgtagaatatttcaattgccaacaggagctggcttcagagttgaataaacagtatcagatagtagaaagagtaataggtaagtacatggtaactcacttcagccatatttgaacttgaggaatagtggcttttgcttttggaagtaatgtaaattttaaaaatgcactttggagactagacacgtgctaggtttattttaaaggaaaagctaagaagatttgctggtaaatttggatgtgggggatgagagaaagaggtgttaagtatgacctcaagatttgtggcctaaacatgtagaagtttagaggtaccatttaccgaagtggaaagatgaagggaagagctgatcattggagtggagaccaagagcttagtttgatatttgtaagtttgatttacttcttagtcatctaagtggagaatatagtgaaggctggagcatatgtgaacctggagcttaggactctttagtctgggctggagatttaaatttggaaatttatcagtatttagtatttaaaggccaagattgaacaggaccatcagaaatagagtatcacgtggtaagaagaagtagtctgagagcatttcagcttttggaagtcagaaagaagctagcaaaggagactgagaaagaacagtcggtgagacaggaggagagctgagagagagtggtgtactggaagccaagtgattcacatagccaggagagaggaaatgctgtcagtcaaggacgattaggactgagacttgatctgtgaatttggcactggcaaaacgcatccatggagtggtgagggtgcggcctgattagggtaggttcaagagaaaatgagaggggatagcaagtataaacaactcgttgggggagttttcttacaaaggggaacagagaagtggagtgtcagcctgagagagagatgagaaaaagaatttttttcttcttcttcttcttcttttttttttttttgagatggtgtcttgctctgttgcccaggctggagtgcagtggcgtgatctcagctcactgcaacctctgcctcccgggttcaagtgattctcctgcctcagccttcccagtagctgggattacaggcaccccccacccccaccacgcccggctaatttctatatttttagtagagacagagtttcaccatgttggccaggttggtcttgaactgctggcctcaagcaatctgcctgccttggcctcccaaagtgctgggattacaggcgtgagccactataatcccattttttttttttcttttttaaggtgtgaggtagtagaatatatttacattttattcatagaacccaaaatctttcattcttcattgtgtttataacttttctgtcttattttttatttgtttagctgtgaagacaagtaaatctacattgggtcaaacagattttccaggtaagcaagaaattttatttataaatgttcttcaacatttcagaacagtgtatgttttgcagattattttgttttgccacatgatgttttattgattatgcataaaacagaatgtcatttttcacttttaattgacagttgctaatctataaattttttttatatgaaatagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggtatggtgatggttggcttttgttttttcagggagaagatatactgataaagaggattggacacatatgtgctgagaaaatattacaaaatgaaatgatgattgccattttgaagtgaaagaaggtgatttaaatatgacattaaagcaaaaggagagaatgaattatttcatggctttgctgacttgtttaatcttgcaatttacataattagaaatagagatatttgagagaatacttgaaaggatttaggcacttttattttattttattttattattttattttgagacagagtttcgctgtgtcgcccaggctggagtgcactggcactatcttggctaactgcaacctctgcctcctgggtttaagtgattctcctgcctcagcctcctgagcagctgggattacaggcacgcaccaccacttccagctaattttttgtatttttagcagagatggggtttcaccatgttggtcaggctggtctcaaactcctgacctcaaatgatccacccaccttggcctcccaaagtgctgggattacaggcgtgagccaccatgcccagttgcatttaggcactttaaaagagaagtgaagccagttgcagtggctcacacctgtggttccagctacttgggaggctgaggcggcaggattgcttgagcacaggagtttgaggccaacctggggaagattgtgatacccgttctctaaaaaaaaaaaaaaatagagagcgggaagtgatagaaaaggcgagtgtctttgaattctaagttagaaattaaatatataggcttatttgctagattggctgaataaatcctttccttggaatttattccatcaggaaactgatgtgcttgggtcctcagtaatgaaatatcagacaagtgatacgtctctgagaagttgacattcatgttaatggcactagaattctatctgtgaaaaccagtatttaattgccaaagagtgtgatagggaaaatgtggtcagagaagcaccaatgtagaagtctctgagctccagtggtcattgaatgggttttaagaggaagttgtggttgttgaactgcatctggcccttgtataatggattggtgctgctggctatacagacaagagggggcccagggtattgccctcctgtgaaaggtatcaagagaaagattcttatagttcaataggagaactactagaccccaggggtgaggagaagaggaatgatgttgacaagtacatcaaggtcaaagtgtgtgtgtcttggctacctcgaagggtattttgactttatctcctaggtattcgtacagctgagtacagtggcattatgaaatagttttatttagaaagcttcatgtaatagcagtatataggagactctggagtaagtaattattaaagccagaaggtccagccagtaagatgtcattgaagtccacgaatgaagaagtagtgtgaggacaagggaagtaacagtggcgtggaaggagtggatgggagaacagttatggggtaggtttggtaggagtggatggatggctgggttttggagttgagagtaagcagtcggattccattcactgccagccgccctcatagagaactgaacacatcaataaccttatcaaatattcttattagaatgatacttctcataatgtgtgctatagagcactaatcttcagagaaaagtcccctgaaaaaagactttttggccatgtaactttgagatacatccctgaatgaatttctcctgtaaattcacgctatggacacacatttcagactttgaaaagtcatgagtaaagaaattgtataactttttgatcggttgtttcctaaactgatttggccacagaatccacattttatgcaaaccatagagactgacctcactagaatgctatcctttaagcttctgggggtgaaaacaaccttcccttcagaagcttgtttctgaagggaaaaccaaattcacgcaattaaagggtttaaggtagatgggcggcatttctgaatttacaaatcctgttatggtgaagatcaactgtatttagcatatgacagctggaggcaatgttttgtactctttagaatcagataacagaaagatagttgtttctgaaaaataggagactctgactgccatataatagacaagacctaaagtgctatttaatgatgttcatagatttatttcaggaaaggggcaagttaactaaaaatattttatttgaggatgaactaactctggcttatggaatattaaccatgaagaaaggggtgatggagtgaggtggtgattcacacacatgaaatttaagtttttggccaggcgcggtggctcacgcctgtaatcccagcactctgggaggccgaggtgggcagatcacgaggtcaggagatcgagaccatcctggctagcatggtgaaaccccatctctactaaaaatacaaaaatagccaggcgtgggtggtggcgggcgcctgtatgtagtcccagctacttgggaggctgaggcaggagaatggcgtgaacccgggaggcagagcttgcagtgagccgagattgggccactgcactccagcctgggtgacagagcaagactccgtctcaaaaaaagaaatttgagtttttatgctttgatgccgaatatgtgaattgtggctagcgttttaacatagtagcagtaagaacattttctcagacttgggcttttgtttttcaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagagaaatgcttcctgggagtttttatgtatgtgtaataccattttattctgatctaaagaatactttatttcattatttggtgggtaatttgtcatagccagaaacctgtatcatcatatgttactcatgagtgtatatagcaagttaagtcactcaaatctttaatgtggaaggagttactcagaagaaagaagaagatgtctttttcacatgtattttctttctaggccagggaagcctttaaattaatttcctacagtagtgctgtagagagtgtgattcccctcccttcactccactccctacctatatagtctgtaggattatcctgttcagaggaaggttgaacctgtgaaagtatcctttttataagaccacgttaatcttgggggggtgaaaaaaagatgagacagtgatagcactggaggtttaaaggtacttttgggaagtacttacaaatttccttcaccaatttcaagtagttcctaattactaagtgctaggtgttagaaacaaatgcttgttcctcggtgctgaaaagaactagtgctcaaggaattttctcagcaaggcaattttactttctgcagaaagggtgcttcttggaagcctaattgtcatgagagcacaccgaacaaagaaaagcagaggtttttatccctgactcattgggttcttactgctgcgtcctgtctccattggctggagctggaccgcacaatctagactgattccgattggctaaaagcttaaaactttcctaaatagataaacgcgcagtggaaaacaaaggaagggggttgtttacaggaaattaggagaataataacatttccaaataaggaaggggtgtaggctgtaagctgggaaatgcctgggcacgttcggacatgtctgagcaggttatagtccagaacaaataacctggttaaagtacaaggacatagaatgtacttattcccttactatatttaacagccacatagggcttaacaaagagttattagcaaaaagcaagggagcttgaaggaagttaatttctaaaagaaactgttatttctaacacttgttatttattctttaacaaaaagggaaactttgaagaggaactttttacttttcacatgcggatccattagtcctcgagaatttaacagtgaacctatatagatgtattttgctgtccttacagaacatgcagtgtaagaagtacctttaatgccaacctacacacttctttcccgaagtacccaattaagtgcaaatgcttaatgtctttagtgttttatagtaaagcaaaaaatccttatttagaattagaagtacaggcctgtgcaacatggcaaaaccccatctttaccaaaaaatacaaaaattagctggacatggtggcatgcttatgtagtctcagctacttgggggctgaggtgggaggatcgcttgagtccaggaggccaaggttgcagtgagccattttcgcaccattgcactccagcctgggtgacaaagtgaaacttcaccttaaaaaaaaaaaaaaggacagcttaaaaaatatttttcccctcattgctgaaaggaagctttctagttatagagatgcatttacagtgactttttcccaagtgaaccatctcctactttttatctgataaaatctagtacaatatttaatactcagttgtgaaaattaggtgtcttgagaagattgagaatgtgggtttgatataatgattctgaattgcttaaaaatgatttttccttttagaggttagtgggacctaattcatctaaatgacagttaataaaagttagatgaactttaattgtgatctaatcctctcattttataattgaagactcttaggaacaaaggtgccgtgtacccatccagagtcacatggtgttttgtgtacagtccttggccagcattttttagactttttattttttagtttttttgagactgagttttgctctgttgcccaggctggagcgcagtggcatgatcttggctcactgcaacctccgattcccaggttcacgtgattctcctgcctcaggctcttgagtagctgggattacacgcacgcaccaccatgcctggctaatttttgtatttttagtagagacggggtttcaccatgttggccaagctggtcttgaactcctgacctcaagtgatctgcctgccttggcctcccaaagtgctgggattacagccatgagccaccgtgcctggccagcatttttttactttaaaccaaaggaataaaaatcagttgaaaagggctcaagcacctgttaagccctggtcacaggaatgttactacattacataatgtgctattttggtctggttccagaaaaacaggtgaatcaattcaaacctactgtagtctgtatatgtagacaatggcattttctaggggcaggaaatactggagaaacttaactgtgcttcctcctgaatagtattgaaaagtgagggaaataagaaggaaattactcaaaggaatatactacatcgtttaaactgtgtagaaaattaggtgtacctgagatgtataggggtatggcttcatcattctccctttcccaagtgtgatcttctttgtttctgtattttaccctttaaactagctagtttgtagaacacagaaggtatttttagaaattatgtctttttggtgaattaaatgtcttgttttttgaatcagttaggttgcctttaactcataaattacttttagttctttctgatttgctgattaagcacatattatatatacgtgcaaactttcagtgtccttattttccagaacctttttataatgtttgcaatctgatgtcttacatgtaatcctaatttcctgccaaaatgactgtattctgtttcccaaatatattttcctaactctggctgtttcttcaattttaaatgtttttcttagatattctttttccattaatatcctgttgaaatctagcccattttgtagagtagtgtttctcaaactgtggttttaaggtagtgcttcccaacctttttggcactagggactggtttcgtggaagacaatttttccacaggctggggaggagggagggggatggtttctggatgattcaagcacattacatttattgtgcactttatttctattattattacattatactatataatgtagaatcagtgggagccctgagtttgtttttctgcaactggacggtcccatctgggggtgatgggagacagcaacagatcaccaggcattaggttctcataaggagtgtgcaacgtagatccctcacatgtgtagttcatagtggggttcatgctcctatgagaatctaatgccgttgctgatctgacaggaggcggagctcaggcactaatgccagcaatggggagcggctgaaaatacatatgaagcttccctccctcacccgctgctcaccttctgctgtgcagctgggttcccgagtggggaatcctggtctggtctaaggaatacctgagtcagaatctccaaaggtgtttgtcagcccttttccatatattgtttagtatatctagggtggggtccacaagtatgatctgtagcctacccctgctttagaccaaagtgtatttaaaacaagccccatgcacctatacatgtaggtctaggaaatagtgtgggtggcattaaacaacccagtggcctgcagtggaatggggtgggccagccacaggattcaccagcggtgctgatagctttctctattgatggagtctaaggttacatgcttgtcttcactttttacaaagcctgtcttctctgtgataaaagatagcctatggaaggtgatgtgaaaagcctaaaggtaaagagtctgacaaggctgtcatagtaatccaagtctaggtaggccacttgttattctgctttttatggtttctactttcttccttatgttgaaagctgaagtaattgcagatgagaagaaatacatttgaggcttatgaatgacaccttgcttggctgttattgtgaagcattggtgtcgttgctgtttatgcacattctgtgttttggtgaactaatgatttttttgtttttatttattttttctttctgcagaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacggtgtgtaaacaaaaagagctgggttagaatctgtgttataaatgtaatttagaaattcacttaaagccttcagtagatcatcagtaaaatttgtggttattattctgatactgtgctgtgttctcaatattaggaggtttatctatcacaaaagtgcaactcagatgttctttaacaaatatgcttactagttaaaaagcaacagcagtatgtgagtgggaatctcttttagctgggttgcaatattaaatttttcttctctctgccctttttacttctaagattgctttatatgagataatatggagttaatactttgtgtaatattaatattatttttgctttctcaatagacatattactgaaaataatcattcttcgaatttcttaatttcttaaacagtgaggttgcataacttataaaaaaggaataaaagtaaaggaaaacaagctattttaggactgtagaaataagaattatcctaaactgttaccaaactttatttgggcatcatgaatttagaacacagtgacttaagtttatctttgtttagcagatcttttctttatagtaactttttttaaagcacctactgtgtgctagatgttgcgctgggtgctttacgtataatacctgtaatcttcatgatagtcttcaaagctgatggcattctttcctgctactgatgaagaattgactcagagagtcttaacacgcgaccctagcgagcaagaatgtggcagagctcagattcggacacaggtgtttctatctagtctagagctttgctctttcatcactgtatataaactatttctgggaaattgcttgtaataagagcaagccattagcaatgtttaaatatttgagttgcatgttgtaaccatatattttcatacaaattcaaatttatttttggtaaatactttcattaaaattgtgtaacttaaacactggctgatttcattggcctaattttgagtttctaagaatatagttttagctttgttaaatcattagttaaccgttaaagacgaaaaaagagaaatttataggtttacaaaatagcgtaaagcactacattccaaaaatgattgcaaacaaagaaaatgaactctaaaaaattgtagtcagagaagttttccttgctatctccagttctccttttctttgttctttttacccccacttgggggcgatcacctgcaggcacttactgtcttgttctccagttcctaacttgacagccaaactgcaagagcgttgtcatgagtcttcgtgcttgctgagtgtccagttatacttcagtatgaatgtactcatctttgtgttcttttacattgacgttattatacgtattgcattatattttcatcttacaagcctccctttttgttgggggacatatctctttggtctatggttgatgaagttccaaaggttggaatttgttttacttgttaatatatgtattttcctattcaaaaagtaaataaattgcatttttaaaagaaatttctaaggatctgggagatcccttgttgagttccaatcaccagggttcagtagctgatgaagtgcattttcttcagtagatgtatttctgggggccagtttcttctgattctggcaataaagcttttgctgttcggtggtcagtgttttaattctaactcttactgctttatagtttggttgcttaggtcattttagaatgtgagatattcattgaattctaatcagatttattttttatttggcatgtttctattacatcaatcacaaaacttatgtgatatagaaaggtagaagtagaaattatgtcttaattatgtttttttcttatagatacgggaatatgaatggattcattcccaaaccaaaagattgaagttcaacgcacttataacaacatatgagatcctcttgaaagataaggtgtgtaattaatatctaaaaggctaaatcttttccagtgcgacttgtccagatggtagggtctgttactgttctgtggagcatgttagaaataaatacttgaaagttaaaaataaaaaacaaatggtagggtctgtacctcctacttgccatgttacttttcttctcttatttcaaaaagcaagcaaatgaacaaccagaaaaattacttttcaaaggatattaacgttataaatagaaaacagaaccctatagatgaggggaccttaggtcaccaagtccagttgaattaaacagaatgaaagggtattgaataggtcagtaacttacctgagattattgtcagtcattggatgccatctcaggtatttcccttgaatgtcatcttaggcatttcctattgtatcattgttaaggcatttctccagaaaagatgatgtgaatggtctttgtgaggaggacaaaaataagaagctctttaaataccgcctttctgctaagaaatatatgtggtaggtagatcccattggtattaagtgcaaacaagttgagtttggtggctcttggtgtttgtgtgcttcagggttggggtggagaataggcaagagaaggaccataattaaggggagaatacagaatcatatggtttttttgttttatttttgcccagcatagcaatttttgtgttcttgctgtggggcatgcagtaatagctggtataagaggcccacctataccttttagatgatgatactctcttttgaatagctaccaatctggcaactaacagaataaacagaagaggcctaatatatattgtcagtgaagaataaatgtgtcaatttatacctttgtaatggtatttatacagagataattaacacttgaaagcacttgtgggttcccttctgacctggtggctcgttctgttttgtttttactttagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtaagctccttcctgtgtatttcaaaagatgctagaatgtctgaaatgccaatgctttttaactttcttagtagaccttagggaaaacagatggcatggtttggggaaagcaaagcgtcaaatggaggcagggatggcggtagtaaaatgtttcataatcaatgaaagaaggcacagaaattagcctgttaaggaggaaagcagtattgtctgctgaaaggctgaattagttaatgcacttgggaaataattgttaaatagataacatcagaccttttcactgttggtataagataatcaatataagtaaaatgaaatatacaaggtacacaagcactgaaaagtatgttatactcaaatatctgataaccgaagcatcaattttacatcttattcacgtattattaaagaactatggaatgtgtttattgaaaagatttttatgggagagatgatatgcacatttcataaaacttaaaattatccaatggtattcagcgatacttagaataacatctatattcattaatttggaggactccactcagtctggccccttgacaatagtctgattcctctcatccactttctccattactcattatgcttcagccattctggctatctttctgtcccttaaacatgccaagccattactattccttcttgactagaattatatttcttcttgtcttcacatggccaaccaccttaatgtttcagctcatcttaaacgaccacctcctttcagaaatcttttgcagattgcctaacctaaagtagccctttagacatcttatccctaacctgttttagtgtctatatagcatctctttttacatttatgttctcattcatctcatgtcattaaattatgtatgaaaatcgcagggattttgtttgcttgattcattgctggttcccattgtctagaatagcacctggtgcacagtaaacaattcagttaatagttgttcagttgatagatatatgctctacaatctttttttttttaattcaggattaaattttattttttacttttatttttatttttaaattttaaatttaaatttgtttagtaactttatagtttgcaaccatcatcattgtccagttttggaacattttcctcatcccaaaaagttcccccttgcttgtttgcagttaacctctgcttccacatatagccttaggcaaccagtaatcagcttttgtctctagagatttaccttttctagaagttttatataagtggaatcctaatatgtaggcttttgtttccggcttccttcacttagcatattttttttgagattcattcatgtcagagtctgtcagtaggtgttctctttcattgggtaatatttcattgcatccagttaccggttgatggacatttggattgctttgttttggggttattatatctttgtgtggacatatgtttttctttctcttgcttagagacttaggaatagaattgctggattgtttggaaagtttatgtttaacattttagaaactaccacgctgttttctaaagtgactaccattgtgcagtcctaccaaaaatgtttgaaggttctagtttccctgcgtcatcaccaggacttggtgcattgtcagtctttttgattctagccgttctggcgaatgtgtgtcattgtggttttgacttgcatttccctaatgactaatgatgttgaacgtcttttcatgtgttcattagccatttgtatgtctttggtgaaatttctattcaaatgttttggcattttaactcaggcgtcgtgttccgtcattggaactctaagcatgtgggaattatttatatcctactgctcaaggtcattgccaaggtctgattgcaaaaaattcaaaaaattgcaacctctatcataaatgggttaaaaaaattggattgtttgtcttattatgagttgaagaggttttttatttcttttaaaaaaattctaaagacaagtgctttatcagtacagtccccaactttctatagtttgatgtaaaatgttttgacttttcagtggtatgaaagcaatacactttcagtagaaagtatactttgaatgaacacaaccattctgtttttcattttcagtgtaatattcgataaattacatgagatattcaactctttattataaagttggctttgcgttaggtgattttgctcaatatcctcatgataagcgttctgagcacattcagggtaggctacggtgtgatgttctgtaggttaagtgcattaaatgcatttttgatttaacaatgttttaaacttacgatgggtttctcaggacataaccctgttgtaagttgaggagcatctgtatataatttgaacatattttatcccaatctgtggcttcttttcactttttgaatgttgtctttcaaagagaaaaagttattgattttgatgaagtttaatttatggatttctttgtatggattgtgctttagatatcatatctgacacagatttgcctaacctatggacacgaagacttgcttctttatttccttctagaagttctagcttttgtattaagtcagagttacattttgtttatagtgtgaagtgtgagtgccttagttcatgtttttgtagtagaatttgggaaattgttctagtatcacttgttgaaaagaatatctgttcttcattgaattgccttgacactgttgttgaaactcagttgacaccataaatgtcatgctttgtttctggactgtcagttctgttttattaatacatatttctgtccttctgccaatgtcacactgtcttgattaatgtagctttcgactgtttttttattttttattttttttgagatggagccttgctctgtcacccaggctggaagggaagtggcgcaatctcagctcactgcaacgtctgcctcccgggctcaagtgattctcctgcctcagcctcccaagtagctgggattacaggcacgcaccaccatgctcaactaattttttgtattttagtagaaatggggttttgccatgttggccaggctggtctcgaactcctgacctcaagtgatccaccgtccttggcctcccaaagtactggtattataggcgtgagccactgcacccggcctagactgctttttaaaaatggagaagtacaagttccattttcttctttttcaaaattgttttggttattctagaattcttgatacttccatgtacattttaggatcaggttgttaatttctgcaagaaaaatatggaattttgatagaaattgtgttgaatcatatatcagttaaagcaaaattattaatattgagtcttctaatccataatcatggaaagtttttctccatttatttagatcttctataatttttctcagtgtttagtggtttttagtttagaaatcttatacattcaaaatattcttttaattctgactatatttggagtggaatttttaaaaatataacctattatagaactacaattgggttttgtatattgatcttacatcctgcaaacttgataaacttactgttttctactgtgtgtgtatgtgtgtgtatattgttctgtatttcttagtatttttctatagacaggattatgttttctgtacctaaagatttcttttccaaaatggatgctttttatttcttcttcttgccttattgtattggcaggaacctccatcttaaatagaaatggtgggagcaggatgttggctatagatgttttttgtagataacctttattgggttgaggaggttttcttttcttcctagtttgtgaggttttaataaagaatggatattaggttttgtcaaatgcttattttctgtgtctgttgagatgaccatgtggttttgtcctttaacaatatagtatattacattaattgctttttagacattaggccaactttttttttcctagcataaatctgacttgttaacagtgtttgatactttctatgcattgctagattcagttggctaatattttgttaaagatttttgcatctgtttggtgtttttttttttttttttttttttttttaagacagagtttccgtctgttgcccaggctagagtacaatggcaccatctcggctcactgcaacctccacctcccaggttcaagcatttctcatgcctcagccttccaggtagctgggattacaagcatgcaccaccatgcccggctaatttttgtatttttcgtagagacagtggggttttgccatgtcagccaggttggtctcgaactcctggccgtaagtgatctgcatctgcctgtctccgccgcctaaagtgctgggattacaggcgtgagccactgtgcctggccgcatttgtgttttttattttaattaggattttagtctatagctttttgttttgttttgatgtttacgttgctttggttttgggatcataaaatgaattggagagcgtttcccttctgttttctgaaggagtttgtgtaagtttagtgttatttcttctttaaatatttactagaattcaccagtgtagccatgtcaaccttcactttgtgggaaaatttttaatgactaacctggtttccagttacaggttcacttaagttttctattcttcttgacttagttttgttaatttgtgtctttctaagagttagtctgtttcatctaacttgtcctaatttgttggcataaagttatagtactctcttagccttttaattttagttttcttttttaagagacatggtctttctctgtcacccacgctgagtgcagtggtacgatcatagttcactgtaacctcgaactcctgggctcaagggatcctcccacttctgtctcttgagtagctggggctgcagatgtgcaccacaatgcccagctaatttttaaaatttattttttgttatttgtagagatgggttcttgctgagttgtccaggttggtctcgaacttctgggctcaagtgatcctcccgcctctgtttcctaaaatgctgagataataggcatgaaccactgtgcctggtagattcttttaaggatcaatagtgattaaagttaattttcttgattatggtaatttgtatcttagctctttttcttggtcagttctagctaagggcttaacaattttgatgctctcaaagaagcaacttttgacatcattggtttcttcctctgttttttcttctctttttttttttttttttttttttgagactgagttttgcatttgttgcccaggctggagtgcagggtgcgatctcggctcactgcaacctccgccttccagtttcaagtgattatcctgcctcagcctcttgagtagctgggattacaggcacctgccaccacgcttggctaatttttgtatttttagtagagacgaggtttcaccaagttggccaggctggtcttgaactcctgaccttgtgatttgcctgccttggcctgccaaagtgctgggattgcaggcgtgagcccccgtgcccggaccctctgtttttctgtttatttccactctcaaaggttgccgtcctttgcttgcttttcatttaattttctctttttctcttaagatacagtttagattactgatgtaaaacttttttcttttctagttgtttaaaggtatgtttacttctatgcactgctttagctgcatcctgtaaatactgataattttgtgtttttgttttcatttgatttcatctattttctaaattctctgtgatttattctttgaagcatgggtttttcagaaggatggtgtttaatatccatatatttagggattttccaaatgtcttataattcggttttgtcttagagaacatgctttaaatgaatttattatgacttattaaatagtcttagtatgctttctttcctggagactgtccgataagtgcttgtaaagaataatctgtattctgcctttgtttgagtagtgttttgtaaatgtccgttcagtgtggtgttaatggtgttgttcaagacttttatatcttttctaactgccagtttagttgtgctttgaattattgagaatgaaatattttaatttttaactgtagttgagtttttgtcttctagtcattttttgcttcattattttggggttgttctgttaggtatgtatccattcataacttttgtatgttcctgaggtattgacctttttctggtcaatatcagaatgtcccatttgacctctaatgatatttattgttttgtaaatccattttgtgtgattttattatagctcctcagctctcttctgattcctgtttgcatgatatattgttttccatcattcgaactggttaccatttgcatggtatactgttttccatcattttactttcaacttacttctttctgtaagtctaaaatgtgtcttatagacaacctgtacttggatgtaccttttttatccaggcaaataatccttgccttttgattggaatatttagttcatttacatttaacagaattaataatatggttggatttatttctgctattttactatttgttttccatatgtcttacatcttttttgttccactttctcctttattgccctcttctgtttcagcaagtatttttcagtgtgtcattttaattcctgttaattttttgctattaaaaaaattgtaattggttgctgtagggattgtatgcatcagtcttcttcaggttagtactgactcagttctggtaaaatagggcaactttgccccgctgtagctccattttcacttccttatgttataaatccaagaatacaaggaaataattattgctttccacaggtttgtcttttaaggacatatagaaaagagaaaaaaaatatatactatctttcatatttatccatatatttgatcattttcagtgatcttcatttcttcctgtgtattcaggtcgctgttgggtattgctttcttttagtctgaagggcttcctttatttacatattgcaaataagaatatgctggcttagatgattaaaagatgtcccgtatgacacagtcaataagtagatagacgaagatcaatagcaaatcttctgtgaccaaggccagtgtcctttgaacttcaagttctaggagaaaaaaatacatccttcataaaaccattgagacgaagtaaggtcaccctacgtagtaagagttatgagacacagtgggaacatctgtgcttgtttttatagaaaaagaattgtggtatgtagtttctaccagtgaatacttagccatgatttgcttttgtgtacctacctgctgaagtggatggtagggattttgctcctaagtggtcataattagctttttcctgccattaagtagctgtggcattccactcagcatgggctatgtttggaaaaatgtcatatatccttcttttgtaattggagagaggaactttcaattactttatcattcagggagtctcttccaaaattttcctttggccagttgaatcaattatggaatgataggttagagttagagatgcaagtttttttctgtgaaagagatctttttttctttgaaaattttgtgtttaaagcattgtcattttcaaataaagtttcaaaattgttgttcacaaagatatgtatatgaaaaggaaaccaattagttaaggagttcagatttgcccttatttctgcctgagcttgctggatgggtaactatagtcttgtgaagtattttgcctcatcctcagcagaagttcctgaggtaccttaggactctacagagcttttgaagaaaggatccactgaagaaaaactattgtaaaggagagaattaggtttagtcaaatagctttggaacttccccactcaaatgttacaggctattgtttcaaaatccaaaagttagtcctctttttaaccaactgaaattctgtttccttagtatagagtctaagtgcctttcctgcagggtggctctgacagggagtacacatgactaaccatattgggaatacttatcaatcaatagcttcattttgtacatactgtttgcaaagcatggaacttggtattaagggtagaaaaagatatgacaagattgaaaaattcggcttataaagaccatcatgtgcaaatatatacttcagacttaccgcagaaaacaagtcagtttgatagcatgtatttcagagattacatcttttagtgttgggatgattttttaaatttttacttctgtcgtctaggccaatctcttaattttttttgcacttttccttttacatatttactgtgtgacttttagcataccattttcactgctttggtttaatttccgttgttggtccttattaaagtaacctatttttctaaaattccgtgttctgcaaagctataaagatcagaattttttctagttctgtgagagacaaatattaaatacagaagttgatagcagggatttatctaaaatatgaatctttagatgtaacatggtgtctttatacatcaccactatgaccttataccttttctatatctaatattataaattaataattgttttcagggcagcagactttttctaaagaatctgatagtatgccgggcgtggtggctcacgcctgtaatcccagcactttgggaggctgaggtgggcagatcacgaggtcaggagatcgagaccatcctggctaacacggtgaaaccctgtctctactaaaaatacaaaaaattagccgggtgtgatggtgggcgcctgtagttccagctgctcaggaggctgatgcaggagaatggcgtcaacccaggagcccaggaggcagagcttgcagtgagccgagatcgcaccactgcactccagcctgggcgacagagccgagactctttctccaaaaaaaaaaaaaaaaaaaaaaaaaaaaaaccaactcagaatctgatggtaaatatttttggttcatagcccacacagtcattgttagccactcatctctgctgtttagaggaaaagcagccatagagaattcataaacaaataaatgatacttatatctcctcagtgtgtgtagatcaagaactagtgtctcatattaactcccttaatataataagagtacagtaggcaggtgaaaatatttgttgcttaaaacatagaggaagtaaatcttggaaataaactttacatttaattttttagattagtaaagttttaatttattataacatgtgttaggtaaattagcttattgaaattgtctctcaggtattcagaaaatagcctgatacagtgatatttctacttctactgatttccggtcacttcacacatttagtgtgtgaggtatcatctccagcattgagatagttcagttttctttctttcttttttcttttctttttttttttttttttgagacagagtctcactgtcacccaggctggagtgcaatggcatgatcttggctcactgcaaccttcatctcctgggttccagtgattctcctgcctcagcctcctgagtagctgggattataggcacttgccaccatgcccagctaatttttgtatttttagtagagatggggtttcaccatgttggccaggctggtctcgaactcctgacctcaggtgatccgcccgcctcagcctcccaaagtgctgggattacaggtgtgagctacttcgcccagccagagatagttcaattttcattgtgcatttgaattattagttttaattcctcacctattttatgttcttggagtatttgcttaatagcatagcagtgtgagaaaatacagtttaccttaggtttatcaggctgtaggctttaatgacgactttagatgtctaccccaaaagatcatataatctgcttccctgtagattgtttcaggccataccgggtgttactaaggctgatgttgattcacttaacaatacctgataaaatgtatggctggatatggtggctcaaacttgtaattccagcactttgggaggccgaggcaggcggatcacttgaggtcaggagtttgagaccagcctggccaacatgatgaaaccctgtctctactaaaaatacaaaaattagttgggtgtggtggtggcacctgtaatcccagctacttgggaggctgaggcaggagaatcacttgagcctgggaggtggaggttgcagtgagctgagattgtgccactgcattccagcctgggcgacggagcgagactctgtctcaaaaaaaaaaaaaaaggaatgactatttatgagttcagaaatgacggtgactttcttgaggctgttgtatccattggcagtactggcaccagctatatctgacgttccatcttaccagagggcatgtgctttgagtagttactgagtagttctagatgatgttggttacatgatagactgaagtattttattaactctgaattcagtctgagaattggaaacgtgctattatccagtgtagactgatggagttgatttcattttacttttcccctttttgttttcccttctatttaagagctctagtgattgataatgtctttccttatgggaaagattcatttttttacagttttttttcctattcttcttttcctcaatgtggctaaataacactatactgtttcttccctaggtttgaattttgggaagattttgaagaagaccatgggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtaagttcttgtttgggttaggcctgaaggggttgagatcagtaccatgaaactattagataggagatatatatatatacttttgttttttttttttttggagacagagtctcgcgattctgctgcctcagcctaccgagtagctgggattacagggatgcgccaccacgcccagctaattttttttgtatttttagtagagatgggatttttccatgttggtcaggctggtcttgaactcccgacctcaggtgatccgcccacctcggcctcccaacgttttgttgttattaagcaaaatttcaatactgttgttatgtctaaaaaattttaataattccttaacagtttcgtaatatctagtgtttacattttcctggttgtcatatacatgtatgtatatctccgtttgtgcatgtgccattttgcttgttttgggatcgatgtaagctccgtgcattttgcttgttttgggatcgatgtaagctccgtgcattttgcttattttgggatcaacgtaagctccatgcattttgcttgtttggggatcgatataagctccatgcattttgattggttggtatgtctcttaagtatattttaatcaatttatttttctttgccttataaattttttgagtcaggaaactgaatttatgttttgtagacttttctcacagtctggattttgctgattctagctccatggcattctttaatattttcagccaggtgtggtggctcacgcctataatcccagcactttgggaggctgaggcaggaggatcgcttgagcccagtagtttgagaccagcctgggcaacacagtgagactccatctctataaaaataaaaaaatttttaaaaaccacttttcctctgaactgtgttttctgtatactcataagtaagtgtaaaggcttgattagactcagattcagtgtgactttagaggcagaggaatattgtttcacaggataaatgtccttttttgtgatgttagtgactaacgatgagcattgcctagatctgttaattcattagagagtacaaaagggtgatattcaaattttatcactcacttgtttattaggtggaatacttttataaaaagaaactttcccatgtcagctgaggaacagttcatgtaggaaaggcagaataagattcttttttacttttgccattttcaaaggaaaagatctacttttcttcaaaggttttgaccaatgagatttactttgatatgattatgaactcatcaattacacctatttatgtttaattctgttggagttaatatccatattcatgctctaacagtcccatttttagctagtgggaactcattcaagttggttgttgtagtccttttgacataaccgtaatagtagttgatagtttctttgctatctggaatgattaagtgttccacatccatcttgtacatttcctgccccagaactagagtcagccatttatccaagaagttctgcatactcctttactaggaaatgatatttgtttgtttctgtttttcctctgaaaatagtttaatactgtaaaatgtaaaaggggaaatagtgttaccttagtaacaacatgaatgtgtcagttggtcagtgctattttgggtgttgattgatcatatgatttttctggcaactctagatacttccagtttacttaagttgatttagttgagtttttatcacttgcaatttaagagtcctggctaatattctgttgccttcaggctgcacaacatgcaggattggggaaagcactagagagccaaagaaagtgagcagagttacttcagggccaccagcgttccccgcaatccctgtcctcaggcataggcccttctgctcttcccactgtagagcagcacccatccccaccaaacctcacttctgggtgtgacttcataggctgtcgtgttctgcagtaccctcgagtccgaggctgttgagtctgaaggatcctcagaagactggcctctttctgatggtttatggactatggcaaagatgaggaaatggtatttggagaccacatactgggccctaggggtgctctttgcaactgcaacaaacatggacagaattgggaaatttgtttttaatggtaaaaatacatgatgaacagtaccacagagattttatttgatcttactgatcttatgccatactaaaaatctcacttcccaaccacaccaagctaattcattctatacatacaacaaagctaatactaccaccaacaataagaatagtaaaaacaggttaagattttctttttttttttttttttgagacggagtctcactctgttacccaggctggagtgtagtggcacgatctcagcttactgcaacaggattttctttttacaggttttgtttttacttttttttttgctttttaaggttatataccacaagaagtggaaaagagttttaaagtactcaagatagtttttcttctgtgtctttaggcaactaatggttacatagatttatttatttcattttagttttgatttttagggattgctttaattttgtttttaaattatagtatttgtagatttccaaaggcaaagctacaaagcctggtatgttcaaagaaatgtagcttcagtccctcttccctccattctagtccatctttccccataggtaattattattattattttttgagatggagtttcgctcttgttgcccaggctggagtgtgattgtgtgatctcagctcacctcaacctccgcctcccaggttcaagtgattctcctgcctcagcctcccgactagctgggattacaggcatgcaccagtacgcccagctaattttgtagttttagtagagatggagtttcatcatgttggtcaggctggtctcgaactcccaacctcaggtgatctgcccccttcggcctcccaaagtgctgggattaacaggtgtgagccaccgcacctggcccataattattattattttttaacattttaatgcttatccttcctttaacttttaattattaaataaaagcaaatgcattttaactttgaatatcctcctttctcttaggtaagtggtagcataccgtatacacttttctctgccttccttttttccttaatgatacatggctgaagagcaccccatagtagcttatagagataggcctttatgatgcatagtgttccattgaggttatatagtatggtttattcaaccagtttccttgtggtaggcacttagattgttttacctacttttataaatagttctggagtgaagaccttgagatagattcctaaagtgtgatttctaagagaagcatgaagaaattgcgccactcaggaaaaaatgtacttttactattttggagtttgtggttaaggaatatacatgggtatacatgaatatatctgtatttctcctccaaatttgggtagaaaacatactgataagttattttgtcagataaaatactcttttacaatgttaaaatgggtatgtagcctctattttatggtatatttacatttatttaacctcataatgttagcttatttccaatttttatatttcagtgaagagtgtttcagtgacagtcattttccattcacacatgcacacacaggttgagtctcttatcaaaaatgcttggggaccagaagtatttcagattttgggatatttgctttatacttactagttaagcattccaaatctggaaatcagaactgtaaaatgctctaatgagaatttcctttgagcgtcatactggcactcagaaagttttgagtgccattttggaacattttagattttcacatttaggattctcagcctttgtgtacacacacacacttaaatatgtataaagtacatgtgtgtaaatatgtaaaatgtatgtatgtatgtgtgtgtgtgtatatatgtaaagcatatgtgtgtgttgtgtatatgtagagagagttgttttcttctagtattcctgtgttcagtgaggttgaaatatccagcagaatctttaacattcctaattctgactggagatgtgaaagatgtatgattagatggcaggagatacaaaagaaaatattctttgcttcttaaacttttttaggcctctttttttctccacaatactactactatctcttatactcttctggtacctacaactttctgtttttttgtatctagtagtatcattatcattttaatttgcaggtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctggtaggtagttcctcataattactttctcaaaaaaaacgcttagtttctctaggtgcttttcatcagaatgctctatttccttgttggtgacctatcaaggatcatcaaaggaagctttaaaaatgggagagaaaaggtaactaagaatgatttggaaagtaaagtatagtatcaacagatactgggaaaaagaacatttcgggaattgctggtcaagcaggttgctaagggcttcagaaagctttaagatgatttttaaaatatggatttgtagagattagggaagattaaaatttgtgtttcaacataattattggaatgtcttttaaatcttcagtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccaggtaaggtgatttcagtaattgctgtggggggaatcaatctctctctccgcctcccctccccaaccttcctacactgggttgtatgctttgcttgttaaagtaggaagtaagagttttcttgtttcaaagaagttaaggttaagattccagggggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagattccaggagggtcttaatttttacttgcatgcctttaggctaccatatgaaagtggtcatgaggagacgattctttttttgaaggtgggtggggaggattagagaaagtcaaacggggcaagataaaaaaaggatgtcagatggcatcttattgcatgtgtatggtgaaagtagagaggaagtaagtgtgagctcaattccaggagcccaaatcctagaaggagagggcagtatcagacattccccccaaaagttgaccctggctgtgaggctgggaacatagcagaacactgctacttaaaaccttgctactccctgaagtaagtgatgatggcttcccctattttctgtggagttccttaactggagttactgtcttcacacagttatctcctatggggaaaatttcttccgcatagtaacatttttctaggtgtatataatctagtagaaacttattctctgatctatttatagacacatagacatatacgcaatttaccttgtctcttggcatgtttatagtgctttgatttttaagatttattacattttttttaaaactttgaatggatgaactcttctaccaactcacataattatgttgggattgaagaaacttggaccaatgattatctcctaagaaggcccacctttgagactatcagattgattatctttcaaaataccctgaaaggcattgttatatccataatatcttatatggtctttcagttgctgtcttagaatatagcttaaggctgtgcttgttatcaagaaacagcctattgcaaaaagtcacttctctgtcagtgaatcgaatccctatgagctttcattcctaggaaatcccgtgataccaagtaaatcaagaatgcatcgtttttctctctagggaatagataagcttggtcagtgacttttagataattaatgccctctactaatgggaatattaaaaggcggcattaggttttctgatttcaagtaaaggctctgaatctcccattgaatacgtcttcggtttaaggctctgagtagagtagtcagtgagaaagaagtaagggactcctcacctgtcagttgacttgagttaggtctggtgggcagagttctgggtatgtaggcccttccacagagtctgctgccagccaagtcacctttcaggttagttttgccttctgtaaaatgaagtattttgttcatctcaagtggtgattgtgaggggatgaaatgcaaaaatgattttaaagagtaagaaatgctttataaaatgtacagcatgcaggtgataattctttagtattttatgtgtcaatggtttctctatggtgacattgtattgcatgtagaactgacatatgttctaataaaggaattgtgtatgctaataaatgccaggggctttcttgaattctcatgtagtttagctgcttgaacactttactatgatttcagagtgtaatttttggcaaagctgggatatatgatcaattttaacattttcaatgattcagcaaaatgtttttcaaacaaaattattatataaataaatttttggtttgtgtgacactttaagtgatagttttagccacattagctaagaagcatcatttttctgcaggagcttattattgggtgacccgtggtcctatttcctaatctctgcagtacctacagaaacagaagtaaacccagcctccaagcacaggttgggttttcgtctttctccttttaggtcctggcagccattctgatccttggctaaacctggacagccctttgaatcagaagcttgtaaccttgagtctgtaactggagagctcaggtcgagtagggtagggtgtgcttcttaagcacagcttcttcatagcgctttgccagtgctttgcagttatttttactcagtgggtgttcaggtgataaaggttccaagtctgctgttctattctgagtgtagctgatcttcctatcttacagttttcttgtggtttatttttacagcgtctggatggttccatcaagggagaaatccgaaaacaggcactggaccacttcaatgcagatgggtctgaggtatactatgcatggctttgttatttgagcaacttgggctctgcatcaaggggaaagtctctctcgcttaatgtattctgtttcagaaacaatttatagtgcaattcttttgccttgagaagaaaatgagaaatctctcatataaaagatggtgttttgttgtcactccagaaaaataaatatgtgcttatttatctcccctgttctgggttgacaacagagtggttctcctggtagcttccagataccaaatccttgggcgtggaagagcagtaaggcaggagtaggggagagttgggcaatagaattaatataagaaggttctgatctctgtactcttttggtgactaagtcctgaaaaatatatttgccatgtctcaaatttgttggacttctgatacagtgtggcttaatgttcttgctctcgctaacagcaacattttacaatcagtgtcgagcttggatttggcattatgaagtattttgtttggggggcacatatagaagagctacttaggatgaaatagaaggtatgacaacattgtagtttgtgcatatcaaatcatcagatgccatgggatttgagagaagtgggagagaaaagttttggtgtgaataaaactgtaataatgtgtagagctaaaggaagcagtggagacaacctgaagtagaagtgtttcacagagaatgctaatttctggagcctgagccactacttttttttttttttaaacagatagaacagacttagctttctgaagagctttaaaaactcttgatgcctgtgcctgttactacagaatgctctgctgtctgcctttagagtgtagaaatcctagttagactagtattctggctacttctgtagtctaaacatttacttcttgaggggcttggggcattaatctattcagagccaaggctctcgttcattaaggataagaggaatggaataattaaagacatcggtcatcaactaattcccattcctcctttccttgctccttgtttcctcagctgtaaaatcacaatgattctgataccccacttcataatattgctctgaggattaaatttggtaatcaacataaagcactgatcacattgcccagtgcatagtaagcgctctaaatatctgctatttttatcatgtagtgttggttgaaattggttttgtgttctccactcttagtttaaaaaatagtatgagtcgaatgtttcatattgccctgtctcaggggaaaaaaaaaattgctttttgcatagctctcagttgattcccactcactatgatggctatatagaacacaagttctctaccatttctgcagtattttaaaaattcctttaaaaaactaaatatttattgtgggacaaaatattatatgcttacttagaatattgggaagatggtaaagaatacaaagaaaaaaacaattgtacccctcattctagacacaacttgctgttcacgtctttggggtgtatttccattcctactagatggaaccatttatatgtttacctaattcggatcatgttgcatacagttttgttcccttcaaaattatactttgaggctaggcgcgcatagtggctcacacctgtaatcttagcactttgggaggccaagatgggggaggatcacttgagaccaggagtttgagaccagcctggtcaacatagtgagacctgtctctaccaaaaaaaaaaaaaaaagtttccccatgttattaaagattttacaaaatttaatttctaggcccatagcaagaccctatctctacaaaaaattaaaaaatgagccgtgcatagtattgtgtgcttgtagttccagctgttcaggagacaggcaggaggatcccttgagaccaggagtttgaggctgcagtgagccaggattgccccactgcactccagcctgggtgacagaatgagaccctgtctcaaaaaaaaaaaaaaattttttttttaaatttctaaatttttcttatgcttgtaccatttatttatttaactaccttaccgttagtggcattgagttttataattttttaacctttttcaacttgatcatagatgcagacgacatattataatccacgttatccttgctaaagagtgatatagcagattgttggttgataggatctttttgactccagatttcatttgttttagatatctcatcttaaattgtccactgtttatctttagacttctctttggagtgtggtggtgcttaatatttctcttaagaatcacagattatgtgcctggacactcctgttgatcacttctttattggaattgtttaattaaaattcttgtgaagcagctgtctccatttttatttctatggcataatgttgttgaatgtgactattagaacatggagaccttttcattgcatctctatgtgtatgctaaatatacccatttatcaagatggaactcaggactaccagtttttcaatgctgcttctctctgctacaaaggcatcagcttttgacatatatgattaaattccctgaaaatagaaatatttcaccttttccccccggcttatatattttattctttttctcctgcccccatatttttctgagcactcagacgcaggcaggtgtgctgtgcttgcccagtgtctactgtcattgctgtggatactgcagtgtcagtgcctgggtggttccacacatcgctctccagccaaacctgttttgatttttttataattttggcatgttttgtggtaattgaggatcctgtggttctcaacacttaccatatatgatctctttagtgcagtgtttctatatttctcgccagcctaacaaacataaatatttatataataaagtatctctgtttatactaactgacttacatggcataatctaccttttccctaaaaataattatacaggtgacttcctggagttaatgatctccatgataattgtttgtctgtttttattattgttgctgttaacttcttgtatattagttgtagccgggaggtagcactaattctctcactcccattgccttattagagtctactctactcctgttcatggcactgactttgcctcttaatcaaatgaaaattcattctaccatcaagtccctgacattcttttagcctccataaagtttgtccatcatatctcacttttcttcacacctgcaggggtttccaggtgtaagggcttattggactgtgaaactgtttctgagaaggccactgcataaagtagtatattgcattgtgtacaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtcagtatggagaggcttctggaaattgctttagggttgggggccagggggcttgttcagccctttcaggatgttaataaaatgctttttccctgttttgcttttatttcccctgaagcattgatttctgtttgttaactagcacagagatgttgtctttgggcccaagatgaacctattaaggaacttttctttttctctgtttgaaaagtacaacatcagcgaccttctatgtgtttatcttgagagagatatatgatgaatagacttagaactgaacattttctctattttagtatggaaaagttaaatatcctattgttcaagatggtttgtttttattatacatgacagtgttagctttaaaggtactttggaaaaccacacacttttttgtttatgaatcttaaagtctgttctatattggataacccgtaagtttcattcttggccaaagattctgtttttgtggaactttccatcactgaagcacgatttttattgatggaacaggccataacgacagatctttagaggcaattttatttaagactgtaacctgctgcacatagtaaaagtattgcatctacttaagctgcctgcttggatggcttacagtcttctatggttagagaataaattctgttaaaattttcccctcttgggttttgacagagctaatccttctctctttttttgggggggttggggggtggttcaggcataagcataacagttccttttcctacaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaagtaagtgccaggaagattgggaggtaggcagaatcaaattgattctacatcactgttggatataataggattttctaccacagacattagtctgttcattacctggaagatgccaggccagaaccacaaataggatagcattttcactttgagtttcttggttcctttttttgcccatcaccccccttcttatgtgttttcctctctttcttgccctctcccttacctttgcttttggctgctcatgtgacatatgacacagcaacagcagtggagttgtgtgttgggtgtcagcctagcataatgtcacctttgacttttctgcagtgagaatccagattggattggcagctgttttttttttttactattggcaaaaatgtttgtgtggagattgttgtgcttccagaagggtgtaaaaagaaagtaatgaagttttaattggctttgggaagaggcacagctacatctcctataaagtttaattagccaggcatggtggcaggcgcctgtagtctcagctacttgggaggctgaggcaggagaatggcgtgaacccgggaagtggagcttacagtgagccgagattgtgccactgcagtccagcctgggcgaccgataataataataataatatcaaaataataatatcaatattatcaagataataatgatatcaaaataataataaaaataagtttacattttgagcagattgttgagtgtcttctgtggtggtgtttcagctatgttttttgtttgtttgtttgtttgtttttgagatggagtctcgctcggtcgcccaggttggagtgcgctggcacgatcttggctcattgcaacctctgtctcctaggttgaagtgattcttgtgcctcagcctcccgagtagctgggactacaggtgtgcaccaccacacctagctaattttttttttcttttttttttttttttttagtagagacagggtttttccatgttggccagactggtctcaaactcctgacctcaagtgataggcccacctcagcccctcaaagtgctgggattataggtgtgagccattgtgcccgctgcagctatgttaaaggtgtattcaaattagcccttcctaaataaaatgttttcagatagttttctgtttaagaggaagctagatgagaaaagcctagctcttttattttggaccggggttgagaaggttgaaaattcttggtgaattataactttctgagtaaaaggccaaaggaaagagctccattctataacattgctagtcacctttctggcttacccatgcaataggtgaaccagtaggactgtaactaattttctattctgctggtttagggttaccatcacagactcatcctgtagatagaaaatgcgatgtttgagaaatcatttttcttgaggcagagtttatattttcagcagttaacttgacctctttctgaaggatagttattctgaagtagaacactttagaggttatttgatgtttctaacaactacattttacttccacagctcaaatccttttaataaagaagagctgacagctattttgaaatttggagcagaggatctcttcaaagaactggaaggggaggaatcagaacctcaggtaattaacaatgaggagagggaaatttttttgagaagtatgatctgtgagagtctaacttttctgtaagaagattctgttagaggcttttgtaaagaaaaagtaattacttgaaggacagtgtgtttttctttcgtaggaatctcatagctcttaccaaattgagtaggaaggaattaataaagcattcgagtatacttttttgggttgtttttttctcccatttctgttcgttttaatttttgaagtttcaccttgtcatttgtataaattatagtttgagacattagatgtaaaagatgtagagttgaaactgaaagtaaatgaaatatcagaaaggagaattggtttatttgcaccaaacatttttagtaaatacgaataatttctgggcaactaggcaactcatctgttgccattttattctattcgtgttggcttttgttcttttaggaaatggatatagatgaaattttgcggttggctgaaacgagagagaatgaagtgtcaacaagtgcaacagatgaacttctatcacagtttaaggtatgaagatctttgtgggagagagttctcagcattgattcattaatgatgactaatgtttatgaacgctttctttgtgctaggcgctctgcttttctctttacctgaattgagtcatatcctcaatattgttctctgaattgtgagtatgttgtgaatgtaggttctacagtccgcacgaaggtaatcactgaagtgggctatcctatgtagagtcagtgtgtggcggaaaagaaatcactgaagagagggctaggtagagagccaggacagagtgtagaaccaggacgtgtggagcactgtgggacacgtcaatagatcagatgccaaagagaggtcaaagataggaaaagagtagatgacaattagaaggttctgatgacttggtgagattttagtttgttttttgtttggtaagtgagagaaagaggtgtcagtggtgtctcatataacagaaaattacatgaaatgaggactaaacacaaaagttgggcaccagacgaataggaggtggcagcacagagtatcaatgttattaaaaagcttagtgaaagagtacagggatgctaaattatatggctagaaggttgaagcaagacaaggtttttgaaagatgttaccatgtttctagtttgaggaaagaacttgagtatagggagatattgaaggttctcaggaaggaaatgatttgatggcacattgccccagaggagactggaagggatacagtcaaaagcacagatggaagacttggccttggaaagaaaaaggacaagtacactttagggaagaggaggaaagagatgctgtgggagtttaatttatgctcttaatgactagtaaagtaagtgaggtgtttgcttgagaagtggaaaagatttgggacagccatggatgaggcagaaagttgttgggaggaacctgatagggagtcagctgaattgagatgatacagctttgccgtggagccagtcagcagggtcatatgactttctccagcaatacttttgaggtcagagaaattggatcagttggctatcccaaggtgggagattggcttgggaggcacaggaaagtcaaaatagcaaaggttttcaagattcatgtgacagcttggaaggaaggattgaccatgggttgattccatggaggtagagaagcaagagagacctgatgattacaatgatggctaagtgtagtatgcccattaggattgaattgaattaggggaaattgtgtgaagtgtttggaaggaagcaatattgtgtgattagctccaaagctggccactggtagaagttgtttcaatggaagaacaaggatggaattgagtgggccagagagccctagattaatgggttaggatgcagaggatggggtagagaagggggaaggtgatttattagtgttcgtcatagtcggtttgggctcctgcagtaaaataccgtagactgggtggtttataaacaatagaaatgtatttctcacagttctgaagatttgaagtttgagatcagggtgccaacatggtcaggttctggtggaggctctcaggttgcagactgctgacttttcttatcttcccatggtagagagagagaagctagagagctctctgggggtcccttttataagggcagtaatcctattatgagggctctaccctcatgacctcctaacaccttacattgggagttaggatttcatcctatgacttttgggaagaacataaacattcagtccattgcactgtttcagctcagttccacctctgtgactgctgctcctttcttcagcaataaaaacctgcacttgtgtaactcttactgtgtttcaagcactatcttaagttaagggccagagtctggcctttaaccacgatgtcccttttggaaaagttaaattccttactgcatgaaccactaacgtatgtgcatatttacatcaatcttaattttagttaattttagccaaaagtcataaagtaagagtcttaacttgacttcactgttggctccaaggaatggagcctccagaagctcatttataccttatgactgtctcaaaggctaggagggagggaataagaagaatgcggagccaggctgggggctgcctgccactgctcagatgctgtccagaggtggtagatgtttctgtgtactcctcctctggttctttgaaatggatacacttagatggctttctttctgggatacctactgttttagtacaaatacatatcggatattaaataatatttgataagaaatgaagagaatattcttctagatttatttaaattttttctgttttatgttttcattttatttcctaagactaaagtgcacttgtgagcatatgaaatcaccacacatctttaactttcatatttttgataaaaatgaataaagcaaccagttggctagatgataatgagtgctttgagttatgcattgtttcaaatgaactctatacaacttatagaaatgtaagttcatcatggagtattaggtattaagcattttaaaatctaaataaatctaaattttatcattagtattatatttattagaacatgtatatgatttataacagctcattcaataaaacttataaaaacaatttgtatctttgtagctgtttctctgcttttcagtaaaatttatgatgtgatgaacttgaggacttgacaagttgatttttgggggtataaaggaaaaattaatagaaaattgattatctgattatgtaatatcacaaaagtcctattattcacagtgtctacttagataaaaacactggataaattgttttagtagatggtgtttagaaatagggaaatgtcagacaatgggttgtctgttttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggtgatcaagtgagatgaaagatatgaaattatttcttatgttgtgaatgctacagaagtgttgattattcaaagaagaggccttgcattgttcccctgacacagaggcttcaggagcagagttgatactgtaggaaacttaacaaaggaaagtggagaaatctgcagagctcctgagcacacctgtgagacatcggatttggtctttgcaaattggctctttgtgaagctgataaacagggtctgaaatttccagaagtttgcattttgcctttgagtagtcctcacagtttggctgttaattgccactgccttcaactttcagaaagtcacacctctgtttgtccataacagttcacagcacttgatataaatacttagtaaaggattatataactataaataagaaacatataccaacttgacagttcacaaagctccatcacagacactatctaatttgatttttgtaacaacattgaaataggtagaacaagtttttttacccattttgttggaggtaatagacacagatttgttcaaggtcacagtaaatcagtatgaggtaacactagctaccatttattgagcccttacaatgtgctaggcatacttctaagtgctttaacttactgaaaaccatctgttataggtactattgtcttcatttttcaaatgagaaaataaaggcacaaagagtaaaattacttgcccaaaggagtaaacatgaacctgttttataatgggatattgtaaaaatattcatatatttttaatccagttcacttatcgttatattacaatgtctctgaaagtatgactgtcctaagtgggtatttctccaagacctgtctccccttatttgtcaaaggaaaattgacttgtctgatatggtgagaagttctgaatactaaagaattaagatggccttctcttagtcctttcaccacttgaacttcgcacttgttacagtgtgactttgcctcgatctttctcaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttggtggaggctctgttctcactgagcttgtttgaaagtgcgtactgtaagtcttgggttgactggatcctggacatcgtgacagggtaggcagaggctaatacctacaaaaaaggaaagagaagctgggtcctgtcccagatctgtaggatgatccttccttctccaaggtttctttctgttgagatcacttttatttgttgttcatctctctatttctctcttattctctggttattcagaacattttcacaaagttcagctcggggaaggagataattgacatacatgtatatacagacttatgtatctgtatataaaagaaatatcaaaaataaaaatggtacaaataagtctaccctcactacctctcccctccgccacaatcccacttccacctgtgttagtactgacatcagtttgctagtggtttgctttgatttataagtagtatgtacagcatgttgttcagcaccttgctttccccgatcccatttaaaatccattttagacatctttctatgtgagtgattactatacatttcttggtatctgattcaaatgtctctatcctccataaaaaaatctaaaattgttgcttacaaattattttttttccagtttccatcttttttttttaagcctgaagaaaatagaaagtataaagatggttttaaggcctaatccatattataattatattaaatagtcctttaagtttcatgtatttgaaactgtgaggtgtttcttttcacttaaaggtcacacctattcttctttctttgtttaatttactatggaaaaatagaaatatttcaaaatactgacagaatagcatgtaacacatcccctcttgtgcttatcatcttaacaattttgaatttgtagccaaaattgtatgtatatatacacaccccacctcttcttgctccctattcccagtattattttgagaagaatgtgttttctgctatggggcagtatgttctatagctgtatttggcttagtgtttttcaggtctttaatttcttcattgattttctgtatagttgtggttattttggtagagtcagaatcttgctctcttgcacaggctggagtatgatcctatctcactgtaacctcacactcctgggctcaagtgatcctcctgcctgagtgcctttttcactcagcctcccaggtagccaggtctacaggcatgtgccaccatgtctggctaattaaaaatttttttttttggtagagacaaggtttcattatgttgcccaggctggtctcagactcctggcctcaagtatcctcctgcttcagcctcccaaagtgttgggattataggcctgagccaccgtgcgcagcctagttgttctacccattattgaaaatgggatgttgacatctctgttactcttatatgatccatttgttcttcaattgttagtttttgcttcatgtgtttttggactcttattaattgtatatattttttataatcgataggtcttgattggcctttttattgtaacatgtatttctgtctgtagtaacaatttttgttttaattcctattttcagtttgatattagtatagccactccagctttctttttgggtatttgaaattttaaaaaatggtatttggccaggcatggtggttcacgcctgtaatcccagcactttgggaggccaaggcaggcagatcgctggagcctaggagtttgagaccagcatggtctcaacatggcgaaaccctctctctactaaaaatacaaaaaattagccaggtgtggtggtacacacctgcagtcccaggtacttgggaggctgaggctgaggcacgagaattgcttgaacccaggaggccaaggtttgcagtgagccgagatggcaccactaaactccagcctgggtgacagagcaaaactctctaaaagaagaaggaaaaaaaaaaaaagatggtatcttaaaattttttaaaaatattttttctgccaatctcttttttttgattgcagtatttaatctatttacatttaatgcagttattataaagtaggaattatgtctgcattttgctatttgtcttctatatgtcatgttttttttgtttatttccccattactactttcctttgtgttaaatatataatataccattttaattaccttaaaaaaaaaactttttttttcacttattttcttagtggttgccctagaaattacaagtaacatcttagaacaatttactttgaattaacatcaatttaatttcaatggcattataaaaactttgccccagttatagctcaccatccccatttgtgctgttgtcgcacattacatctttacacattttaaacccatcaatgcagttttataattcatactttatatagttagttgtctcttttttttttttcttttgagacggagttttgctcttctcaccaaggctggggtacagtggtgcaatctcggcccactgcaacctccacttcccaggttcaagtgactgtcctgccttagcctcccaagtagctgagattactggctcctgccaccacgctggctaattatttttgtatttttagtagagatgggatttcaccatgttggccaggctggtcttgaacttctgacctcaggtgatcggtgtgcctcggcctcccaaagggctgggattagaagcgtgagccacccacacccagcctagttagttgtcttttaaaatcagatagaaggaaaagagttacaaaaatgcatgtatactgtttttatatttacttactctattattccatgggtgctcttatttcttcatgtgatttgagttactattttatgtcctttcatgtctgcccaaaggactctcttttagcattttattttgaggcaggtctgctaacaatggattctctattttggcttagctcgcactgttaatttcatcttcatttttgaaggaaagtcttaatttctttttttctgtttctcacgtgggataatctcaattggcctatcttcagatttggcagttctctcttcttcaggctaatatctgctgctgagcctcaccagtgattttttttttcatttccgttattgtagttttcaactctagaatttctatttcactctttaaaaaatgtccgtttttaaacagcatttctgtttctattgatatcattttcgacctttctttttaattctctaggcagactttttttaactcttgtaaatatttataatagctgattagcatccttgtcttataagcctacatgctagacttccttagggatggtttctattacctgctttttttcctatgtatacttcatacttcatactttttttttttttttttttttttgagatggagttttgctcctatcacccaggctggagtgcaatggcgcgattttggctcactgcaacctccgcctcctgggttcaagtgattctcctgcctcagcctcccgagtagctgggattacaggtgcccaccacaatgcccagctaatttttatatttttagtagagacagggtttcaccatgttggccaggctggtctcgaacgcctgacctcaggtgatccacccgcctcggcctcccaaagtgctcggattacaggcgtgagccaccatgcccagcttactttttggttttctatatgtcccgtaatttttcccgtgaaaaactggacattttaaatcatatggcaactctggaaatcagatctcccctcccagccatgtgttgtgtttgccgctgctgttgtatttgcttgtttagtgactttcctgtactagttatctgaagtctgtattctttgtcatgttatgtgatccttgtcatgctatgtgtagtctctactcctttagcttagtggtcagctaatgattgaacagagatttccttaaatgctttgagcctgtaagtctaccagcctttgttgaagggctgggtatgtgttgttggggcacgtttcaatgctctggaaggcaattgacaactctgccttaactttcagttcctgcttgcacagttgctcaaggtctttctcaggctcagacaaatgacagtgactctgacagtgagtccaagaggcaggcccagagatcctctgcttctgagagtgagacagaagagtctgatgatgacaagaagccaaagcgcagagggtgtcccaggagcgtgcggaaggaccctttgagatctttcctctgcatggacacagacctgcacatgtcagagcttttcagagtatctatcctatgaacatctttcctcccagtttttctttttgtctttgttcaaccttttgttatttccagttggtaatgttgcctcaggccgtcatggtgttaaatctttgcatctaattgtttttgaccaatgaattttggacagggctattcacacagtgagttctgggtcagtccaataaagacaagcctgagaatggagcttcttagggtgctgttagccaggtccagtcattctgggggaatagggcttttggagaactctcaacctcttctttaccctccagtggctgctgtgctgctggttacacagctattgtagttgcagaagtgttagttttgaaggctgtcatgcagctggggttaaggggtgggaatagtgcaagttaaaaaatgccttgaagcttgctgagccattttcttgaataaatttcttagatggctgcacgcatttggttaatttccagagttgtgacaatactgattgtgaccgtttatgccagcattcctattgcttttatgggggagcagattttcacagacccttagtctgtcatttcggaagtgttgttatttagacataaaatatttcagtgtctgtcaagaaggagaaatgcagttaaggagtaatcctcaggttttgttcatatataatactttcctaacctttgtatctgcgctgttcctttaatgttgtttttagctattgtcatattcagtcccattttattctgtagccatgtcttctcatttccatttttcccttagcatctgtccttacatggttatataacccaattatcatagtaatttggcatattacatgatgcccttaatgtgtcatgaagtcctggtttttagtggaaagtactggtgaccagcctgtaggaatggggatgatggcatgagttggtatgtagcatagtttagggtagagacttgcaggaagatagattggatttttgggaggagaggtcagtagagtttccaaaattgtttgcctaagaagttttaaatcatattttactgtgccttattccaaaaactatttgagacagtcaaaaaaatcttaacagctgaaaaatcattggttttctaataacgaaaaatatggtattgaaggtaacagtggtgaactgaatacgctgatgaaacgatataagggtttgtcacaatagagtcgtgatgattgaatcctttatgacacagtgaagtctataaacttgtatcttctaaaaaggatattagagctaagtcacagttctctagcatgttatctaagcaggtttatgtacagtcactgagaataaagttgatctttaatttgaatagatttttagcagtcattattttaagttgactagtttcaaagacattcaacatttattcatttttttggtagtgcaaggattgagtccactctatttttgacaatttgcatggctcatatgtcatcacaggatatgctagcatcaacataactaaagtaagtctctgtttttttaatatgttttattgatcctattcttaggttcatcaaggcttataagaagtttggtctccctcttgaacggtaagttcagtgtaatagtcccttatcttcctcttttttgcttttattatatagtacgttcttttttggtaaatttttccatttaatactaatgctgggaacatttttttttctggaaacatttatttacaaacatttatatattgggtgcctgttcattcatgtctctctgcagagggatgacaaagatgataaagacaggccatccataaaaagactttcaccttcgtgagggagataaagcaagtatattcaaaaccatagtgcgtgaaataatttccagagagatgttcatgtaactccagttgaaaagaatgtatgtagttattatttgtatcctagttcttagatttaataatgtcaaaggtaaaaggctctttatgattttataatcttctgctaattagcaggattttatgaggattaaatacaaaggacttaacatagccttgactataaaaacttccaaaagggtagctgttgttactattctataagcatttagaaaataattcagaagttagattttaacagaagactctatttgaaatggttcggtactttacttcctataaaatctaaaaagccctaatttaaaggaaatactgggctcccttctctttcttctgataaacttcttgagtgggtgaaaattacaagcctgtttttgtttggtcctctccatttggcgaggaggtagtgatgtgtagcattaagccacagcaaggccaagaaggtcagttgcatctttccaggactattgctgaccacccaggggtagactgtctgtttttgggccagttaccgtaaaagccaatagaatgtggaaaagggggcttgacaccttttgacagcctgttttttagctgttaatgtagttgtgtgcttcatatgacatggagatcaactaaacatatagtagaagtagctatactctgcttctaggagcattgcagtgaatgaaagtaggctggagaaaggaaagtgaacacaaaagaagcaagctagtacggatggtgttcaggcacttcacctgctgccactaacagcctatttatttaataaactttgctttgcttgtttctttctttcctctctgttttttggaattattttgttttgtggaatattcaagacacaattctttatgatggaaaatgaatgtgttagccttcagtcaatgtccaggggttcttgttggagccttagaatgaccactaaaggaacgcaaagaaaagtgtctttgcaggagaagattatgtgaggcctagtggcatctcatgacacttaagaagagtgggcacagggtcctaaagtgtccccatatttgttcctcctcaggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggtaagcgaagttggctttagtgagtcttcgcaacctggcactcttggactggatttctgttgctaaagggcgttttaaggacaggcttgaggaccacacatgcctagtgatttcaggtgtttattctgagctgcgtttctgtgagcttaatattctactctcctacaggtctactcacaaatgaagttgatttgcagaaggtgtagagtgaagaaaaagatgaaatggtttttttttgtgttgctgtagaaagtttaaattcgtcggagtgatgtaaaaacccaggggcagagcttggtggacacctctgtattttggctgcaaataagaggtgttatagatcacaagcattgttaattatcttggatatatattgtgcgttatggcaaacacaaaggatttagagaattaattggaataaataaaatattggatgagtatcgtaaacatttttgggttacgttgagattttcatgccactagaatttgttctcattggattggacatgcagtgtgttttctctttgataccagaaagtgattttgcctgtcctgtgtgatatctttaaaagcaagaggtataggaatgcttgtgaggagagaactctgaagtagttattggtaaggacaccctcatagtgaactttaaagaaacgaagagaggccaggcgcagtggctcacgcctgtaatcccagcagtttgggaggctgaggccagaggatcacttgagcccaggagttcaagtccagtctgggcaatatgtaagtgagaccttgtctctacaaacagtttaaaaattagccgaaagtagtaggatgcacacctgtaatcccagctacatgggaggctgaggtgggaggttcgattgagaccaggaggcagaggctgcagtgagttgagatcatgccgctgcagtgagttgagatcatgccactgcacttcagcctgggtgacagagcgaaaccctgtctcaaaatataaataaattaattaaaaaataaagaaatgaagttattatcattctacttctccagactgtggtttatctgtgccatttctgcattttttggggacagcctttacttaggtaaggctacccttctgcagctttgttgagctgtggttaaatcttcaggctccagagaaagaggcagtcagttatctggaattttggttctaccacttctagttataagactttgggcaagttatatcccttcaactgtctcatttgcaaaatagagtaatagtatctacttcaaaggatttggataattgaataattccatacttgtaaattgtttagcaatggcgtctggcttgcaatgttagctgttattaagaagtgagtatttgtgctttgaaattttctttttttctttttaagattttaataataaaaaattattttattattcaataataaccttaatattattgaatttgatataatttaaaaatatcttcaagagagtcaaaacttattttaagataatgttcttttttgtaaaagacaaataacttgtatggtttgcaaaatgatctgaatatgtgcttttataacattcagaatacacccaaaagtaaactttaggtttaatgtacagtatgttttctatgtaattgttttgaataagtaatacatctacatggcttaaaactgaaaaacgtattcctgttacttcttgatgcttttgagaaatgaataatgttttctcccttttaaatggtagtacagcatgcacacttttctgtgcttgcttttttatctcatagtatcttgtggagctgttttcttaacagtcccttctccccaaagtctcccttttttttgtgcatgtccacattctggatctggctgattgcttcttcctggtattaacttatttcctcacacctgtatttcctgtaaactggtattcagcatattctgaatccaggctgacatttctagatcaaatggaagattattgataccttttttcccttaggttgaaatttttgtttctaaaaatgttaacataattacatatttgctttatcccaaacatatgtttccaaataccaataccaatcttactgttaacaaaagaatgctgaaatgcgaagtgtgatttctttgcatttctttttgatcttagaatatatcacactaacaatataaagtcaaaatatatgtttaaattattcaaagttattcctttctctgtgtggttaatgccaccaccttaatatatagttagactcttttgttttcatttattttcagtacttagggactgcttttctcatttagattcgatttaatttttttaattatgtaaaaacatttacatggttcaaagtcacaactataaaacaaggtacatttggagcatcttgttttcgttttttgttccccagctgccttctcttcctccttaataggtcactgtttctattagttgtaagtttatctttgattgtttcttttaaaatttaagtgtgtgtgcgtgtgtattttccttcttacacagaagagaacatactcttttgcacctgcttattttcatgactgagataaattcatatcattatgtagagatcatcctctttccttttacagttgcagagtattctaccatgtagatagatgtcaattcacacttcccccctagtatttaatatttgggttgttttcggtcttttgttattataaagaaagtcacaatgaataatgatctaatgaatataccatttcatatctctgccagcatatctttgggataaatttctagaagtgggattgctgggtcctgggaaaatgcgtatatactttgcttcgatattcccaaatccttctgcataagtctggtgccacaatgtttgtcacaagcctcacaaacagaatatattgttaaacgtttggagttttgccagtttgataggtgagaaacggtatttcatttttcttttaacgaacaaggttgtacatctctaagggtcacttgcattttgttctataaagtgtctattcatgtgtgctgcccattttctattgaaaggagttttcctctcacaggtagcattatctcatggatttcaagttggactatttggttggggcttcatttttacttctgtgatcattttaatttgaaatttgggttagggtaagtttctttttttttttttttttgagatggagtctcgctccatctccaaggctggagcacagtggtgtgatctcggctcactgcaagctctgcctcctgggttcacaccattctcctgcctcagcctcacgagtggctgggactacaggcgcccaccaccacacctggctaatttttttgtatttttagtagagaaggggtttcactgtgttagccagtatggtctcgatctcctgacctcgtgatctgcctgcctcagcctcccaaagtgctaggattacaggtgtgagccaccgcgcccgcctgggttagtgtaattttcttaagccaccacttgttcatcatttcacatgtgttagatgtgaacttaagctcatgtgttttcagtaatagtgttgtgaagatcaagttcatttttaaaacacttgagagttttttgaccttcgctagtgggatgggtaggaaaacaaaaagagaaaccttcagcactaatattataccctcagaatctacttttgttcatttggaaacaaagtagtataaaacaagcaggaagattaaaatacaactataaacatcagtgaattaaaaaagaattccaaatcttaaaagactgaatgttcagaggttattttacagacattagttgagaaaaaaatttgtcttatagattatatcttcaaaataacaataagccagagatatattcagagagactaagaggtcagggttcgttgatacatgttttctgtggaacttctgcagattttcatttaactaatgtgaaactggtatttttcaggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaagtgagtatattttgtgtacatgcttagatggtcgtaccgtaagaaaatagatttgaagttagactttgtgtagttccatagtatttttactgtctcttctttaacataccaaaaaggcccctcttctaatgtcttcctgtttttaaactttctttagatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaagtaagtaaccctaccatgctagagatttctagaagatttgttgtgtaatatttttatatcgattacttatttctaactattttcgagggggcatcaaattagaaattagtatagtcattcttggaaatacttccatctttagcagattgtggcactgtttcacggatgaagataaagggaaaagacagtagccaggtgaaattttggggaaactgtaggagaaatcttaaaattctggtatttaattataggtcagatttcattacaataaatacccaggtgagtttgttaatgataaaagcattccttggccttagttattggccctttgtttaaaagtacatttgaaacaaccatatttcacttcctcacgtaaagattgaatgtcaccttggtattctttgtaatggaattaaacattggctgttcttctcccacaaaatcgagcctcccaccctatctgttgcaagtagcaaggccatggttggagctataagcagggaaggctgactggctcaaattttggtaggatttgctccatgttgtgctcctggcagttcaacagtgctcatcccatctggttttaggagggtgacagcaccctgccttaagcactgagaccagattcagtctggcaagagacccagttgttgtagcaaggaacagatcatgtcctggcgtagctcagtgctctccggcaatgctctaagaagcattttcaatctaaaacgaagctttaacctagctccagggattccctgctcctggaaggaggaaatccacgacggctgggatgctctagcagatgaagccacaagcccctcctacctgagttgttctaccctgttaacagcacaggtaggagccattgggagagctggatttctccatcccattttgtaaaatgagaacggctcgtgagggattttcagtgactgggagccatggacatgagataggatctgaggctttatctatattttgggtggttggggagggaaaggactgtgctcagtttttgttgtctctgtttatcctgatccactaaccaggatgtgggtggtggcgggtgcttctcttcctttcttgttgaagattctgccggtggagacagataaaaagcctcaggggaagcagctacagacccgagcggattacttgttgaagctgctcagaaagggtctggagaagaagggggctgtgacaggtggggaagaggtgagtacgctgccagctggttgtttttcaggggcctgaggctcctaccctgcagaattaggtaggaagagagaggccctctctgagcactgcacagaatgtcaccttctcatgggcatattttgtttttgaggttccagtaatgatgctttgcttggtaataatagaaatgttcatttaggcctggcgcagtggctcatgcctgtaatcccagcactttgggaggctgaggcgggcggatcacaaggtcaggagattgagaccatcctggctaatatggtgaaaccccgtctctactaaaaatacaaaaaaattagccgggcgtggtggcacacgcctgtaatcccagctacttaggaggctgaggcaggagaatggtgtgaacccgggaggcggagcttgcagtgagccgagttcgggccactgcactccggcctgggcaacagagcgagactccgtctcaaaaaaaaaaaaaaaaaaaaaaaaaaaaaaaaaattcatttaagaccacggcatcttggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatagtggatcccagagataaaatggacagttgtaatgcacagttaattcagaaactagaccttacttgctgtgtgaaataccaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcattcttcatataatatgttgagtatgcaatatattatgtgttaggctctggaaaggcagaggttagatcatgttacagatcatatctgattaggcagataaacagtattttaaccttttccttattatatgtaacttgctttcaggttttttaatgttactattatgtctttaatatattatctttatttgtacttttgtatacagagtgattttccttttttaaaaaaaattgtgtctttaggatggattccaaagatgtggaatcagtaggtttaaggaatatggatattttggctggcaaggtggctcacacctgtaatcccagcactttgggaggctgaggtgggtggatcacctgaagtcaggagttcgagaccagcctgaccaacatggcgaaaccctgtttctactaaagacacacaaaaaattagccagtggtggtggcatgtgcttgtagtcccacttagctactcgagaggctgaggcaggagaatcgcttgaacccgggaggcagaggttgcagtgaggcaagatggcacctctacactccagcctgggtgacagtgcaagactccatctcggaaaaaaaaacgaaaaaggaatatggacattttaatgtggtataggccatgtataaggcctataggtttttatttgttttggtttggtcttgtgaggtaaaatgagttgcactcttttgatttctttggaattttcttgtttgaattatatggctgctactgctttaaagagtcatcatgttgtttggttatgcttttgagtgtcttgatttgtattttaatcatcattttctctccttttccaggccaaattaaagaagcggaagcctcgggtaaagaaggaaaacaaagtgcccaggctgaaagaggagcatggaattgagctttcatctcctaggcattcagataatccatcagaagagggagaagtgaaagtatgaagtggggtttcggttgagggttatttatttattttagctatacttatcatgccagctggaataaaatcatctgaaatgtgtttggtttacgagtggattaaatggaaatagaatatgtaagtcttcgcttaatctgtcagcgaggatagtttaagtcagcaactgcaaatttgtacataatggaagtaaatgaaggggactatgacatttttgttgttgttgtttgtttgtttgtttttgagatgaagtctcgctcttgtccgcgaggctggagtgcaatggcacaatcctggctcgctgcaatctctgcctcccaggttcaagcaattctcctgcttcaacctcccaagtagctgggattacaggcacctgccaccacgccaggctcatttttgtattgtaagtagagatggggtttcaccatgttggccaggctggtctcaaaactcctgacctcaggtgatcttcctgcctcggcctcccaaagtgctgggattacaggcgtgagtcaccgcgcccgtcctaaagttttaatgataaatggcgattgacacgtagcctcattcttgcaaatgacggggagtggtcaggactgtggttaaccagagagctcatgcctaatgtaaagggggcagctgctatggagttctgttaacaaaactcctgtgggtcaggtttggcttgccagtttgtaacctctggtctaagtaaagtgaatagtaagttggtatcatttagtgtgctatttcagtgacaactttatggaatttctgagagtgtaattgtacttggatattagctccaagaggatcagcagtgtgtacaggaactagcatggatttgagtcatacatacagatatttatttatttattatgagttgctttttgagatggagtcttgctttgtcacccagggtagagtgcagtggcgcgatctgggctcacagcagcttccacctcctgggttcaagtgattctcctgccgcagcctcccaaatagctaggattacaggcacctgccaccacacctggctagtttttgtatttttagaagagacagggtttcaccatgttggccaggctggtgtcaaactcctgacctcaggtgacaggtctgcctcagcctcccaaagtgctggaattatgagcatgagccactgtgcctggccaatacatacgtacatttaaatactagcaacctaatcagttattagctgactttgtataggtatataatctctttggtactcagtttccatccgtgaaatgagaataataaacttacgttgaagggttgctatgagaattaaatgagaggatatcagtaaagagcttctgcctctacagttgtaactggttattactggaaagtttagacttctctgagtcccttgaggctatttgcttgaaaacaagcttctaagtatagacagtgatgaaccactgggggcagtgcttctttttccagaaagtacataagtagatataaaatttgtagcaaaaattcatagccctgttttgtttcctaggatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaaggtaatgatgcccttctgttcatgcagatatccacagcctttgcaattcgccatttggatttagaagtagaatgagatttgagggccctggaataattgtctttttatgggtatgttcaagaaggatgggtggggccgttgatgggatacctgcacctgtccttgcagagagaggggaacctgcaagtttggggtgttctttaaaaaagaaggcctttacttggtcttttatgacatatttcagggggaaatgtttgaatgagataggacaggtgagagaaatcggcatttacatgtaaatacgaaatacgttctcagattcatattagaggagcacaatccacaactgaatttgaatacttgaagagtttgagtcaaaaacaaatattagcaagagttattggaatataaatggatgaaaagccttgctattataacctttacattaggggttttatgaagttcattctaaaccaaagaatttggtacagtgttgcagtgtatacttgctgacctctgaacacagtaaaatcattgccaaaacacaaacaactgctgtaattctaatatccagttgataactctaatagatttcttgataagtgcctttgaaacttttactttgaaattttatattaaatataaaataaacttctatttaagaacaaatataaaaatcagattaggctgtttgggtagtttttcctcctcacttagcagtatatcacaactttccaagtgattaaatgttaaagtcatttttacagccttggcaacgtagggagacctcgtctctacaaaataaaaacaagcaaaaatctagctgggcattgcggcatgtgcctacgggcccagttgcatgggaggcagaggtgagaggattgcttaggcccaggagctcgaggctgcagtgagccatggttgtgtcacacttcactccagcttgggcaacagaggaagaccttgtctcaaaaaaaaaaaaaaaaaaatcatttttaatagttggggaggattctgtttgggtgtaacatgttagaagcaatttgaatttcccattttgaaatactttctaatttttgatgttaatagaccatactgtgataaataacctgtgcatttgtgctcccacagaaagacattatttttcttaaagtaaaatattaaaaaaataaaaaaagagcaattttagcaaacatctgtttatccactctccagataccacaactgttgttaatattttttcatgtttactttaagtggctttttttttttttttggcggggccaggcggggggagacgctgatatcttttgtatttcatgaacatatgactgatactgttgaagctgccccctgttccctttccctgattttattactcttcctctgttttccccataaccactactgtgaagtgggtccgaaaccttcctgttcatgtttttatatttgtagtacatattatagtgtatatccatataactataaacaaagcatactgtatgcttaaaaatgtacatgaagtcaagctaggcgcagtggctcacacttgtaatcccagcactttgggaggccgaggtggacagatcacaaggtcaggagtttgagacctgcctggacaacatggtgaaaccccgtctgtactaaaaatacaaaaaatagctgggtgtggtggcgtgcgcctgtaatctgagctacttgggaggctgaggcagaagaatctcttgaacccaggaggcagaggttgcagtgagccgagatcatgacgctgcactccggccaggatgacagagcgagaatctgtctcaaaaaaaaaaaaaaaaaaagtacctgaagtcattttatatattcttctgcaacctttccttcaatgtaattgagatttgtatagagttcatttacaataatgtagttaatacagattcctaaaccaaagggtatgctgttaataaaggttgctacatgatactctagagagttctgccaatttacaagcttaacctcttgatgacatttctgtgcattttatggataaaggagtaagaagcccaaaaatagcactgatgaaattgaagttataattgggtacatttagagatggaaatgggaataatgtgtgagtaagctgctaatcagacaggtttgtcttcatgatgtttcaggattttattttactttttaaaaaataaactgagaccatcatatttacccattttaataacacaacataggtaagaaacctaaatcgcacggtaggattgcacaaatgacaatgactccttgtaactcttttttaaaagcctaaaagtggtgatgccaaatcttcgagtaaatcaaagcgatctcagggtcctgtccatattacagcaggaagtgaacctgtccccattggagaggatgaggatgatgatctggaccaggagacattcagcatagtaagtcttgaaatcggggggtgccagtgtctgcagccgcggtacttgctgtggctctgccttttataggtccagccagagcttcagttgagctaagcaatagtacattacttgggaaacacattgcttacagtatcggaagaccatgtgctcttcagcaggctggcaggaagagattttcttgtcttttattgaggggaagtttaaggagtggatttcatgtcttgtgctcctagttaagagaggctctcagggcccttagaggcatttgggaaagagaagtgttcactgagcaagtatttattgaatgttttctgtgttccagcccccagagttaccatgttgaatagataaccatttctatcatcgtaaactgtacattggagtaggggagttagataactacacaaatcatgttggtgcccctgtgacagggctctggaggagagagagtgcatactgtggagatcctgtgagaagggaatttgacctagtcaggggttgccaggagggcttgtgtaaggaagtgatgtttgagttgggttctgaaggaagaataaaaggtaacaggagaagaggggagggcaaggcgatggggagcgagtgcatggaccaggtcttgcacgggattggatacaggccagtgtgtcctcaaggtccctttgcccctggctggagctgcaggtatagatttcactgtgccaccatcccttccccacctctctgtggtctcttctccccatacttccacaaatccattaatcaaacggctcattcaggctgaaagaaaaagcggttttctttcaaatttgaaaatacttccatcctgtggcagcaaaggaccctgttgaccctgtcctgtaacctctctctgacttctttctctgagttctctaaaacctatacacgtatgtatatagatattgttttctttgcacttaactctgttttcttaagtctcttttttgcctgtgagctctctgaggacaagtattgttttatataaaggtcatttagatgctagaagtatatcaataaatgagtaaattgaataaatgaataaactaattacatagccagctaaccaatctgtttcctagtctttcttttccgagtgtttataagagaaaatgatatctaatgttctatggtaccatgatatttaaaaaatgctcttacaaatgactcatttaatcttgtttttatattatgaaatctttaaaagatgcagagaaatttcagggatataatagtcattgataaatataccatgaagttttgtcaaatctgaatttttttaagactcaaaatataaagctgaatcccttggtgttcctccctctcaacctatgctttttctgtctctctctctcttttttttttttttttttttgaggcagagtcttgctctgttgcccaggctggattgcagtggctcaatctcggctcagtgcagcctctgcctctccggttcaagcagttctcctgcctcagcctcctgagtagctgggattacagatgcgcaccaccacacccggctaacttttgtatttttagtagatatgaggtttcaccatgttggtcaggctggtctagaactcctgacctcatgatctgcccacctcagcctcctaaaatgctgggattacaggcgtgagccaccgcacccggccttttctctctctcttacctcccagacgtaaccatgattctgaattcgatgtttatacttaacgtgtggttctagagttttactgcttaagtctgtaaagatgataatagctcacattaatagccagttactgtttatgtgctttatatatattttttccacaacactcctgtgaggtacgttagtgtttccattttacatatttaaaaataaggtgaagagagttaagtgatttgccctgtgtcacacagctaagacatagaacacagttttgacccaggcagttcggcatgagaggttgggtccataaccattgtcctacgtagcctcccacatataaacaacatagaggattgatttccatgtcttaaaactgtaattggcacttgtgtatcctgtaacttgcttttcctctcacagcagtcacatttgttgagatttatctatattaataattgtggctgtcatttaagtttcatgttattctacaatttattcttccacagtttaattttttcccgtattggtggacatcaggatttttccaaatgtttgctactacaaataggctacagtgaaattgttgcccatattttcttgcactacacaagtgagaacttctctagggtgtatggcttgagcaaaaatggtgggtcattcattaggtgtacacatctgccactttattagatactcgagttcctcttgaaagcagttgtagagattgcatgaattatagcaatgaattcaagttctgattgctgaccagccttagaaacagttgttaatttctgactcagttaacagttgttaatttttgctaatctgaggactatgaaatactgactgaaggtcgttggacatttattttcatattttagtggtcattcatgttccttgtgaattgcctattcagttattcaaaattgacatatttggaataatttatctttcttaccttttctgtaggaattctttttacattcttaatactaatcttttattttttatagtcattacaggtgtcttttagtttttggtatattttttattttatgtcctttttaaaaattgaagtataacacagaaaaatccacaaataataagtatgtagctgtggaaatgaccacaaagtgatggggaatttgtagagttttcattatttgaaaatttcatgaccatgtgtcttacttagttcattgtgccagatactcagtggctgacaaccatgtccctacaccattctgtgaaattttcttgaattatatggtggtaattttctctaagttcccagttttacctttatggaatttcttgtgtttggatatcgaattctggatattggtccctaattttactttttaagttgttcatttctgctttttactctactttctgggagattgcttcaactttgtttcacattatttctttccaagatctttttcctccaccgctctcgaatatctttatacttctctttgctttccattgttcacgttacacactttgcttcggtggctttgctgaccctcagttgtcagctcatgtttaagagtggaggacgaaacatgtgattggaagtttgagcatgtgggtggtggggcttgatctcctttgaaagttttcattataggatgatgtagcagaaacttctgacagatagtcaggatcatttggtgtttcctctggggcggtcacattttgtgaagaatgccccagtttcctgactctccagagcgtgaaggcctggctccatccactctggaatgtgagaggcagagacctgggtgtgggtcatcctgtgtgactgtgctcatgtgctcaggtaatcctgttttcagtgtggtgggctcagccctcatctgtgcctgtgcagtcccgctcagaggtccttttatccttttctggagaataagtctttatatttgctgctggttggagttagagatctgggtatcttatgaatctggatatgtgttacttcttaagcagtttttaaaccgctccccattttagccctcatccttccttctgaagacacctcgccgttgggggaattttgccgtgtaagtcaggttagttctaggctgtcttccctcctggcttcgaatttcattttctcaggtctgttttgtcatttcccgtgctgccaatattttgttgccattatcctctctcttgttttctcttgtctttgtgggcttgtctcttttaaggacagtccctttaccattgttttagtgggattggggaggcagagaaaagatgcttgtgttctgtttaccatcttatctggaagcctttctcttgctttctttcaagcctgaaggatttgcaaatattatatcccgtatttttagacagtttctggtgggagaatttcagattaggtctgtaatactgctgctcattagatcttcaaaatgggcttgtgaggcatgccatgcctctcttgcagatgaggaagcagtatttagagaggttaagtaaggcgtgaagggttatcacataactctaagcgatggtgctggcactgcacttcagggttttctgacttgaatacttacacttactccactgcactagctttacccactcttcctctagcaattatatggcataggggtgggctgtgttttcatcgagagcacagtaagcaaaggacaagacttactttctgcagattgtttatgtctttactctgttgtcctgttgcagtgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggtaaccactttggcctcgtctgcccagtttgatttgactgagtgtgggagtggattctgttttcttttaataaaaggtggcatagccacctaagaaatctttctcccagcacaactcatctattggcaatatacctgcaggctttaactccctttccatgaaataggccattccactgagaccagccttttgaaggggtaggacgatgtcattaatttattttatgagagaaagatagtgttactggatttgctggtctattctcagaaataaattttctttaagcctacaaggggcaaaaatcatctggtcttaactactttacccatctcaggttgatatccagatattcagatattactgtatctaatacaactaattggttggttctgtaccaacacatggtgacacaaagattaaaaccgcaagaactatgagttctctattctcatatgcttttttagtaattaaagtagtaatttggattaagttaatctagaacttcagtgtttaaggcatcatggtttataaatgttcctttatatagccactgaaacttttttaaaagatttcaatagttttagggaaacaggtggtgtttggtgacatggataagctctttagtggtgatttccgagattttggtgcacccatcacccgagcagtgcacactgcacccagtgtgtcatcttctatccctcagcccccttccccccagagtccgttatatcatttttatgcctttgcatccaatgtttggttttccattcctgagttatttcacttagaataatggtctccaattccattgaggttgctgcaaatgccattattttattcctttttatggctgagtagtattccatggtatgtatgtaccacattttctttatatacttgttggttgatgggcatttaggctggttccatgtttttgcaattgcagattatgctgctataaacatgtaagtgcaagtgcctttttcatataatgacttcttttcccctgggtggatacccagtagtgggattgctggatatatatccactgtccactttggatattttaagaaaacatgactggaaatttttttttttttttttttttaaatgagacagagtctgactctttcactctatcgcccaggctgaagtgcagtggcacaatcttggcactgcaacctccacctccctggttcaagagattctcctgcttcagcctcctaagtagctgggattacaggtgcctgccatcacgcctggctaatttttgtatttttagtagagatggggtttcatcatgttgaccaggctggtctcgagctcctgaccttaggtgatccgcccgccttgacctcccgaaatgctgggattacaggcatgagccactgcgcccagccatggctggaaattctaaaaggcaattgtaacattaaatctctttccattaatcacagttacttcgtttttattttattttagactcagagggtacatgtgcttgtttgtacataaccacagttactttgaacttgtatatagttcatggataatgtgattatctttgtataatatgtccaatctcagaggactggtttttgagtgaaaagtggatttaagaaaacttctgcatgatggtgtccacagcatgcttcacacctataaagaaaagatttaattttcaaaatggtacttttttttccgcttaacactgttaccaacttctttctttacctagcggcatctggccttttttttttttcttctttttaaatttaacactgattagaagatagcaaaaggtcatcccagtgaacagacccatttttaaatgtgccaggcactgtgatcttggctagcagtagtttataaggtcctcgccctttacaagtcaaaaaagtagtacaaggtaagccctcggagaaactgttcgtcatgaggcagcaaatgcaagcccagatagagtggaagtgttgagaaggaagtgcgtgaagagtagtcaggaaggaaggtcttctgagaggcaggcaggtgcacttgaactgagcatacatgagctgagtcgaattgctgagatgaacagagttctcaggcttcagcaaaggcttgaaagtgggacagggaggggactgggtggtgttcaggatttaaagacagtttgctaaaaagactgaagctctttataggaggctttagacaggaaggtaaatggctcttcacctgatgcagcaggcttactagttagggagcctgtacaggtggtcctgtcagcagcaagccatggtgaaactacctgttaggaagtttgagaagatatgagactcctttatctggctcactctgactacctgtgcttactctttctaaacacctgtctcatcatatcattcccctgttgcgcagtaacaccatgctagggtgaacataatggaattggagggaaaaagccactgagagttttaaggaagaaatgaaaggttgtggtggcgacaactgggaggaaggaggggcagcaacacagagatgaccaactgaatggaggccacaacctgggagatggtggtgctgatggatttgtggtagagtccagaaagtgaaggaaaacttaaaaggactggagtctggggtgtcattgatagaaatttggaggagttctaggtattgatagagccttagtctctaaatccctctgtcagactcttttggcagaaccatgtaaaggtgtacggtaagtcctcacataacgttgtttccttcagctttgtttcattataacattgatgagaaaaaaaattgattttgtttcccttaaagttgcaatttccaagaacctatcgacaacattaagttaggacttactgtattattaatgcaaatacctgaaataatatttctgtagcttaatttctatgcttagggagtataccacagcaaaatttaatagcttgccatccatgaagatcataaaaaattgcttttctaattctataattcaccagaactgttcatttttctttttaggaacctatggatttttgtttccaagtttacagaatttgatgctcgaaaactgcataagttatacaagatggctcataagaaaaggtctcaagaagaagaggtaaagtacaaattcagtcctaattcatacaaacaaataccaattccacagaaaaatctcttaatttttgtttttccatggggagatgatcacagaatcatgggttattgctggtgctaatagtcaaacaataagaccagatgggtgaaatagccaatgtattggagcctaacatggttgaaattctgacaaagagtgtttaccctgtgtttttaggtcctaaaatcatttgttcaccaggttttttcttccatttgcatttttcttctgtacatgtcagtagcttataaatgtggctcctaggaagtaatagggtggtgggcagaaaatactttttctcttcttttctggaccatctatttggtgtccttccagcttttgtatggaaggggtcctgctactcacttgtgagaggtgctcagaagttgcctctcctttggaatagggggatgggtgcagaagtgacatggaggaggctgcagaggcagtgctccttgtgtgggtgtgcccatttgcagatctgctgacttgccacatgggctgtacccaagttggacattgagttcaatctgtgagcattaaataccacctccactaatgcgtcagctccatgaagacagagattttatgtctctcatctactgctgtgttctcagcacatagaatggaatagaatggtgctggggacagggaagcactcaggagtatttgttatgctgtgcccagtgctgtgttggcctgtgaagcagcaccctcaagtagttgatgatttaattttacatggaagaatatgttatagcagtaacatacaggaatcatatactaataagcattataaaaagtctataaatggatagtccggaaaggccccaggagggaatgaaatagttaggaaaggccctttagaagggagtgaaaattaggaagagggtctgaagttggacacataatcatgaaagacttcattcatttagggatcagaatgaataacaaaacagtataagctgaataacaaaaacagtggtatcctactagtgggagtatacattgtcacaacctttctggaggagaattcagcaagatttattaaaagactaaagcatgcagttttgcttccaggaatttagttttgagaaggagatagagatttaaacatgtttataatggaaatggcttggaagcccaacagtaagaaatacattcaatgtggctaggcgcggtggctcgtgcctgtaatcccagcactttgggaggctgaggcgggtggatcacttgaggccgagagttcgagaccagcctggccaacgtgatgaagcctcatctctacataaactacaaatattagctgggtgtggtggcacatgcctgtagccccagcccctcaggaggctgaagtgggaggatcgcatgagaccaggaggtggaggtagcagtgagctgagatggcatcactgaatgcctgcgacagagtgagactctgtctcaaaaaaaaaaaaaaaaaaaaaaaaaaaatacagaaaacaaaaacattcagtagttcatgatatatccatattggggagtattaatcagttattaaacataatattgtagaaataagtatttacatggaaagattttcacaatacatgaagtgaaaaatgaataccaaatatttttgtttaaaatataactacaaaaaaaagcttagaaaaatacgtgccaaattattaacagtaattcccttgctggttaggatttgggtcactttattttttttattgtgtgattttttttatatcaaacatttgacttgtgtgataaggagtaatgttactccaacattcagatatttagcttgatgacttgggcataggagttagttcccactggacagtcgagggttgtttgttgtggttagccttggaaagttggtagtcttggttttacatggtccaggatgatcctctgagagtgccgccagcctgggcgcctacaccataccctgtacagtgacatctagcagtctatgcatgtgttcttgcaggtacttagcagtaatggtcaaactcagcataaattccactgagttcccccagcaaatagcctaacagtggaatttatgagccttttttttgttaggaggtagtaaacgccagttcagaagtttaagaaggacaagaaggagctgtttagaggtgatagcctttattcttctctggggaattaagcctgggatcttgagcttctttggtttccttttactctttaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcaggtaggtcattaagtggagtttttaaaagaggtgccaaaagataaaaaattcacacagccgtttcattttccaaagacactggctagacttctgtgctttattatcttctaacactttattgtcctctcttttcttaatgagagaaagcatgaaataaagatcccccaatttttttttttgtttgtttgagactgagtcttgctctgtcacccaggctggagtgcagtggcacaatctcggctcactgcaacctccacctcctgggttcaggcgattctcgtccctcagcctcccgagtagctgggattacagatgtgcaccaccacgctgagctaatttttaaatttttagtagagacagggttttgccatgttggccaggctggtctcaaactcccggcgccatgtgatctgcccacctcagcctcccaaaatgttgggattacaggtgtgaaccactgcgtctggcccccaggactattatttcaacttccgattaagaagaacccagctaacatgaacaaacgaaaaagactgagggagaagtttacattctgtatgacagtgaaatggttaaaactgctaatcttgaaagagctcttgtaaattgagaacaaaacaataactgaatagaaaaatgggcaatcaacagagtgaagagacagtttatgtaaggggagaaaatattaccaaccgtacatctgataaggggataatatccaaactgtgtaaggaactcagctccttatgtagcaggaaggcaaatgctcgattaaaaagtgggtaaaggacctgaatagacatttctcaaaagaagacatacagattgccaacaggtatatgaaaaaatgctcagcatgactgatcatcagggaaatgcaaattaaaagcacgatgagatatcacttcacacttgttaggatggctagtaccaaaaagtcaaaagataagggttgccaaggatgtggaggaaagggaacccagcgcattgttgctgggaatgtaagttagtgcagccattatggaaaacaatgcagagatgcctcaaaaaaatcacaaacagaactaccatatgatgcagcagtccctttaccaggtatatattcaacgaaaatgaaatcagttatgttgaagaaatgcctgcacttacatattcattgcagcattatttacgatagccaagatacgtaatcatcctaagtgcccatcagcaggtgagtggataaagaaaatgtgtatatacacaatcgaatagtattcagctttaaaaagaaggaaatcctgtcgttcgcaacaacatggttgaatctggagggcatttatgttaagtgaaataagtgaggcacagaaagagaaaaactgcatattctcacttacgtatggaatctgaaaaagtcaaactcatagaagcagggagtagaacagtagttaccagggtcggagggcaggggagaattgggaagatattaacaacggagataaaatttcagttagatatgaggaataagttgagaaatctgttgtacagcatggtgactgtagttaataacaatgtattatataagtgaggtagtgcatatgttaattaggctgattgagccattccataatgtatatgtattttaaaacattgcattgtaatcaataaatacatacaatttttaattgtctattaaaaaatttgtacagtctgggcaacatagactcagtctctacaaaagtgtgaaaattagctaggcgtagtggcgtagtagtcccagctacttgggaggctgaggtgggagaatttcttaggcctgggaggtggaggttgcggtgagccaggattgcaccactgcgctccagtctgggcaatagagtgagaccgtctcaaaaaaaaaaaaaaattgcagttttgaaacaaaactcaaaggaatccagattgaattaaaattttggaaatttgattagaaaaaaactctgtggagcttatccattgttttaaaacaaaatgagcaaaagttatgaattagacagttcatgtaaaagagaaaattcaaatggccaatatgacgagatgaccaaccttgctactaggaaaatataaattaaagcaacaataggttaatcaatttttttacccattcagatcatcaaaaattaaaaagggaaatacacaccgattgctaagagtgtgaattgctataatctttgcagaaaataatctgaaaacccactctgcgggttgtctgttcctccagcagtggtccctgcctgggaaagacccagatccttagcctgttgcaggtgctcaggatcactgatctcttcagtggtgacagaagtcatctcttaactctttgaggttttctgctctgtggaatcttagtccttctagtcctcattgctttagctgctctttgatgcctttaaacacttctttctttttttgggagatggagcctcgctctgtcacccaggctggagtgtagcggcggcacgatcttggctcactgcaacctccacctcccgggttcaagcgattctcctgcctcaacctcccaagtagctgggattacaggcacacaccaccatgccgggctaatttttttttttttttttttttttttttgtatttttgtacagacagggtctcaccatgttggccaaggtggtcttgaactcctgacctcaggtgatccattcgcctcagcctcccaaagtgttgggataacaggcgtgagccactgcgcctggcctaaacgcattctttttaatcttccctttctcattgtttttggcaggatgtaattctgctacaagctaccctgcctggaagcattacgttctatgttctgtaatcttaaaaatctgagttcaaaattatttcatcaccattttgttgagggaaagaaagctaatgattttgcagaatgattgggaaatgtttccctgttcttagatgtagttgcatcagttatactggcttttttctagtattaggctgtttttgtgttttgtatacgatgtcacttattttatattctgaatcctttacaataacttcttactaaatacattcttttatttaaaccttggattcctcacccatctttttaatagctcaatactttgtaacctgtgatttacctcacagagggtttaagaagaaagaaaatctctttgatttactccagaaaaaatgaactagcttgagttttaagcacctctacaaaaccacagacattgacaccctgttagaaatctcactttccatttgatatgaagccatcctcaagtgatccttcgcatatttagaaggtgtctctttttgttgttatttgttaattcttagggtgaatagtcaaaagttttttactttgtggtgctctcatctgatctacccaggtcagccatgaatttaagccactggtggactgtacatcatattaatgctatcagtttctgagctcagcacttccttaatggtgttgttcttcagctctgtagaaaaaagctggaaggccagtaaaatgagtagagacacttatttggtggcatgtctttgatcttcacataattatagacagaagatggatttttccatgaggtcataggttccttttggttagtcctctgtattagtttcctagggctgtatataacaaagtatcacagactaggtggcttcaaacatcaaacatttattttctcacatttctggagaccaggaagtctgatatcaaggtgtcagcagggttggttccttctggaggctccgagggaaaagctgttccatgcctctcttctgccttctggtggctgccagcagttcttggcgttcttgactcacgccgatttctgcctccatctttgcatagccttctcctatgcatagcctgtcatagctccctctgcctttattttgaaaggatgcctgtcctggaatttgtagcccaacctaaattcaggatgatgtcatctagagatttttaacttaattacatctgcaaagacctaggtaaaatcacactcacaggctctgggtggacatgacattttggtagccacagtttaactctccatccctggacttctgtgtcttcactacattttctgattcaagtgagtatgattcttttccttaggagaaaaggaaggctacagaagttaaaaggattgtagtttggccttaatccgtaagagacagagcactgatccaagctcaaagttagagaaattacttttttataggaggaggtccatttttgtgtgtgtgtgcagaatagggaagaataatagaatcggtgagtgtagtctggagagattttcagagaccaggcacagcaggtaccagcaggtgaaataaacgttagatgtgtaaccggaggatattactcgcagctgtgaaactcagcggtatcattttctgaattagtttggttttgttgttaagagtctgccacagattggaaggttaaacaggtatggagagtgaaaagcggtagttgttaagatttcagaaggagaggagtagtaaattttgccttaaaattttgttggaaagaatgtttaggagtcattactgatacgttagccagcagcaacaagaccaagaagaaagaaatttaatgtctgtttgtaacatgtgtcaggctttcagtttgaacttcagcaaagtagtgcttacttcagcagcatacctacaagaattggaacaatacagagaagattggtgtggaagaaaacaaaaataaaaaataaggctgggcgtggtggctcacagctgtaatcccagcaccttgggaagctgaggcgggcggatcacctgaggtcaggagtttgagaccagcctagccaacatggtgaaaccctgtctctactaaaaattcaaaaattgggcaggcatggtggcgggtgcctgtagtcccatctacttgggaggctgaggcacgagaatcgcttgacccaagagatggagattgcagtgatctaagatcgtgccactgcactccagcctgggcaaacagagcacgactccatctccaaaaaaaaaaaaattgtagtgaaagtgaaattcatccatttcttgcagtcatcagatcattctttcttttcctgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttgtgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccgaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacaacattggaggtcacatttcaacatgagatttggaggggacacatacccaaaccgtatcaccatctggaggtctttggtgtggctggtgagaacaggcacgatgccagttctttgtgagcacagggcactgttaccttcagtcttttcgggtggtcctttccctggccttgggtagtttccccacatgcacatcctaagcagtattcagctgtatacctgggaaccctctgtagatcttcaaacttctttctctgcagcactgtcttctctcatgccatgccctgtgaactctggccaccttggttccccatccctcaccttgggaagccaactggtgtctttctgggtttccttcttcctgtgtcacagcctgagggactatctcatgatagtgaacaggagccgttaaaaggctcatttcattagtgtccattcctcagggatcactgttcttcattgcctgatgtctggtgtcttgaaaaccactgttctatgcattttgtcccttttggctgtttcaggcaggatggtaaatctagtccctgttattccattttgactggaacttgagattgctcacttcttcctccctctttctttcattgaggtgaaattcatattacataaaggaactattttaaagcgaacaactgaatgaccttagtgcatttataatattgggcagccaccacttctatctagttccaaaacactttcatcagtcagagaaaaccctataaccattaaataatccttccccattattccctctccccagcctctggcagccaccagtttgcattctgtctctctggatttgcctgttctagacatttcatatagaaagagtcatacaatatgtgaccttttgtgtctggcttctttcacttagcataatgttttcaaggttcattcatcagtactcattccatccttatggctgaataatatttcgttgtgtggatatataccacattttgtttatccattcatctgttgatggacatttgagttgtttccatctttgggctgttgtgaataatgctgcagtgaagattggtgtacaggtacttgactacctgttttcagttttggatatgtgcctgggagtggaattattagtcatattctttacgtttttaggaaacaccaaaatgtttctacgatggctgaaccattttacattcctaccagcaatgtgtaagagttgaaggttttccttatctttgccaacacttatttcctgggttttttttttgtgtttttttttaatgagtatctccatcttcgtgggtgtgaagtagtctcattgtggcttgaacatgcatttccctagtgattaatgacatggagcatcttctcatggttttttttggccatttgtatagcttctttggagaaatgtctgttcaaatcctttgcctgtttttgagttgggttgtttttgttgttgagttttagtaattctttttttaatggtatcatgagcagtttaccatggtccaagctaaaaattttaatactcttcacactgagttggtttttaagataattttattaactagtcactcacttgttgcatatttaggttgatggtgttattaataacttacaaaataatttctgtggctctttttctcatgggctgggtccaggaatatggtaatgtttatggatcttaccagatttttcctaaagggagtgagtttgcaaaagccatcagtaatttttcaagtgtgtacttgtgtcactgcacacttgagccttatttcataggatgtattttgctaataagtgtaaaatgactctgttattaatttttttgattcctaataatgtgagcatttgtccttgaatatgagtatatgaggaagagccaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttagtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacatttaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaaca

SEQ ID NO: 2444 - DNA, 181857 bp, Homo sapiens
  source 1..181857: mol_type = genomic DNA
aactgcatttcccagcgccccacgcggcggcggccgtaaagcgcggcggtcgaacggccggttccggctgaatgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtgagtgtggggggcgtagcgggaggcctcggggctggacagggggacggggcgccgagctccgggtcggggctctaggaggcgtgagagcggcggcgaagggcgcccggggaagcccgtgtggtggttaagagcgagggctcgggagtcagggcgcctgggttcgaaccctgaccccgtcgctcttggctgtgtgaccttggacaagtcgcttaatttctcagagtctccgtatccccacctgtaaagcgagaggatgcgatttcagtttatggacacagactttgttcttgacggtgtccaccaagtttcctggcggggtacttcttaaactgaacagcttagagggtcaaaggcctgggtcctggagtcgggcagatctgggtccgaatctatctgtgtgaatgtaggcctcaggttccccacttgtaaaaagagtagagtgacagcacctgcttcctgctattgtgttgagagttggttggataagagaatgaacgttaagctcagaacacgtacaattgctcattaaacggcattaattattataaaagaacagattattttccgaggggagtctaagctgggggcatgcacgctgagacccaggattttggggcgattggggaggatgatgaaaaatagagacctctgaggagggaatgactctacagctctgggggaggacaggtggcagatagggtcttgggaccaggagtgcagaaattaagaggctggctttgcagccacacctgcgttcaaatcctgaaaccaccatttactggctgtgtgaccttgggcaaattacttcacctctctgagcctccagattcccatttgcaaatggggatcgtgaacattgtaatggaaatggaaggtgactgacccagtaggtacatagtaggtggccagtagtggtagctgtgtttattatcagctcagcgaggccttcccagaccaccctacctaacgtgctccccccatcccagttcctatccatcacatctttctcttgctttcattgagtgcttctccactctctgcgattattctttattttttatttatacttattttctgtcttctgttaaactggcacttcacgagggcacagactgcttggtttgttcacagttgtattcccagcatctaggactgctctctgcttacttaaagagtggaaaaatgaatgattgaattggggagagatgaagagcatgcaggccaggacccaggatttgggggcaggtgtggaggatgatgaaaaatagagatctgtatgaagggaaaggctttagggagggaaatggcggggatgctgaagaggggagtagacaaatcttcagtgtcaagaaataggcaggtttccagaaggagatcctgagactactaatgggaaaggaggaagatagggttagggatatggtgggaagtagtggaagggagacggggctgtggaaaggattggtgggagggaattagatagggacttctcatgtgtccccgggagtggggtaggggtagtggcagggccacagttctcagctgtgacctttctagcatggagcagcatttagtaaacgtttgtgagtcttgaagagtggggagcaggagggttcactatgtggtgaggggcacttttagagcaggaggtggtgagagaagacaaggggaggaaagaggcccaggacaagtctggggtgggtagggaggtggggatcttagatgggagggcagctggccgggaaagggagtggttgaaggatttcaggaatttatcgagtgggcggaggtggctgaggaggggaggggagttatccagaggaggttgggcctcctgccggcatccaggtacctccaggttctcacctaactctgcttaactctagcccttttaaattaccttaatttattaatttatcgaatgcattattctgtaccaggtatttgctaaggactgcctgtgtgttaattcccttagtcctcacaagtctgagttacaggaaccattattgtttccattttacggaagtggaaactaaggttcagggggcttcagtgacttgcccccaggtgtcagcagctgaagggtaccagaggcaggatttgactcccgagcttgtgctcattatactgtctttctgaataaaacttcccaataagtctgtttgagaacacttttgacttggctgagtctcatcgccaatggggcatctttgccagccagcagggaatggtaaacggtctctggttcctttgcagtatcctgggaactgcctgggttcattgtttagatcacatgtctatcggatgcttctttggaaacccaagttgcctgccctgaatcaggcagatcagcttaatccatattacagccccaagaacctgagatttgtgtattggtgggggggttagaagatcccccagtgacttggaaaagagttttgtaaacagccagtgcccaccctggggcttgtgccactctgcatttggctctgttggtaaacatcttgggtcttgggtacagaacagctcgttccctgagggagtttgcaggctggtgggggagacagctgtagagccagtgactgtacagtgtgataagtgctgagatcgccatggacccagggttctgtgggaacccttattgggagctttctggaggagacaacaccagcgcgggttctccaagaatgaacagaagccaccattggcgggcagcaggggcgggaggcggagcactgtgaccaggaccctgcgggttttgtggcatgtccaggtgggggctgatagctgtgggaaacaaggctggaagtaggaaggggcttgggatttatctgacacttcgggtgaccaaccgtcctggtttgcctgggctgaggggtttcccaggatatgggactttcagtgctaaaactgggaaagtcctggacaaactagtataaactggtcaccctaccagtgacaagtgacagttcttaatacactcttaccttgacctagagcagtatggatggagagggaaagtttaagatagttaaaagaattatttatttattattattattttttaaatacacaaggcatctggaaaccctcttctttttttttttgagataagagtcttgctctgttgcccaggctggagtgcagtggcacgatcttggctcactgcaagctccgcctcccgggttcacgccattctcctgcctcagcctccagagtagctgggactacaggcgcccgccaccacgcccagctaattttttgtatttttagtagagacggggtttcaccgtgttagccaggatggtctcgatctcctgaccttgtgatctgccctccttgacctcccaaagtgctgggattacaggcatgagccactgcacccggcctagactttacttttttagaacagtttgagatttacagaaaggttgagaagatagcacagagagctggaaactgtttttagcttcattattctttgtaacactcccagcttgcaaactggaaaggaattttcctgttagggttttacttttgctaaatggtagaaaacttcatacctgtggtctctgtctgctgaactgagttagtgatttagctcaggcagattgaagtagtcaagaggttatttgctacacaccatgggtggtttattgtccagattagtggcaaggctgtgacattgactgacaaatgtccaccaccaagcggaagcctgagtgatggaatcgtttgattgctactgaaacatcatctttaccagggactgcaagtctgcggctggtagaaattggtcgtttttgtattgtggccttcattctggtccactttgtgtgggggtcaagatttttggttccagtgacagaaacccagctagaattgccttaagcctcaaatggattgaatagctcatgtcactgaatggtctgtccccgctaaaccatggctgaatccaggtgtttggagccgtcagaaatcggcctttttccacctttcagctctacctttttcctgttggtgtcattttcaggcaggctgcaggcttacatcatatcagcttagcattcctgaggaaaaagagagcttcttttctcaatattgccagcagaagtccagaattgagattgagtatccctggaccagcaaggtctcatgccacccctgaactgtcactctggccaaaggtatagggggatctgattggccattcctcactcatattcccttccctggagcaagagtgggattagctccactcaagctagtggaaaagaatgagagaaaagagtggttccccatgggagaatcaggggttattgcccaaagaaggcggagaatggatccatggcaggtagacagacgcacacctactcttggtgctttcaagttttggctaaggtggcactgacagtgttagagcttggggtacaatattgccatgttgattttcttaaaatatcgtcttcaccatgccacatattatgggtcctaggctcccactatgtcacgtctaagttcttccaggccttcccaccatctagtttgggagcacagggagttaggaacatccttgttaggcagacgctgtttaaatggagaccaacggggtgagtcgttgttaccaggcagcggggtgtcaggtggaaggaaggatgtttcaggcagaggaaaaggcatttgagaaagcctagtggggcaaggggagcagtgcacattggcagaactcacgtggttcagcaggggagtgttcactgggtgaagaggaagtgaggacccaagctcagagccatgcttggcagtctccagaggccaggtcccctggggccctgtaaatcactttaaggaattcagactatgagtgagaacagtagggagccactgaaggttttttaactacagaaaggctgtggtctggctgaagctggcagaatggattggatgaggggcagactggaggtgggcctccacatgtgttggtggggcggggagcaggggctctgctgccgtcccctggtgagttacggtagcagctgctgtcatccaggtgtatctcctgttggtggtccactcacacacatacctcgcctgcccacttgaggtcccctgctcttttcctcctgcccatccaaatccctagctctatcccgaaaatgccagttcttccctaaaaattgccctggtgacttcagccaacaagagttttgctgtcttctctaacttcttctgtgcctgttcacactgtcccacacagttaacacattattatatacttctcatcgccaaagagtgggtcggctgttagctcctgtgcgttcttaaagtttcatctcggccttgagttagaccctcaggaagctggccggggttcctgtcctttggctatcagacattgtcttcctttgttacatatcttttttgttgttttctcccaatttgaacataagaatcatgaaagcctgtatggcttgttcagctgggtactggtatgccagcacaggacgtggcagatagtaagcaatcaacaaatatttgtcacaggatgaacgagaggcagacctctgttttcagaaaaggccagtcttttcccaacaactgcttgttctccccagtttagtcacagcacctgtgccacagccatgactttctctagggctaaagccctaaagaaagctagggtatagccctgcctataccctacacatccccggcccagcctcacttgccggccctgtttgacatctttgggggatgattcaccaggggaagcacagcctgtgaacaccttctctaatcctctagcctgattccaccctccgtgaagcttctccttgtcctgctggccagaaggctgaacactgaccagatggtggttttcagggcacagagtgggacacactggggaacgtctgcagggcctctgcccgagtgctgaacaggccagacagatacaggctctgtgtctcccatccctctaccacacctgagacattgttatttggagctgtgtggacattggggggtaaatttctaacccccagacctcctatcattctgcttatcctttctcatgccccaccttgcaaatgtacatttcaaaatcttgaaggaggagcatcctaataagctcattatggtgcaaggcatagcacgtgcagaaaatgctgtcactgaaatgaacttggacctagtattcctgtctctgaaatggactgaattgctaatttttgaaggatatggggcattattaactgtagtggtttaacctgtgaaattagtgactcttgagaaagcagaggctattgaggccagatttgtttacgtctgtcatccttggtgatgcacctcgagtgtgttggttacagtttctcttctccaggcatttcaaactctgaagctcatctgtcggtggagagttagctaacaggcaaagctcggatattgagactgcatctgcagagctcctgctggggatatgagaatactggctcttttccagacaaatgggagttagagccttttataaggactttccataagatctgatagtattttcatgcctttttggtttatctatttggtgtttttttaatttattttttgtgtgttaggcattcataacctcatgtaaattcttggccaataaaattgttgcttacttcattgtttgcatttctgtagtcctagaagggttgtaatcatggggtctggagttcagtctgcctggttgtaacctaggcacctcctgtgctgcaccagggccctgggcagatgcctcagctcccagagcatcatccccaaagggtcgattgtttctgggattaaacgaagcactcagacagagactggcagtaataggaagcttcatctgttttactgaggtacatacatagtttgagaaaacacgttgtcattctaacagtggttatcattgtaagagaaacattttaatttgctgccgttaagtagcaaggtaattattctgtcctttgaaacttttctgagataaagacacagctttccatacaaagatggtcatagcaacattgttatcactcacacaattaggaatcttaatgcccttcaaaagagttgctactgtgcttgtcctttcagtgtcatactgtgtagccattacagatatttgcaaacagttgtcaataaccaaaaaaagtgcttttgttttagctgaggtgggaaataagattggcactgaaatggataatgcaacatgacctcaactatgtaaatatccatagcaaagaaaaagacccgaggaaatagattgcaactccagcagcagtcatctctaggcaccacggttgccgtttctctttcattgttgtcaaagtttcctacttctctaaagtgaatgttacatttataatcagaaggttttattaaaatgggccgggtgagttggctcacacctgtaatcccagcactttgggaagccgaggcaggcagatcagttgaggtctggagttcaagaccagcctggccaacatggctaaaccccatctctactaaaagtacaaaaattagctgggcatggtggcctgcgcctataaactcagctacctgggaatctgaggtaggagaatcgcctgaacctaagaggcggaggccgcagtgagccaagatcacgccactgcactccagcctgatgacagagcaagactccatctcagaaaatgacaacaacaacaaaaagttattaaaatgtttatatctctgaggtggttgaattacctaatcttccaaagccctggaattagatacaccattaaaacattaaatcttaatccattcagcctttccccccattacattcaagcaaatgtatattgagcatctcttcctaaaacactgtgtaaaacggtgtgccagggcattgtgggacagaaagacgagcaaggtgaaggtgtaaccctcattgagctttggagcttgcagtctactgagtatttctgtataccagcaaaagacatttagaaaatgaatatttgaaacaatatcatttacaatagcataaaaaaatgtcgactacctagcagcaactctaacaatagatctgcaagattcctgtcaagtgagcatggaaacaaatgctgtaaatatcagaatgttacactattgtaaatatgtcagttctctccaaatttagccatagatgtagggcaagtctaagaaaattttagcacgtatttttgtggaaatgaagaaggtgatttttgaatgtatatggagattaaaagggccaagaataggcaatattgaaaaacagaaggaaagaagttggaagacttaattactatatggcaagatttactgtaaaactgcagtaatcagacagtatggtcttgatacaaggatagacaaatagatcaatgaaactggagtatccagaatgagacccacatgggtagtcacctgattaatgacaatggtggcgctggagtgcagtagagaagtgagggccttttctgtaaatggtgctgggtcaagtagatttccatatagaaaaacttaattttggccagtacctcatatcctacacagaaatcagttccagatgtactcaaagtcagaatgcgaagagtaaaacagtaactttgttagaagtaaaaagcatttccttataaccttggggtaggtaagaacctcttaagcttgatacaagaaacaccatccaagggaaagattaataaattgaactacattaaaattaagaacctctactcatctaaagacccagtataaagggaacgaaaaggtaagccaccatcagagaaagtatttgcaatatttatctccagtaaagggtttgtggtcagagtatataaagaaaagcaagaaaaagccacacagcctaattttaaaaatgggcaggctaggcgcggtggctcacgcctgtaatccaaacactttgggaggctgaggtacgtggatcacgaggtcaggagatcgagaccatcctggctaatacagtgaaaccccatgtctactaaaaatacaaaacaattagccgagcgtgctggcgggcgcctgtagtcccagctattcggaaggctgaggcagggaaatggcgtgaacccaggaggcagagcttgcagtgagtggagatcgcaccactgcactccagcctgggcgacagagcaagactccgtctcaaaaaaaaaaaaatgggcaaaagacttgcacaggcacctcacaaaagaagatattcaaacagtccataaacatatatgaacaggcacccggtttcactactggaagaaagcccccacgcaatatcactgcatacccagcagatggcgccaccgaccagggcaaagaacaccaagtattgagaggccaagaaacaaatggagttctcagacctttcttcctggccacaggtctgtgggcgagctactgaacgtcgccaaacctcacttgctgtcttgtcctgtgcagtggcaacagtgtgcacatcttcaggttactgtgagtctgtaggtcacatgaagccctcgcagagaaccaggcacgtgggggctcctagaatctttttttcaggacttaccgccctgccctctctgcctataagggccttctggtagttactaggtctttttcccccagaaattatttaataagggcaacaataacaatagctagcacttgtatcatacatagtaactgccaagttagttatctgttatctcccaacaccaccaaaataggtagatactaaagtattcaggtaccattgctgtttacattttactggtgagacaactgaggtgcacagagggaaagtaacctgctcaggatcacccagctaataagtgatggaggtgtgctcagacccaggcattccagtgtctgtgattaaccctatgttctaattataccagtgtttgtaattaaccatatactctagtgcctctcaggaaataccagactttctctacttcctgctctggtttcgctgaaccttcccatcacgactcctgccctgaagccctctttccctgtttgaatctagcctgatctcttttctaccttcctggaatattccttagataatgtagtaataatgtgaataacggcccccaccacaatgaccataatctaatcaccatggcagccaagcctgcttctgttgagcccttgctctgtgccaggcgctgtgcttggctctttctgtgcatggtcacgttgcctctctggaacaacccagtgaggaagccttgactgttcccaccactgtgtagaatctgagctgcagagaggtgaagcgccttgtccaaggccacagttaggaggtggcagggccaaaggtcaagcccaagtctgtctgccagactccgaagcctgacctcttcaccagagctctgtgctgtcacttgccgtgtctggcgtttggatccctggctatgttcagtcgtgtatgctttgatctaagttatgtttacaaagaccatcccctgccccattcagcatttattgaacacctgctgtgtatcagacatttggagtgtattggggtcagcaagatcaataaggtgatggtgctgaccttgaggagctcaggtctagtatgggaggcagatctttgcaaatgagggtgggctgtgcagtagcaaatatgtgtgggtacagaggtgccagtgaggagggaacaattaaatccacctgggaggggggcatggggaacgctttaccaagagatgcccgagctgggttttgaaatgtaaaagtttgctggatgacaaggacagcaagggcattctaagcagaaagccccatcaattgaagtcatgtggtcctaaagaatttaaaatttcttcttcttgttggggatcttcagagcagacccacccacctaagccaccgtctcccattgaccaggagtatgatgtgtgatgctaatagatgtacacagaagagaggagggagaatctgcccttctcccatattgccaacgatgtcttgtcactggcagggtgtcaggcacatgggggcctgcgtggagagtgtcactgatggccacagctggagtggtgcggtgactgtcagacttcagtgggattggggccctgcaccaaaagtccaattcaatgggtctgggacaacttacaaaggtgattctgatgcaggatgcctgggaactgcagtttggaaaactctgccgtttgaaactcttggggaagatgcacttgaggcaagatgaagatgtagatttgggagtgggtcctccaatgattcatcccagggtggttcaagtgctgtttgagttacctaattatagagggaaactgggcccatgccccctcccgcagccttttggtagatttgggtacaagtggttgaggatttgtgttttttgagggctcttctaattactgcatattaaaaattacatgcaatttctaataaattaattaaatgcttgattatactaggtctttaaagcataacaaacagtattcgtaaataaaccctagcccctttaaatagcagattgttctttattgtttcatcttcaggctgcttcctctttatgtcttacccgtttttagagattgtagatgggacaatcctatctagacgtttccttccttgctctcaccagacccccagccctgaaaactgaagttagccataaaagaaatcaggagaggagggcccttttcctgagtcacttcctcttggtgtctgcttttccttctcaagcctgagctcccttgacaggtgaagttacctggggctgtgggccctggagaagccatcttaaaagccgtgcccggtggcactcccagggcatccagctaggcttctggtccccgcgctgctcaggactggcctcggtgattcttttggtctcccccaccagcaaagaggccttgaggactggaaggtgtctacctgtctcagctccagcacctggcattcaggcctgtttgggtagatgaagtacagcaccatagcctctgcagcccttatttatttatttatttatttatttagactctcgctctgtcacccaggctggagtgcaatggtgtgatctcggctcactgcaacctccacctcccaggttcaagcaattctccctgcctcagcttccagagtagctgggattacagacttcgccaccacacccagctaatgtttgtatttttagtagagacagggtttcgccatgttgaccaggctggtcttgagctcctgacctcaggtgatccacccaccttggcctcccaaagtgctgggattacaggcatgagccaccgctcccagccagcccatttaactcagtgaatttaacaatctgttctcagcaaataagaccattgcccttgggctgcaaaccacccagatcatttgagccataagttctgatgggctcactgcacttgagaaggattgtgagcattccaaggggaattgcatgtgatttttgtcccagcaactgctgtgggacccagccttcctaagctgtggctccatctctctaaacctcaacattagcctggctgcaggccccgtgttaggcatccagcctgagctgtatgtccccacttgctctgaaggcatcaacatgatgggaagcatatgaaacaggtggctacttgctcttctctcagtcctgctgaatctgaatttccgagggggctccaggagcccccacttgattcagttctccgggtggttctcttgcacactgcagtttgagagtagttgacttcaagggtttgacgattttcttgtctccgtctgggttggtgtgtccttggtttaacccttcaaagcattgtctgctatttttctggggttgtgagttacatctaatctgaatgggaaattgcattacccaaacctgaaaaagcattgctgcattgtctccaaaatattgctaatggtcatggaacttggcttgcatttcagttggtaacctttaatttccttttctctcatttctctcaggtatctgtaccacgttttgaccaaaaacaccacagtcacagaacagaaccggaacctgctagtggagaccatccgttccatcactgagatcctgatctggggagatcaaaatgacagctctgtatttgagtaagggtttctaatgattgctgttctttgattattcttctttgaatgtttttctaaatgtatactatgagtcattctggatgatgtcaggatttgacgctaatttgatcttgcctagatatctatctctgtctagctgtaaaaaaaaaaaaaaaatgcccttgaagcactatagaaatgcaagccaaaaatggggaagttatggaaatgagtgtctctagaaaacctgaaaatgtcatgggtaattttccttcaggttgtgtctgattattttcccaaaggaaggagaacatgtctggtggttagatttgacatgaacagaaggcctgtgccctgggggagtccctgagggctcccagttaccatgtttactgatgaccaggcacagggctgagctcctgatgagatggtccacctaagtttcccacccaccccatggtagaggccctgttggtgtccccttttttgctcaaggtcacatagctggtaagcggtggaaaagtgacacacccagaatcagtgaggggtcccgcaactcaccacttcctaggtgagcagtcctcagccaggctcttcatctccctaagcctcagtttctttacctttaaaagagagagaaaaagttctctttgtctagtgcctggtacaggaataaatgatagcaaatgataaagacagacgtgcctcactggacagttaaaaagcaagggccgccaggcgcggtggctcacacctgtaatcccagcactttgggaggctgaggcaggaggatcgcttgagcccaggagtttgagaccagcctgggcaacatacagagacctcgtctctacgtataattaaaaaattagtcatgcatggttgtgtgtgcctgtgttcccagctactcagaaggttgaggtgggaggattgcctgagcccaggaggtccaggctgcaatgagccatgatcttgccactgcactccagcctgggtgacagagtgagaccatgtctcaaaaaaaaaatagcaagggctgttaactgtgaactacctccctaatagatctgccttgatgtcttagtgcagaaggatttggggctgggttatgacaaccactaaacacgggtgtgtgtgtgtgtgtgtgtgtgtgtgtgtgtgtgtgtctgtattataaatattgaggccacttttaaaactcatttttgaaaagtaaaagtgttctatttttaacctggtttcttattagatatccgaataagaaggatattaccttttcatggattcagacagaattaggcagcactgagcaagttcctgaatataggttcagggtagctttatattttcatcagcaaggttatccaataaagctacttgtggaaatgcagactctttaaaatgcaaacctgtaaacagtggctatgatctccaaagcagaacatgcgagtcatgaatttgtgtttatatacagacctagttcctttaaggatccatggggaattttgttttttttgttttgtgagatggagtcttgctctgtcatccaggctggagtgcattggcgggatcccggctcaccgcaacctctgcctcccagtttcaagcaattctcctacctcagcctctggagtagttgggattacaggcatgcaccaccacgtggggctaatttttgtatttttagtagagatggtgtttcgccatgttggccaggctggtctcaaactcctgacctcaggtgatccaccagcctcaggttccctaagtgctgggattacaggcatgagccaccgtgcccagctggaattttttttttttaaatatctttttggaaatcaaaaagacccttgggttaaagatgagaaactgtgtcccccttgactagaatggacttatttttttttttagagacagggtcttgctgtgttgccagggctggtctcaaactcctgagctcaaacgattcttcctcctcagcctcccaacatgctgggattacaggcatgagctactgcaccctgcctagaacggacgtgtcattctaggtcccaagatgacaccctgtccatctgtcatcttagaaaagctgctgagctcttagggtctccatgattcttaaacagttatccaacaaagtccctaagaaaattttgtttttactacattttaaaattttggaataattttagatttataaaatagtttcgaagatagtatagaatgttcccattgtaagtgtcttacattactggggtgaattgggcaaaactaagaaactgacattggtacagtattgttgagtcaacttcagccctcatttggattttgccagtttttcattaatatctcctttctgtcctagcatcccatccatgttcccatagtacattttgttgtcgtatatccccagcctctgatctgtgactcttttttagtcttccattgtttttgccaccctgaaagttttgagaaatgctagccaggtctcctgtggaatgtctcccaatctgggtttgtctcatgtttttctcatgattaaactggcagttaaggggaagaaagctataggagtaaagttcccctctcttgccatcatcacaaggcattcacaatatccacatgacatcctggtgatgttacctttatcacctggttaaggtgctgtctgccaggtttctctactataaagctactgtcttctcctttccccacactgttctttagaagagagtcaccaagtctaccccacgttttcatgatgagggggtgggggttaaggtctaccttctagaagggggcagtatctacatgtattatttgaaattcttctgcatggaagattcatctcttctctctcatttatgcagtcatttgcttatattaatatggactcgtggatatttatttatactttgggctataattcagtatgttgttattttattgctcaagttgtttcagccttggctattaggagctctttcaggctggttcttgtatcccctcgatatgctctcttccttttgttttttgagcacttcttacttcctggtactgtaaaatgctccagtcctacaatcacccttttttcccaatgaattgcccactcccctatggagttttaaaaaatctaggttcatggattttatgctagacctaccctgtcaatccccggggcaagatctaggtacaggcattttaacaagttcccaagttggtcacagtgcggcagtgagtttgctggtggcccttaggagtcactgatttatgcagcttgaactgaaggtagacaaaaataggccaaatgacagaaatactctggaggtcaacatgaatggcatttacaggcagatgggcctccgagttggagaagattgtaagggtcttttttaggccatttaaattttttcatttatccgttcatggattcagacagaatcaggcagcactgagtaagttccaggcccatgacctcaccactgtggagatgccagacgaggacagagaggcacccacaactgagtcagcccgcaggcacacctcatttcttccaagtgtcccagatgcaagattatctggtgttagcttgagtacagagaacacataactagaaacgtcattctcttcctttagagaaaggcactggatggtctgtttccttttcaagactgaaagagccaacgtgtacccccagaagccagtgccgctaggctgtgtacagacaagtatcctatccacaaggagaaaggcagaaacagacctggggatgggttagtagggtttctccaccacatcagtacctgtgtatttctttctagttattttcccctagaacttgacaatttgggagccacagtacatttggttgtcatatctccccagcctcctctgttccgtgactcttttttagtcttctgttgtttttacgaccctgaaagttttgagaaatgctggccaggtcttctgtggaatgtcccccaaaatgggtttgtctcacttttctcatgattaaactggcagttaaggggaagaaaaccgtagggctaaagctttttgggaacttttttttcttttttttcttttttttttttttggctctgtcacccaggctggagtgcagtggcctgatcatatctcactgcagccttgaactcctgggctcaagcggtcctcccaccttagcctcctgagtagctggcacttcaggcatgcaccaccgcctaattttttttttcttctctgtagaggtaggggtcttgttattttgcccaggctgggtcttgaactggcctcaagcgatcatcctgcctcagcctcccaaagtactgggattgcaggcatgagccactgtgcccagatctaaaactcatttaatactcataattatatcttattcctttgctgggaattccagttgtggcgggtgacaatgggtggcatgacctgtgcagataccttgggggagaggggtgaatctaatacttgtgttgtgaatgaaaccagataataatttctgtttccacatgtggaagcaagccactgatgcttttccattctctccccagcttcttcctggagaagaatatgtttgttttcttcttgaacatcttgcggcaaaagtcgggccgttacgtgtgcgttcagctgctgcagaccttgaacatcctctttgagaacatcagtcacgagacctcactttgtaaggacattccttggtatttgcctctgtgctgctgtgcatgtagcagggtgaagttgggcgtggttttctgtgtctgcgcttactattcgtcggctcaggctatcctaacaaaataccatagactgagtgggttaaacaatagagatttgttttctcactgttctggagcattgaagtccaagattggccaggcatggtatctcatccctgtaaccccagcacttaggaggccaaggtgggcagatcacttgagctcaggagtttgagaacagcctggacaacaaggtgaaaccccgtctctacaaaaaaccacaaaaattagctgggtgtggtggtgtgcacatgtagtcccagctactcaggaggctgaggcaggaagattgtttgtcaaggaagtcgaggttgcagtgagccgtgattgtgccactgcactccagcctgggtgacagagcaagaccttgtctccaacaacaacaaaaaaaaaagttcaagatcaagttgccagcagggttggtttctagtgagggctctcttcctggcttgcagacggccaccctcttgctgtgcatggcctttcatctgtgtgtgagtggagagaaattgagagagtgctagctggtgtctcttcctccttctatggggacgccagtcctattggatgagaacccccacccttatgacctcattaaccttaattacctcgccaaaggccctgtcttcaaatacagccacaatgggggttagagcttcaatgtaggaacctgagggagacatagttcagtccctaagcctgtgtttgtttctgtgtggtgggtactatcagagggttcccctctgctgatgatgctgggggtgtttgcagttcttctttatgacttgctattaaagagttggggtcgctgaatcatcagccaatggaataagcactggaagaagtaagacaaggaagatctctgccagagggcaggcaagggtgtgtgcattggtaccaaccctcctgcttcagtccctccacccagctagtgagtgtgtgactccgaacttcttacctgccctcactaagcctcagtttcgtcatccgtaataaccacccctgagaggcaggtgccatcagtgctttcattttaacacccaggcgccagctctagcaaagccagaatagagaaggggtttcatcccaggcgattagctcagtggtcttcagtgaggggacatttggcatcatctaaaaacattcttgggggtgctgctgacatctagtgggtagagggtaggggtgctgctaaggacaggccccccacaacagggaattacccagcccaaattgtccccagtgccgaggctgagaaaccctggtttggttcctaatcctccacgctagactgctagctttgttattccaaggtgacttcaccaagcccgggccctgcccgccagaagtgggggacaagtggccaaatgtctatatcagaggcaggctctaagtccccaggacaggtctgaaaaaagtctgcagtgggcagaaagaggtagagatggtggcattcctctggccaagagggagaggtgaaagggctgctgagtgatggctctcgcagccgccgctaggtggtgctgctgcctcagagacgccttatgcttcccggtgaccgcaagttgacaaatgtgggccgactcctgtctccctaaatggtttcccttgttaccagcgcctgtttcactggatgtgaaatgactgcggtttctaaaagctctgaggggaagatccagctcagtggcacaggcccttgactcagactgaaccaggtcccaggcccagttctgccccacactggctccctgcacgtgcctggacagtgaaggctccgagctgctgtttgtgcatctgtcaagaggagagcacagtggctgcagcatagagtggctgggcgtgagcgtgagagcaggtgttcagagcgaggcacagggtctggcagataggacatggccatggtgtcggttttatcctttaaggcaacatcaccctcagtgtccctgccctgggaagcctctcaaagtccagctaggcacggggtgactggattgagatgggggtggggcgatcaaaacttacggcttttagagtgtttctctgaattatgtggcttttaaaaattgtatatatttaatgtgtacaacttgatttaatatatacatatacacaaaaaaatgtgtacattgtgaaataatcacggcaatcaagtgaattaacatatccatcacctcacttttgtgcgtgtgtgtgggtgggggttgtgtgtgcaccttgggtgatgaaaatatgcagtagatctgttagcagatttcaagtctgtaacacagtaggatgacctgtagtcactgtgctgtacatgagagctccggaacttactcatcgtgcgtcgtaccctttgatcagcgtctccccatttccctcctccccagtccctggtaaccaccctttgactctctgcttctatgaatttgactgtcttagattctccctgtaattgagatcatgcagtatgcgtggcttttcttgtcctggcaccgaaaagggtgccctgctgtgggaaacccaggcagatgcccctggctttatagccccttcaccacagtgcttttataagccctgcaaaaagggtagaaatcattgcacgtttacagaacttggatttgtaaggggtgaggaggatagaagacctttgcttttatttttgttttctaatcacagaagaaaaaatgtcctcattgttaaataacgaaaagccaaatgttagaaaaatgtaaagtcaagtttctgcagaattcaaccctaacgatccattgtgcaccagccattctgctgtttgcttttctttttcccaccttcccagtgtatcctagatctcattgtcccgttctgtaaccctgcctggtttggtttaggagtggcagcttgttgtgctataatctatttaacctgaccacgggcatttaggtggtttccagcttttcactattacaagctaccatttcacaaatgcacctgttgcctgttggggttagtgacctaagtgacagagtcccgagagactgagattacgtacaggctcccgggtttattagaaaaggataccacagaaagtcagccacacagtgagggggtagtagaaaaatcccagcctgataatagaggcacctccaactgtcctatggtggccccccaccacccacagagtcatctcttggaggccctggaaaagtccctgctggggagtggagggagcctgtcgctgttccagctccagggtacagctgagagactcacagttgcacatctgaagctcccagtatggtgtctgtgctgctggtggtctggaagccactagccagtcacagcagggctcagtaagacaccccaacagctccttatcctgccagcccattacccctccctacttctcccccagcaagagccagaatgacacagaaagaaaaagaagtgctctgggtatcagaatcacctgggtgacacgatacccatgttagactccaggtggataaataaactgtggactattcagagaatgtactactatatagcaaaaaagaaaagaaaaaggaaaaggaaagaaggaatgaactactaccattgcatacacagcaacctggaaagccctcagatgtggtaataagcgaaagaggccagacataggaagtgtgcgtactgtctgcttccattagataaggttcatggacaggcaaaacgagtctgatgtgctagaagcagaataagggttgcattggggtagcgggtactgactgggcaggggcatgaggaagtcttctggagagctgggaatgtcagatttgggatctggatggtgcttacaccgtgtgtatatgtaaaaattcatcatgctgggcacttagggttatgtatctatgtgttttatacgtagatatacccgaggctgggtactttataagggaaagaggtttcattgacttacagctcagcactgctggggaggcctcaggaaacttacaatcatggcagaaggtgaagcaaacacatccttcttcacatggcaacagcaaggagaagaatgagtgctcagcaaagggggaagccccttacaaaaccatcacatctcgtgagaactcactatcacgagaacaggatgggggaaaccacccccatgattcaattatctccacctgatccctcccacaacacgtggggattatgggaactacaattcaagatgagacttagttggggacatagccaaaccatatcatacatatatgtgtgtgtatatttccacatatgtcaagctgtccacttaggatttgtgatatacataaccccatctttaaaaacattaagattcctaagattctgccttagacccattgactccttgcttggagggatccccaagcactgcctcagtagtgttatgagcaggcgattttgaaaactgctcttctaagactacaaaccgcacagcctgtctgccatgcctgctcagagtgcacagtggcttttctgaatgcagtggctttcccggagaactgacttccaaggaggaccacgccacaggcccacactgtggcttccatcacgatcccgggctcccagattcctctttgtggtgtttttgatgattcccaacagactgttgagtttgactttgatcgacctcagttaggtacctcgacggctccaaataacttaatggtttatttcctcttcacccaagagcaactgttttcagtcctggaatatggtagagattttctttgtttgttttgtttttagagacaggtctcaccctgtcgcctaggctagtctccagtgatacgatcatggctcactgcagccttgaactcctggcctcaagctgggaccacaggtgcacaccatcacacctggctaaagctgagattttgaatctccgaataatagtaataataataagaagaatggcagttaacattatcgagtgcttgcattgcggcccatgctgtccattcacacagccagtgaatcagtgactactactactgtcctgagtgctttctgtgcattttctccattaactcttaccactacttcatgaggaagttttggcttcatgaaactggggcgtggggagggtcagcagtttgcccaaggtcacagcacagctaggaagtggcaggggcgagatgtggacacaagcaggccagtccaagtccacgattaaacccagagcttcccaaacactagcacgcatggggagccctgcacacttctcacatgcagagtgctgggcccacccctggagattctgactccgtggcgcagggccggggcccaagatcctacaggtctgacaagctccggggttgctgtgctccccatctgaggacaagactctgagtagcgaggctccaaaccatgcccccagcaggtgtgaatcgtgttctgcctttagctgtcctgggggccgggcaggtgagctggtgcagcactcacacaacattccaaaggacaggcgatgggacagcagtgcctgccttgcagggtggctggtaagaacacagagggaaatatgcctggcaagggcccaacactgagatatcaaactgcaggccataggctgcagctggctagtagacatgtttttgccggccagcacagctttaaaagctagttgatttcagtggcaaacatgtcaggatcaggagatgcagtgttggaatctggttttgcctctcttcactgttgaaagccctcaccatactggcctgcatttctgcagggccaggcgctgggagctggggaatggggttgctcttcagttgaccccagtgcccttgggccctcatcacccagttttcattgttgggcccccataatgcatgacaaactctgacatcagacctaagtttgaatcccttctctgtgactgtctctgtgcacgggtaagttaacatctccgagatgtttttgctcatctgcaaaatgggaagaatgagcaggatcatgtgatggttaatggtcatgtaaagcactcagcctagtggccggcatgtagtagggattcagcaggaagggacctttatgcaatcatgttgctatataaggaggaaaaaaaccctactgtggccttcagagttgatgatgtgatttgtgatggcagaagggggcagctttttaccctcattcatgggtggtttgtgaaaatgcccacacaccagctaatctccccctactcccagctctttgttgcactttgccatcaatgaaaagaaaatgttggagtgtcttttttttatttggtgtgggagggcggggaagggctgttctctggtgatgcctttgaacttcctggtgactgtacattgaagatgatctctttgctggttaaaagttaagctcttcccagttagtgtgtttaatcccagcaacccagaggcttacctgattcaagtacattaacgtggtcatctgcttgttacctggcttatctttcctccagcatgagttaacctgttttgtttttttctccctctagattatttgctctcaaataactacgtaaattctatcatcgttcataaatttgacttttctgatgaggagattatggcctattatatatcgttcctgaaaacactttcgttaaaactcaacaaccacactgtccatttcttttataatgaggtaagtaattgccagaggggcacgtgtgggtgtaaagccacacgtggctttttttttttttttttacggcagcgccttatatctggatggtcttgtgtctgtttacaaagctcttatatgcttgttatgattttcatggcaacacttttgactttggcatgtttaaaaaatttttttaattaaataagttacctttctattaaaaaaatgtaattctttgtagagacagggtcttactatgtttcccaggttggccttgaacttccggggcacaagcgatcctcctaccttggcctcccaaagtgttaggattacaggcatgagccacagcacctggccagcctttccattgttaatgtaaaattcagtttgttctgagagctttatacttggtagagaggagacatgcccagatgttgtcttggggaagtgttgccctgtgggaaaaacaggaactccagtcagggctggttttgtcacttccctgctgtgtcaccttaaggaagtcccagtccctttctgaacctcagtttcctcatctgagaaatggggataagaatatacatcttgtagggttattaggggttaaattaaatgagatgatgtcttcaaagtgccagtatgtacatagctccctaaaagcatagacgttgctattgttgataagataatgtccctgacattctttgggagaattattaaaatgaacaacttaaataaataaattgctcctgtcctcacacctaaaaggggtttgaacaatagggtcaatgtatcacccacaccaaaaggtccaggcactggtcgtgctggggctggttcatcctgtggttcaacagtatcagcgaggacccaggctttcccatcttgctgctctgctgactatacagctggcatccatcctcaggttcaacccctcatggtcacaggttggctgccactgccaaaatgcctgatgagatcacttcccttcttgtgtccctttttaacttccaaagaaaactttctcagaaggttctcaccagccttcccctcatgtttccctgcatcccactgagtacttcttaggtgtcaggtgctgggataagcacaagaccagaaatgatctcatttaatctggaaaccataaagtagatgttattatccccatgttatagatgtagaaacagaggtttagaaatactgcattgcacaggttagaagtggtagaatgggtaatgaacccaggtctgacattatctggactcattttctttttaattataattttcaaagtagagatgaggtctcgtcacattgcccaggctggtctcaaaactcctgacctcaagcaatcccccctccttggcctcccaaagtgctgggattctgggcatgagccaccactcccagccaatcaatcagtgattactactactaccactactactgctcttttttcttttttcttgttttgagacagggtcttgctctgttgcccagcctggcgtgcagtggcacgatcacatctcactgcagcctccaactcctgggctcaagccaacctcccacctcagcctctcccaagtagctggtactatgggtgtgcaccaccacacggacttggactcttctgtttcttccatggctttgccttcctgtccctttctacatgccccattgggaatgaaccactgacttacggttcacattggcaacatttttttttttttttttgtctttttctgaagtctctgatggaattcagagagttggggtggggccaggcctggcttatgggcttataatttgttttcgttatttcttttgttttagcacaccaatgactttgccctgtacacagaagccatcaagtttttcaaccaccctgaaagcatggttagaattgctgtaagaaccataactttgaatgtctataaaggtaagtgtcctcatgggcttgtgtctcggctgatttctgacttggcagcaagcactcactcccgtgtgtgtgcgtacagttctccgattgtcacgagggagcacattgatgatgagccgtggcagcttctctcatgaaaaacttggaatcccctagcatttagctggccgctcatggaaatccttgccttctccaggcatgtcgaagtcttgctcatgctgctacatagaagtaggatgtcctgagaggcacgtgtgggattcagagtggctatgttttagaatttgagaaagcaaagttgtctttttaatgtgtcatttaaatttttgtgtcttggcttgtgaaatatactttaatacagctaaggggtaatttgacttttaagtaatatataaaagcatgtcacattgtgaacagcagggggcaatgttgtattcccaacaggctgcaaagcccagcactaacaattcctcctttccctcaagatgttcttaatgcccaaaacattgccccagggaaaaagccattcccccactctccgctgcactgacacaaaggctgcctggccacaagtttcctgaactggaattgcccttccaaggcgatgcttggaagttctctgcctaattcctgggttattttccccggagtcaccacagtggagatgggactattttctcagggatgaaagggctttgactttcatgagccaaaatgttattactccctaatgagggtgggggcttctcagggactcactccagcctagcactgggcttacattaaatttaagaacctttctaagagcccaactggacccacccaggggtcgcaaactgaggacctgtgggccatatccagccatcagacatgttttaactggcttagtttttgaaaaaatgtgtagttgccagtatttaaaaattgggagatcttccatgataatctggatttgcaccttgaagatgtagatttggctagtcaaggcccacagtcctgcagttgggggggtcagctggcacagaagcagctgcccctttggggtcaaggcccgtgctcccaggtcacacgctggacctctggcaactagccaacgtggcaggcttgtaagattgtgaccctggtccaagccacagttggttctgctgcctcctgctctgttttctcctgtctccttctaaccttatctctctgtgcagatgcctcccaccctagtctctctccctctgagcagctctctcaccttcccaggtcctaaccctgttaactgttgtctgttttttgcttttccttcaatgacgattcctgtgttccttattccagtgtcatgtaagttattaacctctggttttctgctttcttaatctacccttatatgtaaataccttgcttgagaatggtgtaattctcagtgtagtctagctcagtctgctactgataagtaggctctcccatgcaccattaatgtttagcccaactaatttatttttaagtataaaatatcataagaactgccttgatgactatagttttatgaataagataaacatttttaagtatttccaggaaagacagacaatttcagattatagcagagggctttttcattgtggtttttgggttttgctttgtttttgttttttttttaatcttccccaagttatttttggtagcttgactttttttttcttctgtgaattttctcagtggataaccaggccatgctgcactacatccgagataaaactgctgttccttacttctccaatttggtctggttcattgggagccatgtgatcgaactcgatgactgcgtgcagactgatgaggagtaagtgacacccccagggccactcagtagatagacagggtggttaggggagaattctgttttcatcaaggaaaaataaacacaagaaccgcacttccctacctctgtgtaggcagagcatggacttccgtactgtaaaaggtcctgctcacctatttgtaataatgaaatgctggaaacaactcagacgcctcccagagcaggcggggtaaatcaattcagtacagccatagatggggctgctacgcagctggtgagaaggtcaaggggctctgtcagctgatgaatgcattaacaaaatgtagtctgtctgtacgatggaatagtgtttggcgataaaaaggaatgaagtgctgacacttggtgtggcgtagatgaacctcaaaagcattatgcctagtgaaatgcccagaataggtgaatctataggggcagaaagtagattcgtggtttcctagggctaggatgttgtgtggggacataggaagcaactgctaatgagtatagggcttttttttcttttttgagacagagtattgctctgtcacccaggctggagagcagtggggtgatcatggctcactgcagccttgacctcctaggtttaagcattcctcctgcctcagcctcccaggtagctaagaccaccaggcctgtgccaccatgcccagctaatttttttgatttttagtagagatggggtttcgtcatgttgcccaggccaatcttgcattcctgggctcaagcaatcctcctgtctcggcctcccaaagtgctaggattacaggtatgagccatacatccggccaagtaaggggctgcttgcttttttttttttttttttttttttttttttgagacagagtcttgctctgtctcccaggctggagtgcagtggtgcaatcttggctcactgcacctctgcctcctggattcaagtgattcttctgcctcagcctctggagtagctgggattacaggcatgcaccaccacgcctggctaatttttgtatttttagtagagacagggtttcaccgtgttggctaggctagtcttgaactcctgacctcatgatccacccacctgggcctcccagaagtgctaggattacaggtgtgagccactgtacccagccataaggtgcttttttttgcaggggggataacagtgttctaaaattgactgtgatcatggtcaggcaactatgtgactctaccaaaaaccattacattgtgtactttaaataattgaatgttatggaatgtgaattatacttcaataaatctcttttaaaaaacagattaggatggtggttttgtcctcaaagggatgattagaagttccagagcaggatttctttcccttggctctattgacctcttgaactgggcaccattgttgggggggctgtcctgtgcgttgtaggatttttagcaacatcgccagcctctctacctgctagatgccagtagcacccctccccagtcgtaccaaccaaaaatgtccccagacattgccaaatgtcccctttaaggcaaattcaccctcacttgagaaccactgctccagggtgacagctttgcccaggcctagtgagaggtgcacctagatggggtcaggatgctaaagggaccagggcagacccattggagcaattgggaaagctagaagccttatggatttaaacagtcatggatgcgagacataatgagacacttaactatagaaagaacaaagttatacaagcaaggaaatgaaatcatagtcctctatttggctccacagggaatgttatgacatcaaccccaattactgataactacttgtggggaaggggcagagagaatggaagagttctgtcataacaggaggtcaatagataatacctaaaatggctcaattgcaaaataggagtccatgcagattttctagaaatatgggaggaactatctgcagaaacaagtaactgcctctggacagtgaggagaagtagaggagggctgggtgcggtggctcacacctgtaatcccagcactttgggaggctgaggcgggcagatcacttgaggccaggagttgaagaccagcctggccccatctctactaaaaatacaaaaattagccagacatggtagtgcacccctgtaatcccagctaccagggaggtcaaggcaagagaattgcttgaacctaggaggtggaggttgcagtgagctgagatcgcaccactgcactccagcctgggtgacagagcaagacactgtctcaaagaaaagaaaaaaacagtggaggaggcgagtctgggccaggagctgctctttttcattatcagcttatcaatgctatttgagttttaaacctagctgcatatattactttgatattttttaaaccaaagtattaaaaagtgaggcactttaaatataccattagagaaaatgttccaaagtatcttattaagtgggagaaaagtgcaaaacattgtgcataaatgttctaggtctcaggcgcacggtgggttcatagacattcattatactgttaggctttacaacatgtatttgctgtaaatatttaccaaatatcttttttcttttcttttttgagatggagtcttgctctgtcacccaggctggagtgcaatagtgcaatcttggctcactgcaacccaatctcccagattcaagtgattcttgtgcctcggcctcctgaatagctgggactacaggtgcatgccaccacccctggctaattttttttttaatatttttagtagagacgggtttcaccatgttggccaggctggtctcgaactcctgacctaaagcaatctgcctgccttggcctcccaaagtgctgggattacagacatgagccactgcacccagctgaaatatcttgttgaagtataagaaataattggctgggcatagtggttcatgcctgtaatcctaccactttgggaggccgaggcagaaggatcacttgagtccaggagtttgagaccagcgtgggcaacatggtgagacccctccaccctctatgaaaaatttttaaaaatagttgggcattgtagcaggtgcctgtaatctgagatgctttggaggctgaggtgggaggatcccttgaacctgggaggttgaggctgtaatgagctgtgctcatgccacagcactccagcctaggtaacaaaacaagaccctatctcaaaaaataataataaataaataaaaggaataattatccagaattatgtaaaagaagcagaattgatcttgtttttactttttttttttcaagtatatacagttagacggatagaaatgtgacatctatattttagatgtgactactactaggagaggtaaaaatgtagaaaaaacagacattagggttataagtcccaaaatgttaatagtggatatttgttagtggtgggtttgagactttgaattctatttgcttttatattttaatttgctgttgtcaaaaatgatcatctatcagttgggtaataacaacaatacaaacaaaatgcctagctagcatttgctgcatactccttgggggtggtgaaagcatcctcaccagctgtttctggagtgtgagactgactccacccaagagacattaccccctggccccccatccccagcatgctgttgctaactgctgggagacggagacctccagggcaggggcctgggggaggggtgtcatgtctttgctctatgtctgcatgtcgtcagggccactggggtggccacggctctggaggcctgcttttctctttagaactcctctggagcattttaattacagtggatttattgctccattagtgctgcttatctggggagccaggggatcttgccacagtggctagtagctgtgcttatgcagtggcttgctggaagagtttagcagcattttgctttgtttacctcattctgggagaccccagcagtcccctgaaattgattttagtaaacctgcccattttcccttgtatatctccccagtaggggccaggataagtgtctcttgagactaactcaaatatgtggatgaactcacagtgacctaagtctcaggccattgatgttaggctcaaaggctcctagtgttggcctccaggctgaggtggtcatttctcctggcaggcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaaggtgggtccagccccgtggctcccgctggctgaaggccatcagaagtggggaagaacagtccccagtcccctggaatggggctgagcattgcaaatcaggactgaggttttttttttgtttgtttgtttttaaaagacggagttttgctcttttacccaggctggagtgcagtggtgcgatcttggctcactgcaacctccgcctcctgaattcaagtaattctcctgcctcagcctcccgagtagctgggattacaggtgcataccaccacgcctgactaatttttgtactttttggaagagacggcggcatttcaccatgttggtcaggctggtctcaaactcttgacctcaggtgatacacctgcctgggccttccaaagtgctgggattatggccagaactgaggttttgagcccaagggagattcctttcaaagcacactggctttcctttcctttcctttcctcttatttcctgagacagagacagagtgtgtgtgtgtgagaagactataaaagtgaatgagaaaagattaccgacatcaggaggaaacaggaaacatctacaaatgtagggttttggtttctgtgcatccttccctgaagtgttctcctccccagtaacttttcctggtagttgccagaacccactgatttggagaagatacagacagcgacagaacttgcgcagcatggagggaagggatggagcacactcagggaacggtcccagggtggtgactgtccactgttagcaggccccagaggcctgtggggatgacggctggtaacatgcagggcctcaggaccaggaatctgcatgtctcacctatccctcaggtgattctgattctgtgctgctggttctcagggcccccctgtgaggaatgctgcttctggaggggaggcctctgtgcagttcctccggaggtaaaagggcctcagcaggaggcaggacagagccagctggtcaccatgcagaggtgctccaaggggatggagttttcaagattctcactacagatgagtaaataaaagaaagtgtatttttagtagaaacggggtttcaccatgttggccgggctggtctcaaactcctgatctcaggtgatacgcctgcctcggcctcccaaagtgctgggattacaggcatgagccaccgtgcccagccaggactgaggctttgagccggagggagactcctttcaaagcacgctgcttttcctttcctttcctcttatttcctgagagacagagacagagtgtgtgtgtgagaagactataaaggtgaataagcgccttagctttaccagaggcagctctgggaggcagagacaaagtatgagaattggagttttcagacctgcattcaaattctgcctcttccctttcctaactctgtgacctaaagcagttaacctgagcccgtttcttcggctgcaaaatgagggcctaactattcttctctaacagggtgggtgtgaaatggagcatcttgaaattcattataaacgaggggcttttccaaggccagagtgccctaaacctcctcccccatgctttgaaaataacttcccaagaacaggcctcctggaggcctctcctgccggggcgtccagtgccccagctggtacaaatgaacgtgcttggtaacttaaggagcaagttctcgtgggtcagcctctcatccgtgagtaatggtgaaaggtttctcagatggaaaaatagtgtccttgcaaacagtattgagtgggattttgcggagtggacttttgagtagcaccaagaaaggacagccctagggccgtggaggaagtcagtgggacaggacgcctttgttcacacagaaggcttttggctttgtgtattttgtgctgctcgcttgtgtgacctgatctctctctctctctcctgccaccctgcactagggaggagaacggccgaaaattagcctgccggtgtctctttatcttctgtcacaggtatgcttgatcattcaccaatgtccccactacatttggggtcccttggcgtgccactgccttgaagaaaatccccaggccttatcaccccatcttctctgtcccccccatgctggagtaaaataacagcaaaacagaaggggctttctgttttccaggtactaaatagaggtagtgtgtatctttttcatggtaggagatggaaatccaaagagaaatgaaaaataaaccaaacctaacttgtatagttgatttttaccatgaagactgaggtttccaaaacaactgaggagtgcttgaaatgccctggaaatgtgggctgcatcgcttttactcctgcagctttgaatgaagccccacactgcagaacccacagcgtgcatacacacagcaaccttggtgtaacaaacttcctgaaatgagtctattgttaaagggctttatcgcggttctagttcccagattaccgtgtggaaggaatcttgtagcaaccttagctctcagatttgtgtcttgagccaatttatctccctcccctccttcaacaagtgtgtttccttcatgtaattatgtaatatttacaagaagggaaaaactccatggcgacccagttacataactttaaaaatatttttattacaagcagtccagactctcagggcatctcattagactattaagtagtccagcatttacccagaattctgtttccgcttttgcaatggcacaggtatttatttgctttgatgaggaactgtccttctgacttgatccccagctgttttgaatttggggcggggctttgtctttttggcccaagaggagaggttcagaggccacctcctccccggcaggtaggccaatccggacatgtcctgaccatcactcacagcccagagtcctattctggggctatttgctcagagctctgcacgaggccaagtttgtctgaatgccgctctgtacgacggcgctgagcataaaccccagcctctcctggcagcttttttctgctgcctctttccaagtctgccggcatctcctgcttgagattctgagagtccaacaggacccaagcaagccagttctcagccccaggaatcatatggaaagcatcctcaggacccttcagctgttggagcattgcccgggcagggtctcctccagagagcatggccgccaactgcccacagcgggaacgtcagtggagagagttaggacttttctctgagactcctccctcaccggtttgctttgtaaaggaccagtagcccatgcacccaattacttgtttcagtatctcacagaaaacatagcttgtaattcattgttcctcaaacttgagtaatacatcccttttaaagataaacaacctgaagccctgtttccccctgcattttcatttagcttaatgaaaatgtgacctaaatgtgtgaaaaacctaaaatcaggtataaatcctgtgtcctgaaagcccctacttcaatataaaatcattgcatacttgcaaattattttacaagcatagctagaaaaccatgaaaatttttatggatgacgttaatttggtgtgacaggtgatgctgtcctcctaaaaccaaactgctaacagagtgtggtgtaggcagctgggcccagctttttgagtctggcctgcacgtgcttccacgtaccttacagttactcaccctccctcttttttgggttcagagccagggaaatgagcactgtgtgtgtccacaggcaggaattggttgctttgttcaggggggcctttgtaggtgctcactgaatgcttgtggactgaaaagaaggaataaatgatcagttaaggccgcattcattcaaggtacgtaacggatatttgagaatgaatgaccacagtgattggtgttttgtgttgttggtagagtgatgtgtggcagtaattcggccataaggaaggtgagaaaaatcatcattgctaacatttaagggcctgccaagccttggacgtgggttaactcattgaatcatactatgtggtctctgtgatagaaaaggttcccagtatttttttaaaagatgcaattttttatagggaggtgccacatggccattctgcctgtaccttttatctaatttgaattctatgtatttgttagaataatatattccccttgttcaaacagtacaaaacatggcatgtgaaaagtctctctcactctataccctgagcacccaactgcactccccagaggcagcctgtgttgatttttgccttcactttttaaaaaataattttttttaaacaacgttttttaaagttaaaaagttcaaacatgtaaaaaccgggtttctgttctagttttgttcaggctcctgacttctatccccagagacaattagggttacagggttctcgtatgtcctaacagagacatctgtcaggggttcttaactaggggcaattttgcccctcaggggatacctggcagtgtctggggagatgcattcagttgtcatgaccgaggctggggtgctactgacatctagtgggtggaggtcagggatgctgctcaccagcctgcagtgtctgggacagcctccctccatactcagttatagcccaaattgtcagcagtgccaagattgagaaaccctggcctatgcatatgtaaataagcaaatacaaacatgcacacgcttttctatgcaaatggtagataagccacaccctgtgctacaccctcttgcctttacattttaaaacaaaatagcaggcatgtctaggccagctttgcaagacagttttgaataccctgattcttaaagctggtcctctgaacattgggcaacaggtgtgggagcagggccagcttagcccagaggcagccctctgattttgcatcctggcccacctgggtttgcctctgtctcgtgtgattttcagccccgtagttcacatacctcctgacgatgctgtggaatccccgtgtgctaaaacccaccacagggtcagagctccctcccgtgatggaatctctgtgtagccaaccctctgccaagtccttgattggaacaaaactctccggccccttcttcttgtatcactaaagtattgggacagtgccttctagtcttctcataaccaaatttgacactaaaatgcccatggaaaggaaggagtgtgctggtttggctgttctttcccgcattgctccacttcagccggatttggcttcacccagccatgagggacagtctcgcattaatgcacttccttccgaggaagagcagccagccaaataggcaacagtctgaaggagagactgaccttacaagagtggaaccgagtcctgcttcctgtggctcattctttgaattttgcatcgtaggaattgctgcttaatacaggacttaggtagcccagcctggtcgcttctgatccaggaagcaagaggttgaaaataccgcacactttcatgcaaatcccgtttcttttttttccgccaggtcttcttaattatacatcatgcaccgctggtgaactcgttagctgaagtcattctgaatggtgatctgtctgagatgtacgctaagactgaacaggatattcagagaagttctgtaagtcattagcttcgggactgaccttaacaggaaaccattgctcattttgctaatctgtgtgtttctctaaaatcagaaactaacattctgaatatatagcagtgatgatgcataagctggtccgggattcagtgaacctaatcagagtcttgattgcatacccaagagaagctgggatcagggaccacctggatttgattgattgtgtgttcttaaacatggaattgtaccactccgggccttaggttgcatatctgtgagacactgttatcgggacacagtgagaaaatgccttatcagaggaactaatgtctacagaagttgggcgatgaacatccatgaatgactcaggccccaggtgagggcagtagagagtggcgaggggtgtggcaaattggagagtgtatgccaccttggcgagcagctcctgttctaccccaggctgctgctgttctgcaggaatatggatgtaggattactaggttttttcatgtttctagagaagcgggaaaaacgcattgttacgtgtaatctctagttttaaatgatcatcaagctttggactaagtagcatgtttgtggtctgcaggaaggagctttggcgttccatttggtacactgctgagggaaaacacctgatggccagtgttgtgacttctcttgaagcttttccatcttgtcctctgtatatctctgctgtcatctctcagatcctgctcacatgtcctgagctccagctgccttaatcctggtctgacttgcttttcccccagcatgtccagcatttgtgcctttgaacctgcgcctttaccgtacctacagcctggttcctgatgcacctggttccctcttttcaaaggtcttacccactctaagctccttatggcagggatctcacctgtcactgaatcagctgcagtctgggctgcacaaatgctcatctcacttatgcggagcccaggctgcagctgattcagtgacaggtgagatccctgccataaggagcttagagtgggtaagtgagatgagcatagtgcgttttatacaagggctgtttcataaaggtttcctctctgcagccaggtgctcaggcagtggccaggctggtaaaagggccagctcgccctggggtagtagatttgctgccccacctacatgaatgggtggaatgtgaccctgtggatgaaaggccaccactgcatggagtacaattacaagaggcccctgcccttccactggttttggtgtatgatggtctggccaggtcattttgttattcaggggagcattagcgcctctgaaaagcttcccagaaactctgtccttgttagtggtggtggcattagtgaattgattggggccttttcatggcccctgtctggcctatccctttcttgattcattcagcagtgttgatggagctctttctttgggccaagtatcatgctagttctggggatacacaatgtcataaagagtctgtgccgtattcgagctttacagtacagtagagaggtggacatggatcagatatgcaaataactcactgtcttaactcttataagcgctctaaagggaagaagtgtttggtgagaggctttggcctagaggtgacaggggtgatgtgttaaagattttcctagtggtccatctcatgacaacacacggtctggcaaatgtacagctgactcagagtttatggggccctagatatttctctgcaactttcttaaactagcgtttgctaaatgaatgtaagtcacggaaggctgagtcagcagaatcagcagggcctccagttagaggtgcagagtgccctgccagccacctggtctcgggcaggttgtttcactccatttagaaaacaggcagcgcaagccctgctctagagagctgatggagatgggggcaaaatataaagtgcccgctgggcacggtggctcacccctgtaatcccagcactttgggaggccgaggcgggcagatcaccgggtcaggagatcgagaccatcctggctaacacggtgaaaccccgtctctactaaaaatacaaaaaaaattggccgggcatggtggcaggcgcctgcagtctcagctactcgggaggctgaggcaggagaatggcgtgaacccaggaggcggagcttgcagtgagctgagattgcgccactgcactccagcctgggcgacagagcaagactccatctcaaaaaaaaaaaaaaaaaaatatatatatatatatagtgcccatcaagtgcctgctgggttgcaaactggccaccagactcatttggtttggtctttgcagtatttaaaagaaaattttctgaattgccaacattaaaatttaggaagaaaagtccagatttttggaatcttctccaacagtcagaagatctggtccccatcaatgcacgtttctacgggaagcttcgcagagcctgcccccatcagatgaggcgtgtttaccgtgaaacctgcccactgctaactgggactacattgatgttaatatgttaatagcaactggagatgtactgggtccctcgggacttttttttttttttagttgcatgatttccaagcctgaggatagctgccgtggcttcatctcagattgtcttactgtaagataccctctgcagtgctgaagctagacttgtcgttctaagagatgaaaccagagattgctgggctctggggtttgcagcattgtttatttatttttatttatttatttattttgagatggagtctctgtcgcccaggctggagtgcagtggcgtgatctcggctcactgcagcctctgcctctgggttcaagcgtcagcctcccaagtagctgggattacaggcatgtgccaccacgcccagctaatttttgtatttttagtagaaatgggctttcaccatgttggccaggctgctcttgaactcctgagctcaactgatctgcctgccttggcctcccaaagtgttgggattacaagtgtgagacactgcacctggcctgcagaattttttttttttttttttttttttttttttttttttgagactgagtctcgctctgtcgcccaggctggagtacagcggcacgatctcagctcactgcaagctctgcctcccgggttcacgccattctcctgcctcagcctcccaagtagctgggactacaggcgcctgcccccacacccggctcattttttgtatttttagtagagacggggtttcactatgttagccaggatggtctcaatctcctgacctcgtgatccacccgcctcagcctcccaaagtgctgagattacaggcatgagccggcctgctgcatttttagagttgtgataagaacacaacatgagatctacccttttaacacatttttatttgtatggttaacattattgttgagtgtaggcacagcatcattcagcagatttctagatctcatttatcttgcatactgaaacttcagaagtacaatgtgctatccattgctctgtggagtcacctgcatgactgatacttcatacccactggacaacaactctccatccccccagccccagcaatcaccattctcctctctgcatgagtttgacaattttagatacctcgtataagtagaatcgtgcagcatttgtctttgtcactggctcatttcacttaatgtaatgtcctcgagattcatccatgttgtcgcatatatcagaatttatttctttaaggctcaatgtgtgtgtgtgtgtgtgtgtgtgtgtgtgtaccaagaaatataccacattttctttttctttctttatccatttatccatcattatgcagttttagtttttttgattttttttttggtgtgttttgttttgttttgtttttgacagagtctggctctgtcgcccaggctggagtacagtagcgtgatctcggctcactgcaacctctgtctccagggttcaagtgattctcgtgcctcagcctccgaatagctgggactacaggcatgcaccaccacacccagctaattttgtttgtatttttagtagagatgggattttaccatgttggccaggctggtcttgaacttctggcctcaagtgatctgcccgtcttagcctcccaatgtgctgggattacaggtgtgagccactgcacccagcttttatgcagttttttttttaattgaaattttttactgagataattatagatttgcgtgcagttgtaacagataatacagagagatcttcctcagtttcccccagtggtaacatcttgcaaaactctagtacaccctcacaagcaggatattgacagtgatacataggatttatgtttgagcaaaagcaaactgcgggttactggcaacctctcagtttaggacactggctgtagctcaaccatttagtcaggggaagtgtttaggagatctgtcctctctcctgatatggcctcttcttaggatgaaggtctcacctcccttgtgagagacacacaaactgcctttgggatgtaagagccagttgtggtggacacctgaactgaaaatgagactctgtagcgtggagggaattgctagcccacatgtgtcggctttctgcttccagttactacctttctctcagtgtgaagttgaagttggttgtaatctgatgactatcgttcaggtttgggaagagcacaggctgaattccttctgtgacttgtttgataatagtcctggtacgatttaccttccttccctatgagcgagaacagactcctattgtttcctgcccaactcggatgtggtttgattatacttgttttaagtttcttggtcttttttaacctactttctccttcccgtaatttgtagataagttactggtattgcctcatttttaccagcagacctttcacaaaaccaaaccaaaattgaagagagagaagcagaggggagatcacagttatttgaaaggactgtaatttagggttaaatggaaaacacatcagcatggttagatgaatgtctaattgaaattcatctgtgcgttaaaatcatatggttcctgctaaaggctaattcttgctataattcgaatgcagagcagatagtgtttcttgtgtggggaaatcgagtaggacaacactaattctgaaactgctaacatctcgttgtttttgcagaatgaacatatagattagaatttgggatatgcatcattacttgtaggtactttttttaaaggacttttttttcctcttgggtttctgtggaatggtttccttcatttttgcattcattcatttattcatctattcatccattccttcagcagccatctgttgtgtacttgtgctgagagatgagggatgtggtggtgcactggaacgacctgacccctgccctccctgggcttccctcctcccatgaggacagggaccatgtctcggagatgcctgtgccacctgtgccatcatggggcttgccagagatgcccagggaggtgttcggtgcaggagtgaatgactcagtgggtgaagtggtagcagagtcacaagggctctcgtgacattcttgtaatgactctcagagcagaagtcacttcctagcctgccccttgaatgccgccttctctttgcctcagtggctgggtttgcagtgggctgcttttggtgctgttccatgttccacctccagaggcagccttgtggagtgggtgctgtaaccagtttccctgggctcctcaaatcgtggtccctgattttactaggtgttcccgggcctcagtttcttacctctccagtgagaatagcaaacatgggtttatgatgagaattaagtgccgtgtaaagtgcttactccaaagcctttttatgtacacagcaagtgcataaatattagatgttatcattataatgaccttagttcctaaggctgcgcagtgaccttccacctcctacctgggaccttcttccctgggcttacgagctgtctctggactgatgaatgtggaaacagacaccatgcgcccttcagtggggtggcttttgagcagacaccaaggcacagagggagaagtgttagtaataacagtgatgatgaaacaccaatgttagccattgccattgagtgatggtaggtgaagccctctgtgtgtatactgtgtgtatactgtgctctccattcagccagacccagatttaatttctggaaagtgcaaatactgttgtcgttgttttttgttttttgtttttttttgagacaggatctcgcgttgttgcccagtctggagagcagtggtgtgatcctagctcactgcagcctcagcctccccaggtcaaacgatcctcccacctcagcctcctgagtagctgggactaaaggcacatgccaccatgcccagataacttttgtttttttttgtttttttgttttgtggagatggggtttcgccgtgttacccaagctggtctcgaactcctgggctcaaacaattcacccaccttggcctcgcaaagtgctgggattacaggcatgagccatcacacccagctggaaagtataaatacttaactgctaatgtgggttcatatggttggctggttgtgaagtcagggtctgaggattctggggcagaataggcttgcttatctccacataaggacattgacagtctgtctgtagataccagtttagcagttaggatggtttccagatgaatctctggacacctgtcacttctagtagcaggactctctgcccagccggatactcccccaggatatggtgtgtggagccagtggctaggaaagtagcagccttgcttctctgggttgtgtgtttgcagattcagagcattaatcgttgacttagctcccctggtcgctgctgcagggctttctttacaactcaaacttgtatccgatgtcagccgagtctcccgtgtgctgaatgcatcaggcaggatagcaccccttccggccaggattagagttcctgagtcttttagtgaccctgactgtactcatgatcccccagctaatcagtgctggttccaaggcgcgcacattcttcttcctgaaaatgctaataggcttctgggagaaggttgattgtgaatatcaaagggtaaagatagacttctataaattaagggccttaattgacccattgcagacattcccacaagggaattagagcttggtgtatattctcccttttggctttgccattgaggtctatcccctaatccctcactgcagttacggctctgaggtgccattcttgcccaccgaagtattgaatgtggcagctctggtctatgtttaagaggatttgatataatcaaaatccagagtgcaacatgaggtccggtactaaggagcgtatcgttgtctgagaaacagttgcgtctctctgtttcctggggcagaaggtgggctggacaactgaggagggtctcaatgtcccttagtacttgagaagggagcaggctttagccagggccgcgggtgactgtgaccaaaggcccggggttttggccttgggccagctagccagagaaggggcaggtgccttcattgctacatcctggagaagccaattggtaacaatggagtgggcacagtgggcagggatgggagcaggaggcagatggggaagaagccttgtgacttagaccctagctggcttttctatatctgtcctgcagtgtgtgacacagaatgggcttggggcagccacaaggctggaggcagctccatgtagaatggggaccttttctgattgcgttgggccattggtgacttcttctgggtttcaattaaaatcagaaaattgagggtgaggacagacaaatgaggtacatgccacttctggcctctgtcccctgtggcattgttagttttcatgagtgggccagcctcttcggatatttgtgatttttaacctgattttgagttacctgaagccaggtcagtattatttattcagatattcagcagataattattgggtatctgccgtatgccaggcactgttctaggccctggagatatatacccagtgagcaaaacaaaaaccttgacctccaggaacttgggtctcatgcagagagacagaggaacaataaagcaaatagtaacatcagggcacgttagatgtgagaagccctgggaaaacagtagtgaagcagaggatggacatgggcaatgctcggaggctggagtgttacagttctcagtaaggtggctggggttggccttgttgggaaggtgaggtggaagcacagactcaaaggaagcaagagagtgagtcatgttggtatctggaggaagagcattttggtcataaagaacatcgtgaacctgggaggcggagcttgcagtgagccgagatcatgccactacactccagcctgggcgacagagcaagactccgtctcaaaaaaaaaaaaaaaaaaaaaaaagaacagccagtgcaaaggccctgcggtgggatggtgcctagtgtgttggaggaacagcaaagggcaatgtggcaaggggatgggaagtaggagatgaggttggagagaacaagtgtccaagggacatggcacctatgtgccattggaggactcaggagttgctgtggaaggagactggaacctcttcgtctttgtgtccccatgtctagcatggttcctgcagtcaacgttgattgtcttgatgtgacaagtctcggtacgggaatcaaacacatatctctaatgagcggtggacatccggtcttggccagtgtcagagtccttgaaactggttttgctgcgggatgctttgcctgatgggagcctgagggctgcacttgagcaagaagggagcattttgctcacttctcagagacccctgccctttctgggcattccagcagagttcacaagagtggcttggtggtgtgagtcattcgtttcatgcctgagggcagtgcagctctcatccctggaggtgattaatgagtgggagtttccctagagagttctgaggccagttgagtagcagatcctggctggcctgaaattgattgcctgctgaccacttgctgggttgcttataacctggccccaggacagcttcctggtagcctccagatacgcacggggacaaatttgttagtttcatgggcaaagagaagaaaaaatacaataccttactgttaaccacagtcacccttctgtgcaatagaacaccagatctcactcctcctgtctaattggaactttgtacctgttgaccaccctctccccatcttccccatccgcatccctgcatcccctccctgcccagtctcctgtaaccactgttctcctctctacttctatgagatcaactttgtttagattccacaagtgagatcatgctggaagacagagttttgaatgttctcaccacaaagaaatgataaatacatgaggcgatggatatgctaagtaccctgatgtgatcattacatgacgtacacatatattaaaacatcaaattgtaccccataaccatgtacaattataatgcatccattaaaaaataaaaaagaaaaagataacattaaatggttttattcactcaaataatattgtgctgggtgacacttgagttctgggtgggtcattttctgacatgagcagaatgtgctccatctgtgaggcagaggctggctgccatacttacccttgtgcactccctgcctcgagtaattgttgagcccctacaagttgcaggcaggtgctgtgaatgaacaagacatctgtcccttccctgatgatctatttgtgggggatagacagtaagccagctcatcctcacaaatttaagatttggatatgggaaggaaatagaagcaactttgggaggtatgatgagggaagccctctaaggagggagcctaatattgagaactgaggtcagggagctaggcctgctgagagttgaggggttgggtcggggggcgtggccaaaacatgagaaatggtgagtcagaggcctctgtgggaaggagttgggtgtatatgggatcaggagagaggccagcattcaagaaatatcctgggttggtggaagagagggacggttttcgttttatagaagatgaacctggctgggcttggtggttcatgcctgtaatcccaccactttgggaggccggtgtgggcagatcacttgaggccagcctagacaacatggtaagaccctgtctcttcaaaaaaatacaaaaattaaccgggcgtgatgatgcgtacctgtgattccagctactcaggaggctgaggtgggaccatctcttgagcctgggaggcggaggttgcagtgagccatgatcacaccactgcactccagcctgggcaatagagtgagactgtctaaaaaagaaagaaaagaagtcaagcttacttgtttgtctcattgaacatctcatttcacgctcataatgaaagagagcgaggtggtgttattgtcacacgctccccataaggaagccaaggttccgtgattgttcctttgggattgcaggtgactagccccaaatctcacactgtttctattccaagtctttttatcaccacttgcaattatgttttccagtttggcatgagatgtcagggcagtgtagcattttgggctgttctgagtaacagaataaccagtgtttcacagttcatctttttcaaaatatagtaaaatactctttccaaagaaataccaaataagtgcttggtttgtcattgtttagtaagggagtgtgagatgcctcattttgtgtgattgaagaggcctgttcaatgctcgtgatgatcttgcaattaattcatcccacaagcattccctcttgattgaatgccagagacagtgccagacatgctgcttggcattgagagggacagagaaggtgacctgggatggggaaggcaagggagaggaggctggccccctacagacttagtgacacgccagaggtcactttccaagaggaaattgcagcaccatcttgacgttacctgctcctcatctcagcgtcaagtgctgagcacgcggctgcaagaggcctgtgagtgctgtgagtctgttccaattcctgagagatggacatttccttgctttacgcctctgcagctgcaacacttgataactggtaattcatggagaagaatgccgtgttctccttgttaatggaagcggcctgctacctttgcatgttccccactccatagcattcattttctcctttacatttcggcagtgccgtcaaatcgcctcactgatgttgcagctgtgcattcttcatgcatgttgggctttggttccacagctccacgcggctcctggattggcgagtaaggcatatgtctatacatcaccctggggtacatcacccatctggtgcttgcttgccaatcacctccttctggatgagaacaggttcactctgctgcactcatcacccggcttcctttttcagccagtggccaagccatgtgctacagtgctgttggttacagtgggtgtgacctcctgtgactttttgtctctgtgtttatcaggtaaaaatgtgaaaagatgtgtgtgtctgtggtcccagctacatgggaggctgaggctggagtatcacttgaacccaggagacggaggttgcagtgagctaagatcacaccactgcactccagcctgggtgacaaagtaagatcctgtctcaaaaaaaaaagtgaaaagagtcacattatagacaaccatataattgtcaggctagaggaccacctgttgagtgatgcataaactgtcactgcatttttgttgcaaagagctactgtttctctgattagtgtgacgtcggcatggcctagtctttacatcagtgctcccgggaggctggcccaacgttgggaggtgcagcaaatgcatatggaagggaatcgtgtttgagccatgtggcaggaaggttgtgcacctgggcactggggctagtttattcctgggttcaaatcctgcctctgcctctcactagtgggtgaccttgggcaagatcctcacctgtgtagttccttgccccatttggttatttgtaggataaagcaagacaatgtatataaagtgttcagagccatgctgggcacattttaagtgttcactgagtattcaggatggctgttattacctggaaagagtaacaagagtgtgccatctcttggcacctctcagcagcactgttggggagatgctaatatgatgcccattgatggctgtggcaactgagacctatagaggagaaggtaggaagcagtggagccaggactgaaaccacggtggatgggaccctgggcctctgaatcccaccctggctttgtaccttgctgtgtaccttgccagtcctggcgcctgaggccggagatggggaaggttagccaggggcccaggagcatgttggggaggctgagtctagcccactaacaaagcagaaggccagcgagcagtaagttgctgggagcttgggagtcaagtttaaagcatagaacatgactgttctttaaaagcccctcccctgccctctcttccatcctcgtgatctatttgccagggggttgaagggcaatgaaaatttctctggtgcccccttgtaccaggcattttgcctgttggatcccacactacccccatggtggcgtgtgatatggaactactcttgtctctgttttacagatgaggaactgaggctcctgtggtcagggtcgcttggctagtagaatgtgggtctcagacttggggccaggtctgcctgggcatgttttttgttagtcaccatggcctgtctcctttcttaaggggaaaacctttctcctacttctcaaatcgcttagcagagctgtttgaggaagcatcctcagagggtgagtaggctcggcctaggagagcctggaagggtcttcttagcttgattatcacaacagctttgatagattcagacagaatctcaggccctggaatctctccttcctttacctgatgcctctggccaccggtctctctttccttcgtgctcaaccaagattcttccctgggcaggctgcctggtgcccttacatcccctttcctggtcactcgccaacaactgctttctcccctccctgctgccccactgaatagatgctgagaaacccactcaacacgttgcatctatagggcattgagtcaaggtatctgatatctcttctgaggctgtgagcctgaagaacccctttgtgagcagcacgggctagtgcctgactgagaggctactggctggccggggaccactgccctgacttcctgcaaagtccagcggctgtgcatctgcccctacctggggagctggccgagcaccttgggtccaagggtaccaccactgtcaccaagcaccagccccaggtgacctaggccttagcagaagtaaaaggtgagtggcttctgggcacacctagagagctggctcctcctgggctctgagctggctttcctactattctttccttcctgagcatgctgctgaagtcctgttgacatccaagacttgtatcagtcatttcctcctctatcaagccgtcctaagctccccctatgcctcccagccctggcgcattttccctcccttcctctgcggccccatcactcttgtgtgaacctcttctcttccagcgtctgcatgggccatgtggcaataaatgcaggattcaccaggattcacctgtctggggtggactgtgggctctgagaggggtggactgtgggctctgagaggcgtggactgtgggctctgagaggcgtggcctgtggcttcctgcgcttacctgagtccccctcatttcatcagtgatcagtgaatccagctctcccacctgttcgctttgtcctaccttgtatttagggcattacagcaatccaacttcattgaaaatcctcttggtaaactttttggtgttttttgtttgtttgtttttgagacacggtcttgctgtgtcacccaggctggagtgcagtggcacgaccacagctcactgcagcctcaaccttctgggctcaagtgatcttcctgcctcagcctcccaagtagctgggactgcaggcatgcaccaccatacccagctaaattttgtattttttgtagagacaaggtctcaccatgcttcctgtgctcatcttgaacttctgggctcaagtgatcctcctgccttagcctccccagatcttgggattacaggcatgagccactgcgcccagcctgggaaagtttttaaattgaggaatcacataaatacaataaagtacataaaagtttagtaatcttagatgtactgcttgatgattttgtgcacatgattatattcatgtataattcgagtcaagatggaaaacatttctggtattcccataaagcccctcctcagtttgtaacccatacctccaccccacccaagagaatcaccatcctaacttataaacttgccttttcaaagttttttaaattgtgataaaataaacataaaattcactctcttaactattcttaagtgttcagttcagtggcattaatgcgttttgtaaagatgttctttacgtgtaaatagtgctggtaataaaagtttctagtgctggtaatatctaaatagtgctggtaataaaacaattgagtgatgtagacgcaggtagagcagaaagtgaaaggtcctccaacctcagtatcttcctcagagggaaccactgttctcagtttgtatattcttccagacctttcgctgtgtattttcatgtaagtatcaacccaggaatacatgatatgcacttatgtttcagccctatagttttggttttattttaaccataaactgaatcattaattgttgattgattgcaacttgctttttcttgtgcagcctgtgtccaggtctttgtaagctgctgtacccacacctggtggaacatgtttgtttgacatctgtcttctcagccatgtgtctcctctcgttcactcaggcacccagtctttggttgtttccatcctccctcccatcccattgctgccctttgcagtttctgcacacagattcctccattccatgaaagattgatccctggggattcacctttcccaaagtgtttgacttttgaaaaagcaaggaccaaagcctcaggtgaaggggttcaaggctgatggaagacgtcattaaccagcaggcaggtgcagacgcttagggagtagttaggccccggggcacctctaaaatgtagttgctgactgttagctggccctcaccccagaagccagcccaaatattcagctgcagagctcagggctcccttgtgtttcactgcagtcagcaaagaggctccttcccttcatgctcctcctgtagcccagcctcaggcacctgggagatgagcgcgtggtgaaacctaaacctgtggcatttgggacatgtagaccttctttgcagaatacttttccctggggcatgtgttgtgtactttctttatgagaaaatcaacccaaacgccttgtgatttcttactctgaagtgggcttttccacttctggttagtttgggtgagcttgctctttcattctgctacgtttagctcctgagaaagtttggctttttttccccttctttccctcccttctccttcttctccttttttcatcattctgtcttgccctttgggtacagcctggtacaaacattcattcctacagccatgagctcactcagcagcagcctgtccgcccctgctctggtccaggcaccgtggggtagagatgagagcacagtggcgagaggagggacaggggcccttctcctaggggcttcagactggagcatccttggaggctggcagccagaagcagggtgaccggagcaacagaaatggtcacaaatctctgcccacatttcccagccaaattctaccagcctctgcatgctaactgtgatgttttggtgttagctttaagaaaaaacaaaaaacaaaaaacaggtttttaaaatatagaataaaagggagcaaaaatagtccttagtcccaatgtccaaatgacccctgctgaatttgtattatgtatctatttatatgtatatgtttagagacagggtctcactgtgtggccccggctggtcttgaactactgggctcaaggaatcctcccatctcagcctcccaaagtgctgggattacagacatgagctccacacccagctgaatgtttaaaataaagttaatatatgttcatgattagaaatctcaaaccaaaaggtataaaataaaaaaagtgtgcttgtgtgggtgtgtacacagtgccactgctttttttaattcccccaagatgccaatacattcttaggcatctttccaggaaaagtcgcatttacaccatcacgtatagcctttgaaaagctttacttgaaagggaccctactgcctactcccttcctgcattttcatcctggtgctgagtctgcatcagtttatttaggaataaaaaggccccagtcttcttagattcccaccctttggacaaacagatcataattacctaacaactcccctatcaatggacatttaggttatttccagttgtttactggaaggtcgtgttataaaggtttgaaatttccccagtaagcatgccctcccacaccagacacctgatcactgagaaaagtagatccctttggaaagttttaaaattcattcttgcagctgattttttttttctttttttagatgtaagcaggaaaagaaggtaatgttttgtgttggatgttcaccgtttcggcactctctgaaggaactttattacttatttatttattttgagacggagtctcactctgttgtgcccaggctggagtgcggtggtttaatcttggtttacttcaacctccgcctcccaggttcgatcgattctcttgcctcagcctcccgagtagttgggactacaagcgcccgccaccacacctggctaattttttgtatttttagtagaagcggagtttcactatattggccaggctgctcttgaatacctgacctcaggtgatccacctgcctgggcctcccaaagtgctgggattacaggcgtgagccaccacgcccggcctctgaatgaactttatatccatgggttcctttggttctagggggccagaattactctccatgttttagaacaggaacctgaggcctaggacaggccagctgggttgggtttcagaccactctggccagccccaggcgctgagcactttatttcacttcgtcagttctgccagtttgttctgtatgtctgagtccacacagagcttagggaggggttctatatctgtctgtgtgaatttctgctcttaatttcaaactaggggacgttttgccctgcgcttggtctctattttctgtttctgaaagctttgattgctgtgtggccggctctgaaattcactaggagttggcagtgatgggaggaagctaacttcctgggtttggatgcttcaggagaagatgagagggcgactaggctgcattcgatcacccggcatcctaagtgggctctgatggatgctgtctgtcaagcagtgcattctcagaacgctcccatctgggggccctcggttattggcgtctgtaatacgctatctgggtttcctggacagtagaatcatgcagcaatttatgtgtcatttttttgtggttgaataatccacagtgggcaaataaaaattaatgtttatatttggatgctaattcacctttcaattaggttttgttttgagcgttattgaaattaatctgtgttccttgagcacatttccatttattggcaaggtacggtgttccccagcatataattggtggtcgtttggggtaaattcagatggataatctatatcaagataatggaaaagtttattttgaaactttttttaaattacaaaatgatatctgaacattatttcagactctgataagagaaaaacacttcaatcaaaatcccgccctaaacaaatcaattttcttctgtcttttgtgcctttctagtctgtttgcatgtctatacccttttttttttattttcttttttgagacatctcactctgtctcctgggctagagtgcagtggcgccatgttggcgctctgcctccttggctcgagcgatccttctacctcagcctctgaagtagctgggactacatgggcatgccaccatgcccagctaatttttctattttttgtagagatggggttttgccatgttgcccaggctggtcttcaaatccttggctcaagtgatcctcccagcttggtctcccaaattgctgggattacaggtgtgagccatgtgcctggccttcctctttaaagagcattaaatgtagaattaagttttagctcctggtgaaacactgttcttttaggaagagtgtgagctttggaattggcaagccccagtaagccccaattcaaattctgactccaactcagtagctgtgtgacattgggcaagttatttaacctttctgctcctctattttctcaatgataaaaatgggactgataattcctatatattatggttgttataaagactgagatatactaatatgaagcatgaaccacagttgacactagcctcattctgtcgcccaggctggatggagtgtagtggcacgatctcgctcactgaagccttgacctcccagcctcaagcaatccctcccacctcagccccgcaaagtgctgggattagagaggtgagccaccacacccggccatctctgactttttaaaggaagaactttgtcctctggggcgagctgatctttgacttattgctgatacttactaggctccctttctaatgagagccagaatttgacaacacccactacacctggctttttctttctggttatttatgtttaatataatagcaaggcacgctagtgttccattgcctgtagtgatagttttgtttaaaatgaacttatttgggttaaaattaataataatatcagtgggctgtagctaagacacagcttgtgtggctggtacgtggttttgaatcccggctctgccacctcctggctgtgtgacctcgggcagatccttttctgtctctgtgcttcagtttcttcacctgtaaaatgaggatgacacagtaatatctcatgcagttgctataaagttcaagtgagatcatatagtcagagcctgagaacagcatctgacacataagaaagtaccacagaagtgttcatcagaagttctccttacacaaacagctaatatttggggagtgtagagctgctgctggtaaagtgcaccatttctgacttagggcagtagacagtaaatggtagctggcactgttgttttgattatttgatgatgatgttaataatgggcataataatagatctggaggtggcatttgttttggagattaatttctctttattaaaatatgtttttattgtctgtgttcatggggtaaaatggcagtgttgccacattgatgtattgcattgtggtgaagtcaggaccttcattgcatccatcactggagtaatgcgcactggacccaccaaacaccctcccatcatccaccccctccaagtccaccacccctcccagtctcattgtccatcatcccacactctgctgccatgtgcacatgttatttagctcctgcttatgagaatatgcagtaagtgtctgagttatttcacttaagataatcgtccccatgttgctgcaaaatacatgatttccttcttttttagtgctgaatactatgccatcgtgtgtatacatgtcatcttctttatctagtcctctgttggtggacacttaggccgattccatgtctttgctattgtgaatagtcccgcagtaagcatgcgagtgcagctatcttatgatataatggtttcttttggagatgagtttcttaggacagaaacttttgggcaacttgatagcatccagcaggattctagtgttcaaattcacctgttgccttcgttggactttcctaggccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaaggtgagtgtccccatgaacgccgccctgtgcctgcgccgccagccagcccgccagcgaggctgccacctgtgccctctccacccagacttctgctccccacagtgtccagccagtgattcgattcctacctcacactggcgtacctcattctatacagccctgccactcggaggctgctgtaggtgtatgtcatatgcaggtccagggcaagtcccgccctcatgggatgggtgacctggggccagttttcctcacctattaaaggagggtaacaaatagtacctactttgtagtgttcatacaagaattaaatgagcgaatatgtgcaatgtgctccaaacagtgcctggcccattctaaatgctgcaaaggcttcgatgctgcagaagtgttcgtcattattatgacagtaggagcagcatggaattattattatctttatccttattactgatataattattcccaataacctggggttatgatttgcatcctgtgcactgcgggaagaaagaggatttgtgtttaatgaaatgatatgcttgtaggccgagtgcagtggctcacaccttaatcccagcactttgggaagccaaggtgggaggatcacttgagcccaggagcttgagaccagcctcaccaacatgacgagatcctgtctctacaaaaaaaaaaaaaaaaaaagtgtttagtatttttaaaatactgaaaaatcaaatataattctctcaattcttacgttaaggttttttaagtcctgtctgtttagaatgaggtgcactcgtgtgtagtacgtatgtgctctgtaagcaaaatcattcattcctccttttgccctttttgggaattctggtcaatttttcacctccctctcgttgagatgctaaaaccttcttgaattggagatcatttactcttgggattaagcagaatggaactgccctattgcttgtgtcatgggccaggctcacagccacacagctggggtctctgcccgtcgtcctgggcactggggctgggggcagcgggaagtgatggggagcttgatacttggtagaagtggagctggggctcttctcaggaaggtctggccacactttctggaatgaacttggcatctcctcagcagtctggttgcagtctctgtgggtgtggggaacacttcctgtgagccctcctcctgggccttgggctcacagtggctgctctgaaaccacctctccacagccctgtcagcaaggactgcgtgagcttcccagtccagggcatctgaagctgtaacacagagccactcgttcagtgactgggagctcatttgcttttgggagttgcctgagattctgcagccaaagaatgcctccgccaccaccttgcttgctccatcatgactttcttggcagttgtcagtgaataccatgatcacatttcaacaagcgtaaccaaaatgtctctctggtgccaccgagacctctttttatggttgagatctccagcctcctcttatttctgtttaaagtgtgcaataggtgttttggtttaggaattcatttttggcctgggaagcctttgccaataaatatcactgtggtggggaggggaaggccaaacccaaggtaagccatgctaatttgcttattggggtcattctgattattttgttgttaatgctgaagaaaaatgtctgcctaatccctaggtttagttgttctgttgccacactgggggagaaatggacatcttcacctcattttgtgcattgtgttctcatcgattttgttttggaaagatgctacctctttcattccagtccttttaaggatgctctctaaccaggcctcagctgtgactaacagtggtgtggatcagacaggcttagccccaaaatcacaatcaaattagtcagccagccagcccagtcctggcacacaggggcttcaggccagttctgcaggctgctgtttcagcttgaactgcttgaattagagtaggggctcctggaagctgtgcccagctgccctgggcagggtacaagggaacgaatttctgccacgtccaaaagcctgttttccaggtggttacttagccagatcgtgccacacaggacccaggaatctccccagaggctttgcttgaacagttggtgcttcagggctcagtcacacatggctctcaatgacctgtgcaattttgatgccctcctaatttcttgagcacattagtcatttcaaaatatgatggatctgtcattttgtcactcagctcaccataaatacatacaactttcatagaccggtcctgccaggcaacagcacttgtattctggagctttctgaattatatatttgctctcttgattatttgtaaatgtgaaggtgcagttggtgggtgttctctccttagacggtatctgtgtttggatgaaactgcacagctgttaattcctgtgagtcggaagggtgtcaggcacatttcttcattcacattgcataccagagaacagtgtagatgctgggcagtgcctagaagatgcgagatctgactcgcagtcatgtctcagcatctaggtttattgtgtgtcttggatggcctcttgaagctctggacctcattgttcctgtctggaaatttctgaatatagaaaatataattcacatgatgactttttttttttttaagtgaagatacgttgatatttgcgattgcaagatttagaaatccaactcagactggcttaagcaaagagggtgtttattgttcatgttcctgggaagcttggacagggctgggcccaggtgcgctcacatcgtcccagcttggccagcaagtggagagggggcttctccttcccagtggctgccactgaagtcctggggccaatgcttgtgggtactgtgggcctgacttgggtcctcttcccacccccagagatattctggaccgattggcctggcccgcatgacaaatctatgctacagtggctccctcagtaaaaaatgagatgcgtttatcagaagcaaggggcagggatgctgggccagcagaaatagcagatttccccctagaaagtcacactgtatttctgggtactccccttctctctcaaggccatcttctgccatcctattttgagatagacatgcggctcttttctcttccacattatttcttctctagaagctcctttcattgtccctagatccacggacttatcgacagatggacatggtgactcttaaggaaagagatgctgacactctgcctctgcataccctgccaatcccattttagtagtgaaattttgactttaaaagacggggaaaatacaggagtaaaaaaggcatgtggtcacgaggcacagttttgccatgacccaatttggatatggcattagtgtgtattgttttgttgttgttgttgttattttttataaatgcagcacccagaattcacacctcctccagatttaagctcagacaaggaagttgtgtgaaatgaatgtgcacccctaacccatccactcccttccccagtctacagaggaatttgctctgcctcaggtcccaagtaatgggtgactcattctgcaaccaagaaatcacagggcccctaaatttgcagaaattaaatactaaaaaaagaaggatatcatcgtccctgtaggcaaagaagcattcactctgcccaggaaggcagacttcctagggtacgtgcttgttttttagcttgcccttgagtctgaaaggacagttatctcttttggaatttacttagagcagtaacttaataagcatatcctagggactgaatccttcaaactcctcatgtaaaaatagggctggactactgtttttttgcctatggaaaaagtaattgcccggactcaccttcaaagcctactcatttgttgaaattccagcaagggcatgaagtaaagatgataggcctttgaacctgccaggttagctgggtttgagagggtacctgggagtttagagacccatcttgcctttttctttttcttttggaagtctctactgaaatgggatgaaacctggcctcatttccagctcctctttcaaaattagagccagccccaggcctggcagtgtcttggttggggcaagccagggactgactatcggagagttgagatctgaatcccagctctgcccctgaacagctgtgtggctctgggcaagtaattgccctctctgcacttctccacctatagaggggacttcctaatgcctgggcctcagattgtcataagtgagaacatcaacactgtagcgttcagcatgtgacacaggagctttctacgaaccctggccaaggtggagggcagagtgaggcgctcgaacagcaatttgagtgtggttgcatgacctccacttgggcaccaagcacgtttctgtgggacccgtttctctgttaatttctacagctagtaagtgagcttagtgagtgtgcaggtgagtatgtgtgtgagagtgagtgtgtttgtatgtatgtgtgtgtgtaatggtgggaagagagggagaagaaggatcagcaggcccaggcgctgcagtagagagatgttgtggggctgtcaggttttcagatgggcttaactgggataaggaggagaattagaggtgaattaggacaaagcctctgaagagcaacttcccgaaaacagttctcaactcaatctcctgctgggcagtagaagataataaaaaaacaaaggaagggctgcccccagtacttagagcacttagcgcacacactctcggtcgttgtcaggggctgtttgcttcttgaaattctgctaaaaagccagccaattacatgcaggctgtcccttatatcctaggtaaccagccaggcatctttccccttagccttcctttgaaggtcttattcccctcttgccatcttttttcagtctgtccttgctgtgatcgctggaatatggaacacagagggcaactgagaaaatccttgaatttgtgaagtcaaagactattgggaggccatgcctgccatttccctgaaaagcacttcatttaccaaatactaatcagattcgaatggacatcagcccgggcgagttgttaaattattgctgtaatttgaaaaatgagtgtgtcagagtatcagggaagctcaagaatctggccagagctgtcatttagagaggcagaagtggacgtccttgggtgctgagggccctcaggactctcctggcccacaccagtgcctccccacataggcactagttggacaacaagtggaaagatgtggccttccctgctccctttttttttcctttttttaaacttatggtaaaatacgtataacaaaatttaccatctgaatcatttctaagtgcacatttcagtagtgttaagtacattcggctgggtgcggtggttcacgcctgtaatcccagcactttgggaggccgaggtgggcagatcacaaggtcaggagatcgagaccctcctggccaacacagtgacaccccgtctctactaaaaaaaaaaaaaaaaaaaaaaactagccaggcgtggtggcgggcacctgtagtcccagctactcgggaggctgaggcaggagaatggcgtgaacccgggaggcggagcttgcagtgagccgagatcgcgccactgcactccagcctgggcagcagagcgagactctgtctcaaaaaaaataaaaaagtacattcacgttgtataaccatcaccaccatctgtcttcagaatgcttttcatttttcatcttgtaaaaccaaaactgtgcccatttaataactccccaccccaccctttgatgttctgtctttatgggtttgactgctctaggtcgtttattcaaatggaatcatacagtattgtcttttgtgcctggcttgcatcacttagcataaagtcttcaaggttcattcatgttgtagcatgtgctggggatttccttctctttcttttttttaggctgaataataattccgttatatggctggactacatttctttatccactcctctgttgatggacacttggattgcttccacttttggctattgggaataatgccgctataaacatgggtatacaaatccattcctgcctttgaggcttttgtagaattgatagaggctgcagagggtctgggtggtactggccaaagcaaaatgagttggagatttgagttcctgctcccagctttgcagcctcatgagctgtgggatggtaatcacattactcagctcctagaggcgggaaacttcagttgtgtgatggcgccgtaccacctacaaggctaggcgctggagtgttggacatgacgggccatgctgcctggcatgggaactgatactgtgcaggcactcatttccacaacttaagggggcagtgcaaagaaaagagcccacagtagcctggggcagagactaatgccttggtacttcagtttcccctgccttaacatgcagagttgagggtacataagtatttctaccactgcagaatatagagatggttttagatggtacagggagagccttaaagaatatggtggccaggcgcagtggctcacacctgtaatcccagcacttcgggaggccaacacaagaggatcacctgagcccagaagttcaagaccagccaggcaacatagggagacccctgtctgtacaaaaaataaaaaactagccagtcacagcggtgtgtgcctgtagtcccagctactctggaggctgaggtggaaggatcccttgagcccaggaggttgaagctacagtgaactgtgatcgtgccacacactccagccggggtgacagagtgagaccttgtttcttaaaaaaaaagaagatggtgcaagagctctaattctaaatgattatctccatggcaggggatagggtgggtgggggagcctgcatatttgctgtgacaggtatttagtacttgaatacctctttcataaacatgaatctccctttcatctccctttctcaatgcacacaacaggccctagcacctttttgtttattcatcatgtatatttttgtagttgctttctatttatactggttttatgcttatggtaattttcccaaactttttatttgaaaataatttcaaatttacaaaaggtgcaaagccaaaaatagtataaagaacacctgtttaccctttacccagtttacccctgtaacatttcataccatttactttcctattgtattttctctgtctgcacacccgccccacacaccccacgcacattcatcgtgcccctttcctcctgaagcatcatgagcatttgctaagattaaggtgttctcattcatgagcacagcacagctgtcaaattcatagtattctcctgctgtgttcttgttgtattggcctaataatgtctttctagcatattctctcctccagtgcaaggtccaatccagaggcgggtggtgccttccgttgtcacgcctccagcctcctttactccggaacatttccacgatctctttctcttttgcgacattgacttttttttgaggaatacagaacctcctcctttttttgttctaataaaacgtccttcattttgtctttgtgtgatgtgtccttgtgattagactgagattatgcgttcttggctggaacacggcatgggtgatgtcatgcacttctcagggtgtcacatctggaggcacatgatgtccttctgtccctcttgggtgatgttcgttttggtcacatgactaaggtgttgcccagtttctgtattgtgtaatgaccttccttttcttcccaactaataagcagtccacagggagacactttgggatcatacagatattcagccccttgttaaaattcccccttagatttgacatttgttgatgattcttgcctggttcagtcactatcgtaatgggcaggaaaagatgattttccacgttcaacattctctctgtgtttaaaagtcagcccttggcattctgttgtaagcaagacctttcccttcttctcatttatttatttatctcttattggtgtggactcatggattccaattttctaatggtttatagtgcattactgtatttaattattttggtgcttaaattgtcccagagttggcctgcaggaaccctttcaagctggctgtcatgtgcttgcctggtgattttttgagcagtcacttacactttctggcataacatggtgttctgtgttcatctagtacctcctctgcctgtccttggaattaaccatttctctggctcctgtccatgggcaggggtattagaggccaagatttgggcactggatgtgctcatcgctactgaggtatctttgcagtttggccctttcagtggagaaagctaggaaatctatgtatgtacatatacaaagtgtacatttatatgtgcctacatatacatacatataagcatgcgtacacacacgtattttagaaatcatatgttcataccagtacccccaattccagtgaatttacaggttttttttttcttgtcctctcccatcttagatttgtatgtttcttcttgtacactgagagccctgactcctaacaacgtctactcactgatttgcccaatcttataatgcacctaaaagcttcagaattgcttcacttagagttgtttattgcttaaaaaacagttcaggatgtttttgcaattttccctcccccatgcccaccccaatactttacttatccccatatagaggatatatagctgagcacattaattcctcacttaacatcaaggataggttcttagaaactgtgaccttaagggaaattatgtataaagaaaccaattttaccataggtgagttgatatcaacaggagttaagttcatgtggcatacttctggtcacgaaaacatatctaacttctacataaaggcccaaaatacttctagcattaaacattgaaataaatgtgagctgtacatacacttaagaaagatttatgggccgggcacggtggcttacgcctgtaatcccagcgctttgggaggccgaggtgggcggatcatgaggtcaggagatcgagacgatcctggctaatacggtgaaaccctgtctctactaaaactacaaaaaattaaccaggcggaatggcacgtgcctgtagtcccagctactcgggaggctgaggcaggagaatggcgtgaacccgggaggcggagcttgtggtgagccgagatcacgccactgcactccagcctgggcgatagagtgagactccgtctcaaaaaaaaaaaaaaaaaaaaaaaaaaagaaagatttatgaaaacatgtaagataattacttacccgatttttggtgaattaatgaatgaacagcagtcatggtggtggtgggttaaatcaaggaataaatgtttgcaaagtgaaaaatcataaggagcacctccttcctgcacgaggttcaaaaccaatcacaaatctggtaggcttgttgaatgctttcataccacatcatttattgtcatgcatttgtattatcgtctactttatgaattgttatttgacaatcatttgtattcatttattttccaactcgcatatttccagtttaggatcttgtatgaccagtgcctgggtacttcaggacgccaggtgggagccaactctggacagggcaccatcctgtcacaggacaaactcacacgcccccacactcactcagactgcgcctgtgtggacatgccagggaacttaacatgtacatctctgggatgagggaggaaaccagaatatgtggcaaaaacccatgcagacatggcgagaacatgcagactccacatagacggtggccgggactgggaatcagtttttttctttttatcctcatccatgttataatgcaacaatgttgaatgaaatgatgttattcaaagatctgctgtattgtgtttataagctacttggattaatctgagcatccttcctttccccattcagagtggatttggtattcatttaaaataaatttggattcaggctaggcatggtggctcacacctgtaatcccaccactttgggaggctgagatgggcggatcatttgaaatcaggagtttgagaccagcctggccaacatggtgaaaccccatctctgctaaaaatacaaaaatgaggccaggtgtgctggctcacacctgtaatcccagaactttgggaggccaaggcaggcagatcatttgaggtcaggagttcgagaccaacctgaccaacatggtggagccctgaaaatacaaaaaaattagccaggcatggtgatgtgtacctatagtcccagctattcggggaggctgaggctggagaatcccgttagactgggaggcagaggttgcagtgagccaagatcacgccaccgcactccagcctaggcgatggagtgagactctgtctcaaaaataaataaataaataaaaatacaaaaatgagccgggcatggtggcgtacacctgtaatcctagctactcgggaggctgaggcaggagaattgcttgaacttgggaggcagaagttgtagtgagctgagatcatgccactgcactccagcctgggcaacagagtgagactctgtctcaaaaaaaagaagaagaagaagaagaagaaatttggattcttttttaaaatttccagtttaggcttcttctttctcattctcattgatttaattttcattttaaaaatgcatggaatattagcaaactgaagtatccttcctcccttccacttaattcctgtcatctcttatagataaccaacttgattgtgtactgaagaagtctccttcctgtgtttctttctgtaaaaataagcagatttgtgtatgttttcttcttttcctttcttacatacagggtagcatatgtgttccttccacttagcaatgtctccggaaattactccatatcatttctcagatcttcttcattccttttcacagctgtgctgtgtgtatgtaccatagttgattccatcggtctgttatgcctgggcatttaggtagtttccagtattttgcaattacaaagaatactacagtaaatatccttgtgcatgtgcagttgcatacttccagaggtgtgtcttgcggagaaagacctacaagtgggctgctaggttgtagagtataacggtgatttaaactttccttttaagctgtatttaagtgaaaaaaaagtaatagttcaaataaaatgaaaaatagtacaggtaacacagagacgtgacagaaatcataaaagcaagcaaattaaactattgcttcagtcccttcaaactccaaatagtatcataactgaggttcagtcagagccccctggaaatccagcctcagtgcctcagtcccggccttggggaccataggtggaactctgtatccacatagcctactgagctgctttccttggtggcagcagtgtggcgcccgcaccttgggagggaggctggccagtgacaacagggacaattggagttggggcccggagtggcacagaaccgtgccaacttcaggtgtagcactatgaggaggttccctgtgaccctgatcatcaggggaggtcaagtcctctttgatgtcctcttctaaagatgatactcactttagagcagtgagaatctggggagccctttcccccaaaaacctgctaccaactggtcccatgcccacatagcactttgcatagagcttcagggaattggcagacctataagggttgtttcagtacctataagggttgtttggataaaactatcaaaaagaagagcaagaaacctttccttgacatttgaagatctgatccgcattcatctagaaaattaagtggagccactcactctacagctgtgctagctggatgaggactgtgaggtgcagctgtgcgcacaggtgtcacagccagggtgtggaaatcccattttgtgtggagaggcccatgtgggtctggttctgcgtcaagatgtgacacgggggttgggggtgaggaagggggagcggtcctggctttgctgctgcatttccagctgtgttaagaatcactgcacttgtgggtttctgtgcactcatactcaatatccagggttggaccagacggtggttttcaagcagttttgtgtgaagccgtagaattccagaaaggggcctcatggagtgcacgagggagcccacggcagtcagaggcatttgatgcccaccaccctttcctggagcagctctgcgctcatctgctgactgtggtgggatgccctggaaaattgtcctgcaaattagtattcagctgcttaaaaaaaaagttggatgagcttggtgctgaattgtcttcaccctcttctctgctccggaattctgctggtgtccaacgagattaagccagaaaggggacaactacgtcacaaagcttggcctccaggccagggtgctggggcttggccctgtaaccttaggaagtacttggagctgagttcccactgtgtcaaccaagcagggcagagctgagcctggggaaggagaacttgcagctgtaggggaggtgggcctatgccacgtcctctgcctcatggggcagaggccagaggctgggagacgaggaggaggctagcctcacaggcttgcttgggagtcttcagatgtctgatggcaagccttgttagtaaacacaagcaaacctatacatatgacatttaagcatacatctcccaaatatgtgtaaaaatttatgtattataaattatatataatatgatcatgctagtattatggacagtataaaacaaaatagattttaaaagatgagaagcgttaaaagacctactgcctagggaatcatcttgcatgcccactgaggtccatacccactttggagatggccaaggtagttggaggacactaggtgcctgaaggaggctggtgaaggtgaaaatggcagaagggaaagagaattatgtttccccgacagcagtctgcaccacgttcgaactcttttttttctttttttttcttttttttttttgaaacagagtctcactctgtcacccaggctggagtgcagtggcccaatcttggctcactgcaacccccaccccctgggttcaagcgattctcatgcctcagcctccccagtagttgggattacaggcgcccgccaccacacccagctaatgtttgtgataggtttcaccatgttggccaggctgatctcaaactcttgacctcaagggatcctcttgcctcagcctcccaaaatgctaggattacaggcatgagcctccacgcccagcccacattccagctcttggccatatctgtgtactgtttgctctgctgtttactggatagctttctttgaattgactcacttgtttttttcccaaaatttagccttattctaagcactaatatccacagaaggctttctgtgcagctagaattttcttccaatgcacaatgaaataagtacaaaactatgcaaacaaagcatttgtccacacaccacttagaaagcactgttggctcccacctgtgtgatggggcccgccctgtgggagactctgatctttgacatctgacttcagatcagatgggagggaagggggatggtgagagtgaacctcacatagggccggggcccatgtgaatatcggggcgggggggggggtgctcctccatgccaaggggtgcctgcaggtacagtcatgcctaacagtctggggagagtctcttggggcatgagatatctccccacgagaacactttgtgaccacattgatcacagactttgtcggggagtggcccaccccgcctcagatcacagctaccatgaatcattgccactcgggcccgctgccaaaacatctcgtgttgggctagaccagtcgctcatttatcacttcaagagatacttattgtgtgcctactctgtgccagacactggattagacagtggagaacaagacacataagacagctacaaaacccctgttctagtggaggaaggcagacagtaaagaagcagaacaatagagaatgtaagagccaagtcacaatgaatgctattattattaagtaaaatcaagataagggggaggaaggacaaatctcctctacagaagaatgccaaataatttatggagatacgcgaagacgtttcagaacctaatgtcccattctctaagtgtggcctgtgtttactgactttcttccacagagtatggtatggaaggaggaggaaaagtgacttcacagtggcgaaagctgatgaacattagcttggccaagtattggagattaacatcaacagttataagtcatattgatagtatgtgccctgataggatgtgatgagaagggtacttcccctctgtggtcctcctcctcaaaacctgtaaccccagtctaaatagcagaaagacattgcacaaacccagagtgagggactctcaagaatgcctgaccagtactcctcaaaatgtccaggtcatcacaagcaaggacagtctgagaaacgtcacatccagaggaacctaagaatgaggactcaatgtaaaagggatcctggaacagaaaaaagacattgggaaaaactaatgaaatctgcccaaagtgtagagtttagtttagttaataacaatttttaaagaggtattaaaaaaaaaaaaaaaaaggcaggtgaaggccggtgtggtggctcacgcctataatcccagcactttgggaggccaaggtgggaggatcatttgagctcagaagtttgagaccagcctgggcaacatagtgagaccccatctctacaaatactaaaaaattagccgggtgtgctggcatgtacctgtgttcctagctactcgggagcccaggtggtcaaggctacagtgagccatgatcacaccactgcactctaggctgggtgtcagagcaagaccctgtctcaaaaaagaaaaaaaaaaaaaaaacaggtgaagagggcgtccaggaagatgtctccgtggaggcgacatgtgaactgagccttgaatgatgcaccccagtcacacctggctaggagagacctggtgtgagagccttccaggcagaggaaattactgtgtaaagatccttggatagaaacaagcttgggccaggcgcggtagctcacgcctgtaatcccagcactttgggaggccgagacaggcagatcatgaggtcaggagatggagaccatcctggccaacacggtgaaaccctgtctgtaataaaaatacaaaagattagctgggtgtggtggcgggtgcctgtagtcccagctactcaggaggctgaggcaggagaatggtgtgaacctgggaggcggagcttgcagtgagccgagatcatgctactgcactccagcctgggcgacagagcgagactccatctcaaaaaaaaaaaaaaaaatggagacaagcttgggatgttcaagagatagtgagaagcccagcacagctggagcagcatgagccagccaggcagggatggccaggaggtaaggtcagaggtggactggggccaggccgtgtgtttggatttcatcttgagagtgatgagtaggcactgggagttttgaacagaggagtgacatgagctaatttcattaaaatcacttgggtttgtgtggagaatacattagggtggcagaagaggtggcagacgtccctgcatgagccggggggagggagaccatggcagaggcggtgtctgagcccaaggtatgtgttcacatccctctggaaacagaagtgcaggttcacattttgtcatctcttttaaccccctgtatgtctcccgaaggtggggaaaaagatgtgaactctgagttccaaaggctgactgtttgaaagtccacgcccgcacagccaagaactctgatggggacaccataaagcccaaccctcatccatctttaattcaagatgttttctttggtggttcataactttttctgaaaaataaaaatgcacaccatgcttaagctgattgctacaggttacccttgtttaatggggagaaaaaatgaggttcctaatctctctctgccttctggaagttgtaagtaaaaaaggaaaacaaaaggcttcagtcacatcagagctttctattaaaaatgtaagcagctttaggccagacatggtggctgacgcctgtaatcccaacactttgggaggccgaggtgggtggatcacctgaggtcaggaattcgagaccagcctggccaacatggcgaaactctgtctctacgaaaaatacaaaaattagctgggtgtggtggcaagcgcctgtaatcccagctactcaggaggctgagacaggacaatcacttgaaccctggaggcggaggtagcagtgagctgagattgcgccactgccctccagcctgggtgacaagagcgagactctgtctcaaaaaaaaaaaaaaaaaaaatgtaaggagctttagaatgttgtcagtgaggttgattatgtttatcaaccacatgtcatatcttctcagctgcctgaaatcctttgggaaggaaatgtggtatcaataaagtaaaaaagacgattttaaactctcgaaatagaataaatgattgcaatttgtgttttgttgtcaaagacaggaacacgtttcttggtgttgctgtgatgaatggaaagagaggctctggcctctgtcttatttccaccccagtgtgtctctggtgttcaggtcgctgctgtcggacatgtgcttgatgtgtttggagtcatttatgcatatttattctccaacatgagcatgtgtataaatctagggctgaaaagctgtctggactcatcccagtctccattttggcttccagagatcgagatggtgatcatggagcgtagcaagctctcagagctggccgccagcacctccgtgcaggagcagaacaccacggacgaggagaaaagcgccgccgccacctgctctgagagcacgcaatggagcaggtagctgcccgagaggtcgatgctgagtgctctctcagggaagaggagagggctcagtggggaggttgagccctagggccagagcctcttctgtccctcagcccgaccatgctgcctccctttctttccctgcttctccagctctggccacccagaagcatggagacggagccatcactcaacactgtaatgctcactcctttgcaaagagattcgccaggatagcgcaactctctccctgccctgctcctggcactttggagcttggctctgtctaaaggacatgggttgcttcacattggctgctcctagaaatgctctgctgctccaaggaaggatcccctcagtagctgggcttggatctccctgcctggttcattccctgccctgcacacacaaacacataccccatctatagggcctgccctcttgacttggccacatgagttggtgctgccatccacctttgactttttgcctgattgttcatttcatcgatggccatctgtagctacatcttcttaaacctgggtgaccccacatttcctggaaccttgccatagcaccagcccctccacaatgggattggagggaaggctactcccagcgtatgctggtagctggtagcagggcttcatttcagagttatttccttacctcgcagccccactgcacagacccctgcaacagcctcctgattagcactaccttcctgttcataaatgcaccacaccaggatttctctgtcagcctgcgaggcattcacttcctcagcccctagggaggggtggtggaaatacacacggccccccatcctctttagtaatccaacttcaagtgaagatgtgaagtccactaatttttttcctccacatcttatttgtctctttgcttggcaaatgtttcaatgacttaacagatgggattaatttttatcagatgtgcaagggagccatttttagtttttgctaaataaaaaaacagtggagtacaaagaccttttagattttgcttcacagcaaaaaatgtaactcccaaagctctgaaaaataagtaattctaaacacagacggttggggacaaccttggcacagcattctttagactataaataattagaagagccccaaataaccagtagtgggatgttgcttaagcaaaggaagaggtatctgcttaatggaggattaggccaggcatggttgttcacacctgaaatcctagcgctttgggaggccaaggggggaggatcacttgaacccaggagtttgtgactggcctagtcacatagtgagaccccatctttacgaaaatattaaaaaattagccgggcatggtggcaggtgcctgtagtcccggctacttgagaggctgaggtgggagattgcttgagccagagaggtcaaggctgcaatgcactatgattgcaccactgcactccagcctgggcaacagaatgagactctcgctcagaatatctgctgctgcttttaggtgaatactgtcatgatgtgttcagttccttagggtttgataaatggaaacagagaacatacttttcgtagtatggtaatactgtggctttgctaatggaagagaaacacccatgtatttctcccgccaccaaaaaaagggttaaaaaaacagaccaaaatgttatgtttgaatattggggttgatgacttctttttttctgaattttggtggagagaagggttttcttagagttgattgagattgtttcttaactttgggcatcttgaagcacatggcttctaatggaagctgattcagttgccttgagttaggccgcatgcagtcctgggaacctccaggccagatttctgctagactgtgagactgaatgccgggttagagactggcccaggtggagagcagctttctcctttgtcaaggtatcgagttgcagcttgtaagaaactgccactgccctctgtccccccaacttgagcagttgggactacaggccagagtcaccatgtctggctaccttttttttttttttttttttttttgcaaagacaggatcctactatgttgctcaggctagtctggaactcctggcctcaagtgatcctccaatcctcctgcctcagccttcctgaggcagggagtgggaaggaaggtggctgtttgttctctaggctgtgaattggatcttggcgttggtccacttgccccaagaaacagcaaggtaaaaaacagactgtttttatattccccatatattatgggctctgtctgcactgggggttaaatataggcctaagaggccgggtgcagtggctcatgcctgtaatcgcagcactttgggaggccaaggtgggcagatcatgaggtcaggagatcgagaccatcctggctaacacggtgaaaccccgtctctactaaaaatacaaaaaattagctgggcgtggtggcgagcgcttgtggtcccagctactcaggaggctgaggcaggagaatggcgtgaacccgggaggcagagcttgcagtgagccgagatcacaccactgcactccagcctgggcaacagagcgagattccatctcaaaaatatatatatatatatatatatgtatatataggcctaagaaacttaaagctttcgaaacatcgtttcttttcttaaaaaaaaaagtttaaaattatgaaagtatgcaaaatcttaaaaagcataaagggggaaaaagtcttcactgctaacattcagaatcagggggactaccattttggttattttttttaccagtttttttttttttttttccgatgtgaactttctgggaatttcaccctcccttctcccagaagcttggaccgtattgtgtctataattttgtattctttttttccatctaatatcaactcccaagcaaacttttcaccttattctaccctgcgtaaacaaaacgcttaatggttttatgatacttcatctcataaaagatggtacccacccagctattggcatttggttattcatattattcccaaatgaaaatataatccaaatttcaagcagctgatttacaagaaaatgttatcctactcctaagtctggaagtgttattgctggaggctttcaaaacccaaatctacacatggcaaaactattaacacatctgaaaggtggtgccccatctggggctgtggagaaatggggatggaacataaatgtcccctttaagattttcattttttttttttagtttttgtgtgtcacgtgtgtgtttgaaatgttatgacaagtacatttttcctactttttttttttgcatttttcaatgaaatattttgtatcagagatacatgtatagagtcaaaaattcaaaactgtgtcaaaggttatatagtgaacactccctgtttctccccagtcccctttcactccccgtaggcatccaatgttcattggagcttgggtgtccttccagaaattaaatgtgcccttggtcactcatgaaggtgctctgttctcttggcctcagcctggcattcagagggggcagccacagacagtgggaggatcagagcctctggcctgtgggccagacctgtgcatattctattctcctggtgttgaagagtatttttctgtgaggcccttcacctggaaaggcagcatttgggatgtgccatttccgatttttgcagcctctctacagatctcacccacaaagcatcagaggtgagagacctcactatcgattcttcgcagtcagagaaagtcagcctgagaaattgctgggtcaggaccctgccaaagtgaaatcatgaagtagtgcccttggtatattaaaaatagaaatcaaatagcagctcccatgcattggcaccgtccacagtgcctgaccctgtgctaaatgcttttcagtcttcattgcgcttgaatcctcacaataatcctgcaaggttggactccaccccatacagatggggaaataggttttatgtgacttgcccaagggtttgctgaataaaaagctaagaagaggcagaatcagaatttgaacccagacagtctggcactagggctcatgttcttgaacttgtttggattgttgtttgtgccttgtgtgacatcacactgtcctgttttcttcattggcttgtgacacacatcactttgcattgatgtctgtttgttctgtgtctaccagctgacacgggagctttggtgtggggagtttgtataattgattccctgtgtctggaatacctggtgaatgattgttgtgtgactaagcaagcagtctgttccttggtcaggttcccctctggatagcggcttccgcaggcagagcctgtctctcatttgtctgtgtcctcagtgcgtggtgctggaccaggcacacagttgtggcctaaagagctgtgtcaaaggcagctagcaccccatgtgcaggttagagaggggaggtgttcacccttgtgcaccgtgaggctcatacatgcccctcctcttttccagacccttcctggatatggtgtaccacgcgctggacagcccggatgatgattaccatgccctgttcgtgctctgcctcctctatgccatgtctcataataaaggtaagcacccttgccttgcctgacttccttgctgggccctgcatacccatagcatccttcccctctgctgcatggaggacaaagaaaggtgctttctgtacagaatttcctttctggttttggtggtcctttttggttttgactcccgctcctctttagcttctttagaatttctcaggtgtttttctaccaactgaagccacaggaattggttactcaggcaatatggaggaaggtgacttgagtgcctaacccaggatgactatattcaccctgtggttttcttttgaccccttgatttacaactgacttagcgtctgacctctttcctaacatcagaactgaaatcagtcaaattgtaatcttggttttgctatttataacacttggtgttcttattctgtgttcagagctgaaatagaccctgggtggacttggtggaagcataggtttcctttctgaagaaaggtgtggttctctggcttcccctattaaggctacttggccaggatccaactcccatggggttgacaggttttgttgggattcattcattcaccgccttgctgccgacccctgggaatagttactgttgtttgccccacctggcttgacatgggcacgttctgaaacctccacatcagaatctcttcaaagaagaattcaggaatattccttctaacccctgccaagagctaggcttggcatagtaaaaaaaatcaagtgatattttagtaggttttttataagcttattggggagtagatagagttgggttttactaagacagcctatggctagaggcattagaacatacatgatataactaagtttatgtgttcttaaatcattaatcatgataaataagttgattagtggcagaagggtatatagggaaaaagtttcccacctttgaccccagctctcctcttcaaaggcagttcctgctaccggtttctcttgtgtctttttaaagatagccaaacaaacccaagtaggagtatatatggttttatttgtatgactgcccacttagctgtaaatggagatacccatattgtgctttctaccttgctctgctcacatcatcatatttcagcacatgggttcacatccatagagaactgccattcttttttatcaatgtgtgagcaaatcatagatattaaggatttttgcatctatgttcatgactgatactggtctgtagtcttcttgtaattctcttgtctggttttgctatcagggttatgctcacctaatagaatgaattgagaaatattatcttctccttgattttctggaggaatttttgtagtattatttcttccataaatattccttaaaccagtgaagccatctgaatatggagttgtctttggtggaaggtttttaaccactcaatttcttcagtaggcatagggctttttaaggttacgtatttcttcttgagtgagctttggtaacctgtgtcttttaaggaatttgtcatttcatctgaactgtcaaatttattggcataaactttatgtttttcctttattatctttttaatgtctgtaggatctgtagtgatgttccctctctgattgatggtattgataatttaggtcttcattttttttcctaatcattttggctagaggattattaattttattgctaccctctattgttctgctgtttttgattttgttgatttctgttcttatgtttgtttggggttttttttttttttttttgccttctgctgcttccaatttaatttactttttgttttataacttcttataaagaagctttaggcattgtgggaagcactttattgtccacagccaagctgcttgtgatgaaactgtaacttacaagaaaagggctgggttttaaaaatgacacaggctctaaaaaccctggaagcggtgcaacttttggcaggaatgggggttagcaggacctcaatggctcactatggctaagtgaacgctgactgggtcctccagcgtgagctagaacagacgtctctatggtcaagtaaacagcgcgcgtgctgtctttcccatgtggtggggttgcgcatgatcagtagctgcaccactagaaagatggcggaggaagagcaaagaaaaatccctttggttccagaaaatctcctgaaaaagaggaaggcttatcaggcactcaaagccacccaggcaaagcaggaacttttggcaaagaaggagcagaagaaaggaaaagggctcaggtttaagctactggaatcattcctacatgattactggcagcagaaacctgacaaggtgcatctcagacgactagaagtgaaacctcatgccgtggaattgccagataaacattccttggcctttgttgtacgcatcgaaaggattgatggcgtgagtttactggtgcagagaaccattgcaagactttgcctaaagaaaatttttagtggtgtctttgtaaaagtcaccccccagaatctacaaatgctgcgtatagtggaaacttatgtgacctggggatttccaaatctgaagtctgtccgagaactcattttgaaacgtggacaagccaaggtcaagagtaagaccatccctctgacagacaacacagtgattgaggagcacctggggaagtttggcatcatttgcttggaagacctcattcatgaaattgcattcccagggaagcatttccaggagatctcatggttcttgcgccctttccacctctcagtggcccatcatgctaccaaaaatagagtgggcttcctcaaggagatgggcacacttggctatcggggtgaacgcatcaatcagctcatccgccagctgaactagacccaggtgccaaactgcagtatatttttgatcaatgaagtggaagcatgtgttttgttgttttgggaatttttatcaagtgtcttcagagaagattatttcctgctctgtcttcaaaaactggaaaggaagggtcaaagaaaagacagtagctggctgggcgttgtggctcacgcccgtaatcccaacactttgggaggctgaggtgggcagatcacttgaggttgggagttcgagaccagcctgaccaacatggagaaatgccatctctactaaaaataaaaaattagccgggcatggtggcgcatgcctgtaatcccagctactcaggaggctgaggcaggagaatcgctcaaacgtgggaggcggaagttgcagtgagctgagatcacgccattgcactccagcctgggcaacgagcgaaactctgtctcaacaaaaagaaaagacagtagcttatgttcatgtcaagcacctctcatcagagtctagttccaaggaaaaattccagtgttttctacattgggtgctgcgtcgtctgaaatcggcacattccatggaggaaggagtcctgctttgttgcatctatcctagggtttaatgttggtaaatgagtcactctagcatttgtacaaggctccctaagactcctgcagcagtcgaccaagcccaaggacataattgaatctggagagtcctggagccttgttttgaaaaagacttgaaatacacataggaagaaaggcataaaaataaaggttcacttgtctctgctgtggaaaaaaaaaaaaaaagaagctctaattattgattttaatcatcgtaggaagctttgatcattgattttttaagcaaatcagcttatttttttaaactaacgtaccataaaattaactcatttttgtatttaattctgtgaattttgggacatgtatggataggtgtgaacaccacttaatcaggagatagtacagtttcattatcagaaaaatatccctcaggctattccctttccagtcattgatttttaaacctttcttctctatgactttaatgctataaatttccctgtaagcactgctttacctgcatccagtaaattttaacatatgaggttcattcagcttaaaattttacacagtttcccttttgatttcttgtgttttgtcatgtgtataatttctagctgtgtttctcttattgatttttctcctgcttttggattccttcccccattttttgcatgcctggtcatttttgattggttgacagttactgtggtttttcacagttggatgctggattcttcctgtaaatatttttgggctgatggttcagttaattggagttggtttgatccttttttgaggcttgcttttaagctctgtgagagctggtccagacagccttcagtttagggctaacttcgccctattactgagacattacccttctgagactctactgtgtcccatggtgaggtggtctctccacactggcccccccagtgtgagctccaggaattgttccacaggcttcattctggcaggtctttccctttcttcatgtgcatgcacagaccagaacacagcaaggttctaaaggaaccctctgcacatgtctgagctctctctctgcagctctctcttcatttatcttgtccatgaattttaaccccttgatctccctgaactccagactctgccttctctgagagaaccacagtctttgggttttctatccctttgctgaggcccggatactctcactggacagcaagctggagcaatcactgggccactgcctttgtgcttctccctctcagggatctctctcttatgctgcctgttcatccagagtctgataaccattgttttgtatatattgtcttgctttctaagttgcctgaattagtaggataaattcagtccatcttggccagaagcatagcacctttaaagaaaaagttggattgaagtctaattgatatgcaataaactgaacatatttaaggtgcacaatttaatattttgacatatgtaaatacccgtgaaatcatcaccatgatcaaggcagtgtataatccagcatcccaaacatttcctcattcccctcccttgcttcccacacccctctccccaagtaacaccagtctgcttcctgtcatgctagattagttttgcactttctaaaattttgtataaacagagtcatgcaacatgtactcctcttcatgtggcttctttcaatccacttaattattttgagatccatcatgatgttgtgtgtatctgtagttcatttcttcttgctgagtaacattccattatatgaacataccacagtttattcattcatctgttaatggaaatttgggttgtttccagttttggactattacaaacaaagctgctgtgagcatttgtgtggccccatacaatgtatgcccatacagagagttgtatgagcatatacattcttttctcttggataaatacctaggaatggaatggctgaatcatatttcccatataattatgggagatatgtgtatgtttgcttttattttaagatactgccaaactgttttccaagatgcctatataattttatatcccatcaccagtgtacaagagttctagttcctttacctcctttccaacatttggtgtggccacctttttagttttcaccattctaataggtttgcagtggtatcttatgatcttaatttgcatatccctaatgacattgaacatcttttcatgtgtttcttttgccatacatgtctttgttagtgaagagtcttttcgaatccttagcccgttttttaaattgaattgagtaaaaaaaatattgtgtttcgagacttttgggtttttttgttttgtttcttttaagacggagtctcactctgttgcccaggccagaatgcaatggtgcaatcttggctcgctgcaacctccgcctcccaggttcaagcaattctcctgcctcagcctccagagtagctgggactacaggtgtgcgccaccacgcccggctgatttttgtatttttagtagtgacagggtttcgccctgttggccaggctggtctcgaactcctgacctcaagtgatacacccgcctcagcctcgagagttctttatgtattttgaatgcaagtcctttatcagaggcatttagcaatgatttcccccaagtctgtggcatgtcttttcattttcataacaacatcttgggaagaccagatgttttttaatctccatgaggttcctgtggcactttttaataccgccttttctctgtattttttctctcccattctggactgctaggccttggaaggcagaaaccatgtgctccctgcagtacccagcctaccgcctggcactcagtcagtgctcagccagagtttgctgattggttgctgctcagctatgtggcacgtccccaaggccatctcttcctggcagcttgtagctcagggcttcagcaaagaaggtgctgtctgtgtggtgtagatgccaggctccatgggacagtgggcaagctcctcatcttggtgactggtgttctccatgggcttccttcctgcagccctgacctgtacggggagcagagacgtcatggcttactgggtgtgctgccatgcaccttcatccatcttatgcgctggagagaccactcacctgtgttcccgcctgggcatcctacctctttttcttgggaatttcttcttggaagagtagaactgtatattcaaggaaattgaattccttctcccattttctgctaatgctatgcatgtattgattcattcattcttccaacaaatattttggaagcccctgttagatgccaggcactgggatcagtattggggatgcagtggtgaagcaaacaaatgctttcatggaatctggattctcttagaggagacagacagtaaactagtaaccaagtaaaataatcccatgtagcgagaagtgcaacagtgaaaataaaactaggtaatgcggtggggcaggctgagggtagagggtactacatccgcctgagcaatcaggagaggcctcttggaggcttaagtgatcaggaggaatagcttgcagtttctgatgaatttcctcatgtaattagttattcagcaaatgcatgtggagcaccggccgtgtgccaggcagtgtgctcaacatggggactacaaactccaggcagaccaacccaggcccttgcccaagaaagcatcagtcattcttggacagaaaagtcctacgaggaggctgtcagcacaatagagggtcacttgcctggtggtgagcatggactctgcccgcaggagtgaggacccgtttcctgaggacacccgggctatggtagaggacagagcaagaaggggcatgagagcctgtggcatatccatcagatcactgcccgttccctagggtgagtggcagcatgtccgaggcagcgggtgccccaagaggcaggcatctggagccagtctgcagggggtggcacaggcagcgactgaactgtgttcctatgagccgtgtggggctgctggggggcagttggtcagttagtgagctgacccactctgcacctctcagaatgggtttgcagtaattcagccagcgggtgggagggatgagaggtgaaactgagaggctttcttatcattcagcagatacttgctgagcgcttgccagggcaaggccccgtcataggcactcaaacaagcccagatgagtctcactgaagtgaacaagaagattaattgtgactgtgacaaatggtagaaggaaatgaacagggtggagtgatgaggaagcctagtggttgtgctgcaggggttactaggtgctagtcagggtggtcggggagggctcctctgaggaaggaccagcagagccacagcccagagagtgagaaggagccagctctgcaaagacctggggcaagagtcctccaggtgaagggagcagcatgtacagaggccccggggtgggaaggagcagaaagtgggccaaggtgaggctggccaggcgggcaggggccaggtcatgaagggccttgaaggccctgaagaggaattgccattttttctccaagtgcaatgggaaacccctaccgaatttttaagtaggacagtgatgtggtcagatggaagtttttaaaagaaacgttggctaccagacagaaagtagatgactgggggtggggatgagttgcaggagggaacaccgagagacttgctaagaagctgttgcagtcatccaggcgagataatgtggattggattaggctgctggctggggagtagaggaaactggaaggacttgtgattatttcagcgctagagccaggacgtgctgatggattgaatgtaggggtcgagtgaaagggacgagtcagatgactcctgtgatttggcttgagcaatggtgggggtgcatttactaggatgaggagacaaggagagtcactaggctaggggtgaggggttctggttgatttgaaaggagggggcatgaagggaggagcctgggtaaggctcaggttcctgactcctttccctgtgtgaccaatagtgccatttccagaactaacaagcatgggccttggagtaggtttggagaagaaacggaaaagttcaagtccggtgccctgaggcccaggtgcctggggaagctgcctcgtgggggagctgccacctggtttatgctcagtcctggcctgtgagcacagagtctgcatttggtggggctttgctggtggaggttggttgagtgattggtttttggttatgcagcagctgatcaggctgcacttgaccttcagcctcacttttccagatccttaccccccaaatcaggtcccaagtgacctggtctctttctcatagattttttcctcatagtcaattttaacataaaagccacgttcataaaaaccaaatgtgagctcaggccttccagtaatcataatagattagatgctgcaccgaaatgaatatcccacagtggaaagggttgaccggttggcggaaggcgcttgttgtgattcagttgggccacataatgaattctggtttgtttctgtaatagaaaatgcagccttcgctcttctatcaagtccgctgagtcctgggccagaggtggagggatgggggtgagttttacagcttttgtatcttgaaggttccccagttcagtgaccaaccttctactcctgccactccatttgtcattgtttacccaggaagaaggagtcttgggctctttgtgttttgtgttttgttttgctgagaagttaatggaacatggatgagcgatatggaaaaggttgaaaggtaataggctaaagggaagcttttgccatgcggagaacttgcacaacgtcagtttggatcttggctgacacataaccagaattagaagtacattggaaatcggcccaacatctggttagctttcgaaatctttggtctatagtcttccaaagctggtaatacttgtgtgactgcagccaaggagactttgtgtggtcaacagacgtttttaaaaagtttgaactgtttacctggtgttctcgtggtgtctttatccagatctgtctaattattcttatgcatctttggtctgggtcttttacctctctaccctaaatgggggctactactaagggggaagaatccagatatcagaactgagagggaagcttagtaagagttactgacactgtggggccacacccttcccttctgttttggattctttgaatgagttagttgagagttccgccctccacccctgtccacgggtggacaggggacacccgttctgagtcggtgggcagctcaggctctgacccctaaggcagggctgtgggcggggcagggaacatgtggtctgctggaagccagaatgagctagtgctcccgtgaagtgcagcagggtttctttggaatttgtctgtcacaaagcacttaagagttgaagcaaataggataatatattatccacagtgtttatttctgtcagagggaaatgactggcaaagaagctattgggtttgcagcaaaacctgcctttctgtgaccaaaaaccacggggtatgcatgcgtgtgtgaatgagtgtctgtgtgtgtatgagtgtgtgtgtgtgtttgtgtgtatgtccttgcacacaggagccgtcttacctttcacatgcatgcccctgttacagggtgacattgaccttagccactcagaaccatcagccaccaggttgtttcaggcaggaggcttaaacctaaatctaatgttcgccacaaattaaatgccatcctaagtacagtgatggtcatgcaatgattgttatagaaaacaaaaatgagaataagttgctttttcacttgcctttgatagtaccaccttaaaataaccaactgctgacagtgtcgtatttctttctagcatgttttctgtgtgggtgatggttgggcttttttgcacagctgtcatatggtggcttctattttacgtatgtttccccttcattttgagatttgtctaatcttctgcccgaaatttgatcaaaactacttaactttttaaaaaattaattcagcaaaaatgtatggactgttgtgtttgtgccaagaacaccactagatcacatgacatacatagcttgggaaggtggagggaaagagcgttaaccagcggggatcatggtacacggcagagaggagggaggtaagagccacatggctgcattcagggctgggctttccactctccacatgaccccaggcaagctcatgtcttttttgagcctcagcttcctcgtctataaaatggaaatactattagccacttcatggaatgtcatgaggatgaaatgaagcattctacgtcatatgcctggctgatggtcaccatttcttcagagcttaccatgcgaaggcaatcttgtcatcttagcagaatcctctcctccttccttccaaagacactctgtccttccccagagagactggtgattttgttgttgtttgtttgttttgactgagtattttggtaaatgataaggcctccttcaaaacactggatagttggagtcaaagagaggattttaaaggccatggtgggaaaaagagctgggagagagaatggggcccctggcccagaaggagctttggggaaagaagggagatgttcagaggggtttctgttatatagttttgccgtgtgctgtgtggaatcacctctgctctctgcctcccagggctggtggtaaaatctacctcacatggactgcatggcactagcaggtcagtttggggtaaagggccggaagcatggagaccacttggaacagtcaggggaatggaaccaccccagtcagccagggcacaaccagattatgttacggcccgctagctgcctctcctgggcccctccactgcatcaccctccaggatcctggcacgaagccttgcctgtcccttcccccatcctccacctcatcaccccctccccggctctctcccacccagacctctctgggtctgctccactccctgcagtcccaccttggtttggcaagtcctggccctccctgtccagttcaaggcaaactcctgttcatcctttaggatccaacctgagcagctcgccccctgagaggggcccccagcagctcagcatgcctcttttgggctgtctgtagcttgatttagctcttgttaggttttatccttgtgttcttttgttctaattttccttttttttttttttttttttttgagacaagagtctcgctctgtcacccaggctggactgcagtggcgcagtctcagcccactgcaacctccgcctcctgggttcaagcaattctcatttctgagcctctcaagtagctggtactacaggcatgtgcactacacccagctaatttttgtatttttagtagagacggggtttcaccacattggccaggctgatctcaaactcctgacctcaggcgatctgcccaccttggcctcccaaagtgctggtattaaaaacatgagccaccgtgcccggcctaactttccttttataacacgaatgataaggaaacacatgaagtcatgctcaaactaaaaattctcatccatgcattaagcagtgctcaaactaaaaattcccatttgtgcataataatgagagataaagttgttggcctgtgacagtgctttttctctttcgatcctgacagcagtcgtggggcgggtagttaccataattattcccacttcacaggtgaggaaactgaggttcaaagaggtaaagtatcaaaacaaagttcctcccgcaccccaccgctaggcttctcattcctgctgtacccagctgtccccctaagagagggtgagcccagggacacagaggggtggcttttgtcagcccaagaggacgggccccctgtgtgctcctggtgggctggctgtgtgggtgctgccaccctttcccatttggaccccacccaccttcgggatcacctgaaagtggtttgagctgtgtctctgacttgctctgtgaccttggggaaacaacataacaactctgggccttaacttcctcatgaaaggaaaaggctggacttggaacctggtacagagagaagtgtttctatcctctgggaccttcccttcacggagagttgagaaaagtcgagatcatcttgggacgcttttcttcctgtcaagaaaagagcttgccccagatttcctcactgtccacaaattctaaggagacggaggggcaatgataggaaagaaacaaaatggacctctctctggaaattcaaggcctggtcctagtttgcctctttccatggttctgtggccactgccccattctagaaggagcgagcagccaggccctttctgctatcctctctgaagcggagtgactgctgatgggttataaagttgggcaatgcacctgggacacagaggagcttttattccccacccccacccccacccccacccccagaaccactgactggcagttctcaaagggccagaaattaacgagtagagagatgttaggacagtgttaacatctctggaaaaaacaaatgccagaaagattcagttgacattcttcttgccattcaataagccagaatccttcagagttacacatttagcattaacatgggatacagaagccacaaattaaattttcactgcaatgaaattttttgaggaaacccacatttgtggggcgttttggggcatgagagagactactaccctactcaagtctttaggccgtccctcacccaggtcatctccttggtatgacttagcctctttctgggagctggaaggaattcagaaaagcaagatatattgttacttcttattacatcaatgtgcatgtgcaggagttacttagaatccagacaatcatctcttcaatgctatcttccactattttgtcaaggttctaaatgaagcgtcatctggtactcaagggaccgtattttaagagttccgagaagtgccacctttcccccttttgtagagtaacaggaaaagacgtggtacaagcgcaaataatccattcagttctccaagcttggatcaagcaaaatatttgtttctgtaagtgtatttttgaagagccacgtcagttgagcagataaggagtttgaagacctcttactccaggcaggaactgttctagtagccctaacaggtcttctgtcactgcaggtcctgtgtgcttctttaggagaaatgacaacagggctcaaagtcacacacttgcctgttcttctttcctttcccacttaccttccccacccccatctaatattttatctttcaaatgctgttagttttggcaggaagaattgttgaattttcactggaggaaaaatgattcccttgcctcttaatgatagatctctgctgtattggtgtcattgtattaggttggcacaaaagtaattgcggtgttccaattgcttttaatggcaaaaactgcaattacttttgtgccaacctaatatgtgcacctttctgtaagaaaggcttagcttagtgtctttctgctaatgtcaccctcaggggcaggcgtggcctctgcctcacctggctcacaacttgattcctcctacatgtgttgagggtggggctcagcttttgagtttgtcattaaaagcttgagggcacaattgttggggatgactgtatttccttcgtgtctagtctctctttctctaggcctggatttcctcaagcgtagaaggtgcgtaatacgggagtggcctcaggtggccctcagacctggcacacagtggcagtgagttgtgctatgggatggtgtcccctttttctactcccttccctgtgtctaggagaatgccaccatttggggctagcttctctccaacactattaagtacctgccaacctccctttttaacaaagatcaggtcttgggccaccatgagtaggcagtcaaaagtcattggctagcatgcaaaaacattttttgatttttaaaatattattactggcaattattgcatcaatcctgatttcctatttataagaaatagaaaatgtatgttttaatacatttatgtaagttcagtttatggagagctctgcgataagttatggcaccaacagcaaccagtcatgacagcagttgccaagaggggacaggcgcagtggctcacaacagtaatcccagcaatttgggaggcccagcacttggggaagcccaggagttcaagtccagcctgggaaacatgacaaaatcctgtctctattaaaaactaaaaaaaagaaaagaaaaaggaaaagaaatcaccaagagggaacatatgtggctgaagttgaggaaaccccactctacaggacctttcggtatgaggaggtcaggtagtcaggaggcctccacttacatccttctcctctgttccaggcatggatcctgaaaaattagagcgaatccagctccccgtgccaaatgcggccgagaagaccacctacaaccacccgctagctgaaagactcatcaggatcatgaacaacgctgcccagccaggtgcccacttggggtgttgtctgtccacagggccacgcagttgtaggaagcagaccccactgggagcctgagccctgggtgctaggcctgagccttctgagaatccgggcccatcccaacctctccctctgcctctcaacccctgcatcctgggccagccctcctgcctgctgggactgtgtcttagctctgggtctccttttgccatcccatcccctgccacttggtaaccatctttcttcttccacaccccgcccttcttttgctgagattgtcaatgttttcgcccccaccccgctatgtctgggtggcccaaggtaatattatgagaaagaactaggctgacagtggagtgaggggagaacattcgaaggtttaacgggccagtagacgtaggagacagagttttgttaccagcaacagttgtgggtaggtatggaaacaggtaggagtgagaatgcgcttggagaaaaactcacttggactgggcagctgaagagaggttacgctagtgctggggctgagtggggtggggccaggagagccgatggagccgagaccacccagtccttggtcatccctggggcttgtattatgtttgggaagacctattttttgtgatagcgctttttcttttcttttttttttttttttgagatggagtctcgcactgtcacctgggctggagtgtaatggagtgatctctgctcacggcaacctccgcctcccaggttcatgcgattctcctgcctcagccttctgagtagctgggattacaggtgcacactaccacacccagctatttttttgtatttttagttgagacagggtttcactatgttggccagactggtctcgaactcctgacctcatgatccacccacctcggcctcccaaagtgctgggattacaaggttgggccactgcgcctggcctgctgtttcattttttaggcagatccccttttctcacttattttcacctgacttacaatgcattaacaaagggactggcagggaggtgggcagaggggtgtatctgcctttagttttttcccagtgacctatcgtggtctctgatgtttccaaggccttagaggcatagcctgaaggcctcctcctctccacagtgggacctttcaccagaaataaacttgaaagacccacagaggagtttgcataagagcagttgtccttcagtcagtcagttacagatgcttctaggagagatgccagatgcgggttttggctttctgagcacctgcagtctaccactacccagctatgagacctaggacaagtcacttcacttttctaagcctcaatctttccagcactcattgcaataggtttttatagagattccttcaggacctatataaagtgttcggcactgtgcctcgttcacagtggtaagtaagtaatagcatagtaagtaagctgtgttagagctctcttggtcttgacagaaacccgactcactctggcttaaacaatacaagcagacaaagctgtgttagcttataaagactgctgaggcctagcttcaggcaaagctggatccaggggctcaaacagtatttttctacctttggcctctgccaccttctgggttgacgagataaatgccagcccctccagctagccctttctgcactgagactctagacttactctacgggagacacttagatttgaacagtctagttggaagagagatctcgaagtgatatttgtagaatactttactaagattaaaaatgctggcaagggtgaggaggtggccgatatagattataatgcttgtgcccctcagggcgtcaccacggtcctctgctcagcccggcacaaggagaatttctcttaacccagcagttccagcagattgtgaggttgagccttactggctctgactggctcccttgcctggttcttacctagtcactgggaccaagggaatatggagcaccccaactggccaggtgatgtgcccaaccctggaacggggaaggaggatcagctccacccaaatcacatgacccagagtgggactggcggctctctaaaggaagtgggggtgcagggccactttccaggcctcaacagtgtttagtcaccctctttttcctgcaccctgtcagtaaagggacttcagggaagtatttggtataggtagttttgatggagaacattgaattctaactgatggggaatggtttgggcatggggggttcccactgtgtccccactggatgttgggagccatgagcagttggtctatcatgtgacctgctagcctcaacgtggataggcagcagtcttgggtttaagggcgccccaccctgggtgtgcaaggcttaccctggtgtgctctgcagatgggaagatccggctggcgacgctggagctgagctgcctgcttctgaagcagcaagtcctgatgagtgctggctgcatcatgaaggacgtgcacctggcctgcctggaggtaacgccctctccgctcctccttcctgtgggccaagggagagggacaggaggacaggagggaagctgctggcatccagataggagccctggcccgtggtgtcatcggtcaccagctagaagcagcaggggctgctctcttgagaccccactccaacctacttattcagcagggacttcctttcagccgagactcgctgaagagtccacttaattgagttttagtagtttctgttgcaattatttgattctgtatttgtcctcaggatttctgaattttttctttggtattacaaaagtttttttgcacatacaaacacatcaacacacatacacacattgattatggtttttgtgtttaaaatatatgttaaattttcagtggcttttatggtacctcttattttctatgtttattttagaaaatttaggaagtagaaaggtaaaagtaacaactatagttgacattttgtctgtgtctgtgcacacacacacacatattatatatgtaaataatatatttaagtattataagcaaataattatatatataaagaagtatatttacatatacaatatgtaaatattatacactacgtatatttacatatgtaatatgtaaatatgtacatgtgaatatatgtaaatgaaacatctatttacatatgtaaatgaaaattcatttataagtgtgtatatatgtttgtgtatatatatacacacacacacacacatgcttacaaatgaattttttgtcttatacaaatgtagttgggccaagtgcagtggctcatgcatgtaattccaacattttggaaagctgaggtgagaggatcacttgaggccaagaagttgagactagtctggacaacatagtgagaccctatctctaaaaaaacaaaaaagattagccaggacatgcctgtaaccccagctactcagaaggctgaggctggaagattgcctgaacccaggagtttgagactgcagtgagctatgattgtaccaccgcactccagcctgggccacagattgagactgtcttggaaaagtaaaataaaaaaggagtcatgatggccatattttataacccattttcccccaattaactgtatattaacagcttctcatgccattacaatcgaattacctatcctttccccattttcattttgagctctgtctcctttcctctctctctcattaagaactattttataggccaggcatggtggctcgtgcctgtaatcccagcactttgggaggccgaggcgggcagatcacctgaggtcaggagttcgagaccagcctggccaacatggtgaagccccatctctactaaaaatacaaaaattagccaggcatggtgatgggtgcctgtaataccagctactcgggaggttgagacaggagaatcacttgaacctgggaggcggaggttgcactgagccaagatcacaccactgcactccatgcactccagcctgggtgacagaacaagactccatctcaagaaaagggaaaaaaaaaaaacaccattttatacattaaggatattagtccagatctgttttatacacactcatgttttagaattcgtagtttgcccgacttgctcacctatatgagacctgcctccttcacaccttccttctcttttaacagggtgcgagagaagaaagtgttcaccttgtacgacatttttataaggtaattggcagagcacagatggacagcagcatggtgtgtattgtagaaacagaagtgtggtgtctggttctatgcagataaacgttatatgtcttcagttattttttatgcctataattactgaataaaaatgctcaatttcatagtccctagagtagcaatatctaaacttttctgtccaagctgtcttatcagtaaaatttttgaggactcagccccagtatatgataatttgtttctcagtaatacatggatttggttatttgggaataattatatgtaaattatgaactacgtacgtataaacacatataaataaattatatatgatgcacttatgttcataagttatatatgcttacacatataaaattacttatgaattacatatgaatttatgaaccatatacatgtatattatttatattgatatgtgctaagaaaccttatacagacttctaaacctctattaacgtttattgagattttgtaaagtgccaccatgactttcagtatctgaaaaatttgcagagctttgtcttcaggttccagatggttttataaatatctaattgccgccaggcatggtggctcatgcctgtaatcccagcactttgggaggccgaggcaggtggatcacctgaggtcgggagtttaagaccagcctgaccaacatggagaaaccccgtctctactaaaaatacaaaattaggcatggtggcgcatgcgtgtaattgcagctactcgggaggctgaggcaagagaatcacttgaactcaggaggcagagattgcggcgagccaagatagcgccattgccctccatcctaggcaacaagagcgaaaactccatctcaaaaaaaaaaaaaaaaaactaattgccgtggttttgttttagcttttaaggcatatgttttagtccatttgggatgctaaaacaaaacaccataaactgggtagcttataaacaatagacatttacttctgggccgggcatggtggctcatgcctataatcaatcccagcactttgggaggctgcggcggtcagatcacaagggtcaggagaccaagaccattctggctaacatggtgaaaccctgtctttactaagaaatacaaaaaaaattagcctggcatggtggcaggcgcctgtagtcccagctcctcgggaggctgaggtgggaggatggcatgaactggggaggcaaagcttgcagtgagctgagatcgcgccactgcactccagcctgggtgataggtgagactccatctcaaaaaaagaagaaaaagaaatttacttctgtcagttttggaggctgggaagtctaagatcaaggcagatttgatatcttgtgaaggctcactttctcatagatggcaccatcttactggatgacctcattacctcccaaaggccctacctactaatcccatcaccttgggaattaggatttcaacatatgaatttgggtggtggggggtggtggggagcagaaacactcaggccttgccagcctcatgtgtctttcagggaaggctcatcactcgtcagccatggtggattaatccataggtcaagtagtcattttctagtttgctggcctccggatcaggtctctgcagatcctgcgagtgatggtttcccctcttaacgtggctgatgaagatcctcctacatggggaaggtggcaacactgccatttccttgtcccctgtactttcattattcaagccctctttaagctgctgtttctttgcaggaatcgttttaagcgactgcattattgtcagtgtttgttgagataaaatgaggttatatgatttggagatcgaccttgccaggctcagatgaccccatccagctgcagcagtggacatacccagacaagggtggcaccgtggtgggcccctacacactgaggaggaaatcccactttccccttagaacatcccaaaccgcacttggcctccaagtgaggatacaccctcactagcaaagcccacgagaaagcagaaacctcagggttgcattagtcatctttgaacctctttccagtataactgccctaagtttatgtcctctagaaagcttttggattgcaaaaacagaaagacatataggtaggcattttcccagagggttattctttattattaacaaaaggagagctttatttaaattctggatcccttctcccaacccagatttttcttacttttatcccataacatttattataccctaagtataatttctcagcagcttttagatgttttcaggaattgtctttcctggtggtggtagttatgtcacacaagaatattcaaatttagttgtagttctgacaactgaaaaaacctaaaaaggatctattccctttcccaccccaagtgtggggtgtgtgtgtgtgtgtgtctcattcagaacttgtgagagagatgcagcagttctaagggtcattgtccagtagagattaccatgacagtgagtgctcacactgacccaaccctgaacgagtgacaggttctgtgcctcctcgcatttcatgtgcattaactcatttcatcttcacaataccctagacagacatgccattcatgcagtggaacaaggaggcgagaggtgtaaagctggatttggttatgtgtatcagaaccaagactatgcccaccgtgctgttctgaaggggccctcccaggcagtcatgaccctgaggaacaacataaccccgaaagcactcctcataaacaaatagaacaagccatgtaattgtaatgttaaacttatttaattatactcttccttccagaggtgtggagccttgtatctttaatgtggtaacttaaacaggattgtccatttctccagccgttctcgacaaaatagataatgttaaacacttgaaatattagccttttctatattttaatcctacatagtagttttttttttaattaactgctttgacagaagaattctaactccatatacttaaaaaggaaggagaaaattttgaatagtgcaatttgatatttggtctgtcatttgagcgtgtgtgtttgtgttcacgtgtgcattttacttcctggtgatttacgagaactcactaatgagaaacagatggcctctaaagccacaaactagagtttataatactctgttgtttatggaaaaaaatatgaataatctcctcttccctcccttcctttctttttagggagaagacatttttttggacatgtttgaagatgagtataggagcatgacagtaagtgaggggctgggacacacttgggctggtgtgcgcctgtgtccctgccaagctccccctgcccatcccagagggagttttttgacttagggctttgtgaccaaatagcacagattgatggggaagcagatttagaatggtgtcttgtgatccccaccactgttaaaatttcagactatattctctccctctaacatgggaggtgtccgatgaatcaggatgattctctgctatgaatagtaattttggggacagtatcattttattgaggacttactctgtgctggatgtatatagcatgctgtacagattatatctcttcatcctcacaccaaccaacggtaatagctactgccattgtccctttcttgctgaattagtctcttctcatactgctacgcagaaatacccaagactgggtaatttataaagaaaagaggtttaattgactcacagttccacattgccggagaggcctcaggaaacttacgatcatggtggaaggcacctcttcacagggtgacaggagagagaattagtgcaaggagaaaagatgccagatgcttagaaaaccatcagatttcatgagaacttactcactatcatgagaacagtataagggaaactgctcccatgattcagttaccggcacatggttctgcccttgacacgtggggattctcatgtgtctcaccattcaaggtgcgatttgggtgaggacacagagccaaaccatatcacttgctaatgaggaaactgagtcagagaggtctagtgatgtacccaagtctgcccggccggtgagtggcagagccacgcttctagaggaggacagcccagccccgcatcccccgtgcttctccatgtattatgtccctgcctccctgtttgctgctccactggaatgtttcagcatgcagctctccctccagtctgtagtgccagcacatgggcttccttcctcctcccgcaggcagaatcgcgggaagccataggttcagaagatcccagctttctctgctttgcgcgtttgtctctgttatcccagcacctgcccttggctaggtactccataagtacgtgataagtgatccttcttgtggatattacccaccaaagcatgtgtgatttgggaagtttataataaacctaagtgttttaagtgtcaaaaagaaaaaggcagcgtgcactaattggctccttggcttcgcagcccattccctaggaatcgggacagctgggccctcaccacgtcctttgtcactgcatgtctgaggctgccgtggagccttttcaggggaaaggtgtaaattggcataagtcatctccagaaacaccccagcagcaccctgtgccaggcccccgtgggctgctcatctacagcccctcatcattcctccagccccttcgagagaggctcagtcttccacccttcagaccattcattagagtggaagggattcagttgtcatttgttatttcctcttacccccgagacatccccctgcaatgtcatttcctacagtttggtttcctgtttggaaatgtcaggcttctatggcacttgaccatgtgggaaagcttgagctcttaaacccctgctcagtgtctgcttttgacaatgcaaccttgagtgcattgctgaaattctgagccttgatttttttctttttttttttcgaacagagttttgctctgtcgcccaggctggagtgcaagtagtgcgttctcggctcactgcaacctctgcctcttgggttcaagcaattctcctgcctcagcctcccgagtagctgggattacaggcgcccactactacgcccagctaatttttgtatttttagtagagacggggtttcaccatgctggccaggctggtctcaaacccctgacctcgtgatccgcccgccttggcctcccaaagtggtggaattacaggcgtgagccaccgcacctggcaatttttttttttaaatccgtaaggtgggggatccctacctcatagccacccaggctgtatatgaaatagccaacaagaggcctcatgggtccatacacaacaacaaatactcatgggtctatacacaacaaatacttcctccccctcccaccatggggagcttcccaggtttttttgtttgtttgtttgtttgtttgttttaatcaaacatgtattgtgtgtcctatacaatgcctggcattccagagaaatacaaaggtgccacgcccttgctctgtatctgaaaatcagtcctcagccttcaggaatgcagcttctgagtggaagggggtggggacaggccctccaaggccagctgctgtaccaaagtcagaccatgacttgtgacctttccttcatttcccttattgcctctggtttaatgcaaaaggttcagtgaggtgatggcctagctctgcccccagcaggcctgaggggttcactgggaaggttgtagggggcagcaggagtagaggggaagggagctgcaagtgaatgagtgaggcaggaactgccacccctgcggggttagaggatttggagtgggggacctcaggcttctggaggaaagtacttaaagtgtccaaaagaagaaggcaagcagcatgcaccaagtggctccttggccctctggcccattcaccgggtgtctcagtatgttttctgcagctataacagaataccacagacttaatttataaaaaaaagaaatttcttacagttctagaggctgggaagtccaatatcaggtgccagcatttggcgacggccttcttgccacatcatcccatggtagaatgcgaaagggcaagacagagcaagagggaacagaactcactcttataacaaagtcactctcaccatcattgagccacacctgcaataacaacattactccattcatgagacccaatcccgtcttgttaggccctacctctcagcactgtcacactggggattaagtttccaacacatgaactatgggggacacgttcaaaccatagcaccaggtatctgggccactgagccctcgctacatccctgccctatgtagtcagctttacctagcaggagggggaaagtggtatgtttgaagcccactttctgaaaagagaagacacaaggaaagcttgtgatgtttgaaagagtaaaatgaattctgcagaaagcttacccttcgtctgtgaagccagggaaatgaaatgttagtgttcaacaacacgtgtgcattgattactactactgatgcagcagagatctgggagaggtggcagggaggggatgtcaccctgtgtcttagtcctcaaagaaggcttcgcagaggtggtgtggaaagaggccgtcagctctggcccagtggccgtgggcatgcgcctttcctcctctgagctcagtgtcccttttatgatgggcccaccagcacctgccgtccagcaggaggtgatcccagcacgtgcctggcacttagtagatgctccaataatgattgtgttatattatcccaggtaagatgtgaaggggacaaggaaggaaggggaaacattggtcctagggtgggaatcacagaggccctggagcaagacaggcctgggctcatgtcttggctctgccacccaccagctgagcgaccttggatccatttttctgcttctctgagactgtgttccctcatcagcaaagtgggaagcagctcctcaaaagcccttaggtcacagcttgcagcggaatcagctctcgttaaacggaagctgccatcgccatagctgttatcatcactggaaggacagagaggaggaagcaggtggcagacgggcttgcacccacagggataaagcatacctggcctcctgctgagaatccctgtccctgctgaggtggagagagaatgcgaagaggagcaagcttttcacagcaaggatgcaacttctcaagagtctgagctgctgcttcaattaaaggaaaaatctgcaatttagaaaaccaaaaggcatattgctcccttatctggctgcctctgtgctttacttcaatctaaatccaggatttagatcactcatttacatttactaaatgcggttgaaggcgaggggcctgtgcaacctcccccggccccttcctccttccaagtaaggaatctgctttgaggtttcctgtaatgtctcttctagatgaagcccatgaacgtggaatatctcatgatggacgcctccatcctgctgcccccaacaggcacgccactgacgggcattgacttcgtgaagcggctgccgtgtggcgatgtggagaagacccggcgggtgagtgagcacaggacctgtcatctcctgggccactgttctccagaaccactcccagaccagggaggaaagggcttctttgtcaaagtcaagagcctgccctcaacacagcttagacagtggatagagagtacccatttgcccccaggcatgactttccaaggcatgtttttaccctttgggaagtagggtttggcattccgttgcatctggcacccagtgttggctgcagagaggtagccttcaccagtgcagacagacaagccctgagctcaggagtgtaaggcaatggggccagttttctgtgaaccatcgggggtgagcacggtacatccagtgcaggtgaggttggtgtgaaatcgtagcccagcggtctcaggacccccagagatagtgcgatgttaaggcatctacctgctcttgggacacagtcaaattaaatgtgaatctcaccagcctgcaggacagatatgtgtgaaaagattagttctcagaaccagctgcagtgtgtgcttccgttatcagccctttttttccgaagcaggtactctaggaagcagtgtcctcaggggtgttcatggtattttatctcccgggtaagatcagagtttctttcttagaaagcaccatcaccttttcctagaaaatcattcactggagacatgagtatttgtgtatagttcagaggaattcattgcacacagctccccttgtcagcctttatcatctgagttaattcgtgtgtgacagaggtgtttcacttttggattttgcaaaacaggaatgacctgtcatttgcacctcagacacgaggagtctgaaccttcctccctgcagctggtggttctacctcggaagcctgggggtgcagaggaagtgggacccatgtgtcttgagtcaatccacatttccaactgtctgaccaaacccacaagcctcaccgcaggacccaccctgtccggcccactgacgccttccttccatgtcctccctgccaggcacacgattctgtttgtgggtggcagtgtttgcactggacgtcctggcatcagctttcactggaggactggttctgacagatgtgtatgtgttgcttcatgatgctgacgtgctcacccccagccagggctacagcatcctgtgccaagaaggccccacctgggagatccccccgcacccctgagccagaaggtccagaggactgaacgctgagcactgctgctctggattccactttgcctttttgttgttgttgttgttgttgttgttttggaggctgcagtgagctgtgatccatcctggagtgcagtgttgcgatcatagctcactgcagcctcaaactcctgggctccagccatcctcccacctcagcgtcggtagctggaactacaggcacaagctaccacacctagctaatttttagatgttttatagagatgaagtcttgctaagttacccaagttagccttgaactcctggcctcaagccatcctcctgccttggcctcccaaagtgctgaaattacagacatgtaccaccacacccagcccacactctaccttcttttggttcacagttcatcagggtttttcttaccacttctatgaacacatagcctctgttatgaagtagatcaattcaaatcagttctttatgtgaatttcctcattaaattctataaccatcctaggagattggcactattattatccccattttacagaggaagaattttttttttttttagacagggtcctgctctgtcacccaggttggagtgcagtggtgccatcttggctcactgcaacacactctgccccctggggtcaagcaatcctcccacctcagcctcctgggtagctgggattacaggtgtgtgccaccacactcggctaatttttgtattttttgtagaaatggggttttgccatgttacccaggctggtcttgaactcctggacccaagcgatccgcccacctcggcctctcaaagtgctaggattacagatgtgaaccaccacgccctgtccacaggggaagaaattgatgcatggagaggtctggtgatttgctcaaggtcacccagctagtgagtagctgagccacaagtcagcccaggcaatgtggcccccagaacctagactcttaggcattctgatccactgcttcccacactgccttcttgagatctgctggctctgctcaggacactgggacagcaaaaacacagccccagtcctgaagaaatcagagccttagaggtcaaagtgggaagagacagtggcaggtcatgtggctcaggccattattcaagcagcattaggtcaggtcactaatcccacctggagcaggaagtgggacaggcatcagatagggaggcataggcccagagacaggtggcacattctggcaccaacacggcagtgattgcagctggagcccacaggaggatgtgatgaggctgggggtgctggcaggagccagatcacgggagccttggagccccttgagaaccttggctgtcacctcttaacacagtttcatgacctcatgccctgctgggctggggcagatggtcctgatccacaggcgagagatgggagaaatgcaggggccagtttgtcaggcatgtggcagaagggaggttgcttcttgtctactctgagctgctgtctccatctgtcaagtaaaatgtgcctgcctttccagagttatcgtgaggactcggcagcaagccaatggcaggtctcgatgatagtctttttgcccctcacatgtcacagagttgcaggttcccagggctgtgctgcccacctcccttgtcctggataggatgcacaacccgagtggctggctgaagcacagatagagaatatctcagcttctctagagtctctttgcctgtctgacaagtttccaaaagcaactctcaagtcctcccagggtccctgggtagcagaatgatataaaagaggccaggctacctcaaagccaaggcatccactttagaaaagcttcctttgtgactttaataatttctttctgaagggtggctttggccactcatctcactacggttcctgttgcaaggtagccatctagaatcatccagaagcttagctcttcaagcccacttcagaaatcagaacacaccaatgtgctttgaatctgagctaaaggaagttacatggtttagcaagcaattgagggcttatgtggttcgtttcaagttttttgcttgtatccaaagaacattccaagctacccctttggattcaaaggttttctttctttttttttttttttttccaccaagtagactttttaaaggaggctgatcctttttagaaactccatcctttattttccttaaggacttgtcaaagaggttcaaacaattctcctggcaaatcattcctaaatattcatagattcatcaaagagctgctagattcttgctatgtgccaaatactgtgttagccttgggggtgaagaaatgagtgagcacacatccctgccttctggaccgctctttttacctagtgaggtaaagtttattaacaagtaagagaatagcaggttgggtatcaactcacagtcagagctctggaggaaagaaacagcatgccatagccaggggctgaggagcgctcctcctgcagatagagtgatcggaagagcttctctgcagagttgacatctgagctgaaacctggagcatgaggaggagccaggaaggttaaagtgataaaggaggcactttccaaacagggaacagcacacatccagtccctgagatgccaccaagtgtggcatgttcaaggagcatagttaagtgagggaggggcaggagcgcagctacaggagaggatggtggtagcgctttgcaggccgtggggaggcatctcacgataacgccgttttccctcttgctttttttttttttttttttttttttttttttgagacgagtctcagtctgtcacccatgctggagtgcagtggcatgatctcggctcactgcaacctgctcctcctaggttcaagtgattctcctgcctcagcctctacagtagcatgagccaccacgtccagctgattttttaattttttttgtatttttagtagagactgggtttccccagtctgttggccaggctgctcccaaactcctgaactcaggtgatccacctgcctcggcctcccatggtgctgggattacaggcgtgagccaccatgcccagccctctcttgcattttaaaaaccacatcacttattctttctttcaacatagttgttgaacatattctaggtgtcaggctctgagtaagatgcaagacaagaatgatgagcaaataatataaaataagaccaaaacagcaaggggtccactgagccatgccagctgagaagggaaattcatgttgaaatgaaggtcactggagctgttggggtccagtgagaacattggagcagaactttgggcttaggctggatccatcccacatgtagggggacctgagagaagcagtgaagaaggaaaacagtggtgtcagtcagaccaaccacgggtcaaatcccaactccagctgcatgagcttgagcgagccactcaccctcccggaacctcaggtccctcgtgggtcttgcctctcagctgttgcccagagtagacgagtgtggctgtgaagtgacaagcccagggcctggcagacagtaagtgctcaggaagcattgtctgaacagagatggagcagtctagtatgtaaggtgggaaagaaatagggtctttcatgatctaaatctaccaaagcttaatgccagagaaaagagagttaggaataggattttttggtgaatatcaaaatccaagtttaagccactagccatctgtatatagtcatcttggaagcggttatgaaacacccatatttgcacgaggttttatttgtccccacattgtttccctgttcctttgtaaaaccacaagcagtttttgtgtttatcactattggccttgaggaaatagaatattttgctttattttttcgatgtgtattatacattaaagaaaatacaataacatctcatgcagtttcaaaagtaaagggaacagtctttcccatgatttcatcaccctaaacaaacaatacttagacatcttttgtgctcctcctatctttgtctgtaaaaagagtgtactgtggtcttgctttcatcccttctttttctttcttttcgtcgtagcacaagaagtttttcatgttgtcacagtttaaataagtctcatttcttatggcctcataaaggttcatctggcattttcttgcaagtagacattttcgttgcttccagtattacattattttcaactaaactataatgagcagcttcatgaatacagtgtttttctttcttttgaattatttctttaggataagttcccagaagcggaatttctggttcaaagggtatgaatgtgtttttttcatgaccctctgcatattgccaaattgctttcccgatgggttgtgcccacattaaactgcttcggccctcttttaagaatgactgactttcacagctacatggcctcagtgggcttctaacttgagtgactgtcgcctaaactaggcagcttgcacatgcagcaaggaagcaggagggtgaaaaccgagcctttgttccaggccagctcgtgggctcagcacatcaccggtgccatcccgttgtacctgcacggtgggtgccccatttccagaacacaagcctgggcttgggcacgtcacgtgattaccaagccccagcttgagccacagtgtgtctgactacagagccacccaccttcccctgctcattggactgattccccggtgacattgagtttgccagaatttgcttccagactcattgaagcaaagaaactggagcaatctctttatatttgagcttggtcagctgtcatccttttcaaaatctaacctgttcttcctgggtcagtccttcctgatattctatggaagaatctgaaagaataataatttatttttcctttttaataatacttttaaatttgcgtctttatttagcaaagaaaagcgctcaataaaaccctgggtcccaagccttaaatcttttggaggtcaaggagtgtggttggaagaacacagagcttggaatctagttattcactaactgaccttgggcaggctgcctgtcattgctcagctttggtttccccatctgtaaaataggaaccatgcagagtcattaaaagcttagatgagacaaccccgtacagctggcatagtatgcggcaggccatggggaatcaagagagtgcttattgttttgggtgtggtggggtgaattttatggctcttatgctcatattttagctttcttttgtgaatttacagagttgtggggctgcccaatgtgcctaccaggcccttataacccccctacccccatgggagcccaggttttgcctcgagtggagctccccgccctgtgggaatcggcccgcctcagattcatggacatggcttctcatgtgtccttccttctcttaggagttggggcaggaaccaggaaaaacattgagagattttattatacagtcatccctcggtatccatggggaattggttctagggctcccccaaggataccaaaatccacagatgctcaagtcccttatataaacggcgtagtgtttgcatataacctatgcacatcctcctgtagactttaaatcgtctctagattacttatgatactgagtacaatgtaaatgctatgtaaatagtttgttatactgtattgattagggaataataaggaaaaaagtctgtacaagttgagtacagatgcaaccctttttttttttaatatttttgatctacagttggttgaatccacagatatggaacccatggatacagagagctgactgtatgtgtattatattctattttatatttatgatgatgattgttattatccatgtgttgtttgcaaggcaaaagcagatattggcctatattgggagccaaattctgaacttttaaagtatttattgaaaggttacagtttttcagagtggtgggctgcagaaagccacacgtttctgttttcttacccacctgctctggtcctgcatgagttatttgccttcaaaaccccaagaggaacaggcgtttgggcacagaaatgagcgtctccttgacttggacctggctgtgatgggccgtttcctttctttctcatcctcatggtcatgactccttatttgagagctcaagctgccaaatatttcaagtgaccacccacgtcttgggctttctgtacttggactgccatggatgtttaagtttcctggtgcacttggttaagtgacacacatgtcatacattcctgagttcacacccagctcagccacttagcaggtgtgtgagctgaaataactctgcccctctcagctctgtttcttcctccataaaatcttcaagttacaataaggtgcccacagttcctgccaccccgtaagtgcttaaaaaatagaagttcttttgaattttttaatggaactacacttctttttctcccaattgttagagatgtctttatgaagactgtacttttaaaaactgttgacaatcagatacgaatgctaccaccaccatcatcatcattataacttaagagctgatctttctccagtgctttctggtttacagaggactgcactaccttagcatagggccaggagataggattgctcttccagttccaacattaggaagttgctccaaggtctcccactggttagggcgcaaggcagcactgggtgtaagcaggctgaccagctcctcattgcctggggtatgaggaggcagtgtgagtgcacctctttgcagacagtaatttggcccctttctagttttgggaggcacactgctgtatagagggcacctcccctcacctaggtccagactgcagccttcagagccataaacaagaagacccaaaggcgcactgggattcgcctttgcagctccctagtggtgacagtggtttgtccccccaaccccactgtgctggctgctttccctcctgcgttatctcagaacctcctagcaggcatgcgagctatcatgcccattttacagatgaggaaaaggaagctcacagaagtcaggggacttgcccagcctagtggaactgggaatctgatgtagacctcatgtgtctgactctggagctgtccccatggggcactgcaccctcagtcaggcccagcagctgtgcctcagggagagaggcctgcaggtggccttttctgtggactgcccctctgcttccttgctctggttggtgggcaagcctgtcctggggctggaggctgctttctgcacacacggctccgactgctgggactctgctttgtttctgctctctgaaagtacctggtggccacacaattctgaccagacaccacttctatgggccaggaatccctgtgctggtggatccacctgtgcccctggtctgctggcagggaaagcctgaggggcattcagggaaccaaggtcactgcccacctgctaggtgcgaggtctctgccccgtcagcagcacaccccctgtcgtaagaccaagggagcgggagttgaagagactcacccagggtaggattttcctcaggtctcaggccctgcagcccacaggcatttcatttcaccctcttctgtctgccccacccccgtattcagtaggtagtaccttgaaatgcttttggagtgattgggttttccagagcccatgctggtttggttgggacagacagactcagggtctagcccttgctggaagcatggcctgggcaggtcacttcaccttcttaggtctcagctgcccggtctgtgaaatggggctgactgctgggcagggattattatgaaggtcacctgatacttggggacaaggtcctggcagatgacgggtgctcagttcaggtaaagtaacccaaacctgaacctgtgaataactgaaaacaggctactccccctttgatttttttttttctgtcttgttataaaagcacgtaccagaatcaaaacacccgaagaggtgggctttattgcgtttctttcttttttaatagagagtcatggtgtcatttctgggtgtggggcatctcactgaaatgactctgcaatctcactcttctctgctctctgaactgttggtccaggccatccgggtgttcttcatgctgcgttccctgtcactgcaattgcgaggggagcctgagacacagttgccgctgactcgggaggaggacctgatcaagactgatgatgtcctggatctgagtgagttggctgctctgagtcacagcagggggctgggggacatgggacatgggacaccactctgctgattcacacgccactgggagggtcagtgtgcaacctacattttgtactattattgagctgtgaccttgagccagcggtgtgcatgtcccatgcaggttttgaagaaaaggcccctgggttctctgagatcagtttgagggttctgctttcacacagctggttctctaaaaagtctctgcagagcacctggaggctcaagcaagggtgaacaaactccagggttcctgtcctccctataaacatagtggcatcggtttggttggttttatatattaagcattttctatatgattctaatgataaaagggttctgctgctaaagaaagaaacttgtaaaaagcaaaacaccagtgtttaggtaaggatgaaggctttggaggctggagaaccacgtgctcagcccataaccttgagctacttgttccgctgtgtagtgcctcattgttctcatctgcagcatgaggctcagctttagagaagacaatgggcataaagcctgaccgtgttcctggaacccctctcgtatttgtatagctttctctttcctccatttgctacagggcacaggcacactaatgagcagcatggttttctgtttcttaacggcattgtggtatattaggagtctttggttataagagacagaaaactcaccttagaccagcttaaggaaaagaaagggaaattggctgatgtcactgggaagtccaggagtaggctaccttcaggcatggctggatccgggtgctcagacactgtcatcaggaagctgccttcctccgtctcccaactctgctttcctctgttcatcctcaggagggctctcaccaggtagtggcaagatggccttcagcagccccaagatttgttgagccagctacacagccctgatggaaagagaagcttctctttccctttaattctctaaagtctggggtagacgtgttattggcctagcttggggcacatgaccatccctgaaccagccagtggtcagaggaatgtgactcactgattgtctaagctggggtcgcatgcccagccttggagctgggagggagggagggccagttccttttgaaccccatcacctgagagagggaagaggcgaccctcaaaggaaagccaccaaagaagggatggtggctgggtgggcagaaacagcacagggccactctctgtagcactgttgttgctgttttaaatcagctttattaagatataatttatatacaaaaaaactccccaagggttagtgtataattcaatgagttttgacaaaactatagagttgtgatctagaccctgctttgtattcccttgaacaaatgacaggacccccacagcctccgtttcgtctcctgtaaaacgagatggtctttcttaaaatacagaattgttttcaggattgaatgaaatagaacatgaaatatcacgtgaccaagcatagtgcctaccgtgtaactgtactcagcaaactgtagtcagtattacaggaggtcatgcgtgtgaagagcatagcatgccgcctgacacgtagaggttctcagtgaatgagtattgtgtgttacctggttgtctggtttctttttctggccttatttatgttttatctttccctttcttggaagaataaagcagctgtgacgcctctctgcctgctgcccaactcctttggcccttttgcccttgagaaatggccacaggaatttctctaagggtttaaattgatcaagttggctgcaaagaatcataaaccagtctttctctgatttgattcaaggagagaaagagcttgctttgggggggtgggggagggcagtggggagggggcacttcatcagggcagcaagaatgtttgcatccgtgaaatggaattaaattttatgctgggaattcacattccttctctcctccccctaggaatggcctgctggaataaaggttcaaagtttttcacttatcaattttaattgattagattgctagttgagatcacttaactgagcctttttgggtagttggccattaagaaagtaatggctgtttgtctttgcccagcctgattgcaaattatgtcttttgctaaggagggcgactttcagaaaatagtagggattatggaagcacgtggtactaggataagatatgcctgtattgttggtttatttggtttttttcttctttccttttttttttttttttttttttgagggagggattgtaaatgctggagcttctcctcaccttccattgtgggggaaaatcaccctagtgtgcaatctgaccaaacgccttctgtatacaaaatacaggtgaaggacaggtgaagccattcttgcttgctgcatgactggaagctgggcatgtttttgtctccctgatgaacttgagaaagctgactccgggagaaatgttagggactgctcaccatttacctgactccatgtggtctgctaggcttaaaggagtgctgtctccaaacagcaggaagaggtggcgtaaagtgtattcactgccccttgtcacacttcagtaagaaacaacagcgtaaaggatattccccagaagccaccccaagtgcttgctgaccagcagcaggtctctcggctgggtgtgacagccgagctccggctgtcataaaaggtggcttctcatggggagcattaaagatgtggtcaccactcagcaaagaggcaaactggtcatgcttaaagtgaagcctgttttgtttttcactagagaggagagtggcagagggcagaggtcaggaactggcagccacgtgtgccacatctgctggagtgatggggggctggggtgggaaggaagagagagaggaagggagggagggaagtggaaggaagttgaagggaaggagggattggaggaagaaaggggaagggagggaagggaagaggggaggaactagataaaacagtggatttctagagaaaatagcatcatgaatctccatatacccagccctcagcttcaacagtttttaccatttagctaagttttattttatctgccctttcatctgtctatttaaaatacgccacccacccacacagtgtattaaagcaaatggaagacatcatattattacatctagaaatacctctctctaacagagaaggactttgtattgttccttttaatggaattgattgccaccatttgcaaaccgagtgcctccccagccccagctgctgctttggaatggaggccagggtgcaggggcctgtagacagggcctgtgctcacccatgtgctgccgcccgggtcttgttgacatttgattttgcagccactggcatcattggagtaatcatctttgtaatcttccccagagtcttcatgcctgtgaggctcagtagccttacctttgaaatggttctagggctggatgtggtgactcacacctgtaatctcagcactttgggagtctgaagtgggaagatcacttgagctcaggagttcaagaccagcctgagcaacgtagtgagaccttgtctctactaaaatccaaaaaaatagccggttgtggtggcagatacctgtagtcccagatacttgaggggctgaggtgggaggatctcttgaacccgggaagttgaggctgcagtgaaccctgatcatgccactgcactccagcctgggggacagagtgagaccctctttcaaaaaaataaaaacaaaaccaaaacagggttctaaaagactttccaaggagctcaaatgagatcacatgtaaagctcacagcaccatgcttggcacttagtaggtgcccagtgagtgggagttggctgcttccctgctgcagctgctgaatacgcaagctgaaactcatcctgctgggctccatggggctggcattttctgcttaagcaacactctgagaacagtgtcctgagacattcaggtcattgctcggatgatggcactgttttgaggggtaagaaagatatagctctggctgctttggccagaggaagggagctgtatcccgtctaggctgtgagactcactcactccagtgtgcctcctgaacagggacaagcaggctttgaggagaaaccacagattccttgggattgacctcagagcctccttaaaggattcttgcctgtttccaaatatcatgagcaaccacaataggggagaaatctgtccattatccatacaccccaaagagacacctggcaaccaggtgtgttcagtgtccagtttccttgcagcctgttcatgtgggcacctaacattcacatagttgcagccatagcatgtgctacatgtatctaacttgtattctgatttctaaaatcaattcgtgaagcccattcaatgaagacccattcatgcattcagctatttattgagcacctgctgtatgccaggcacagtgctaggagctgagatgtgagagtgagcaaaagccagacttcacttctgttcttgaggtgtttccagttgtggagggagcaaccactaacaggtaggttaagtaaatgcatgatcacagactgattgggatggctccatagaggtgatgagcagggtccatgctggagaataaccaggaggaaaatcctcatgggctggttagggaaggcctctctgaagaggtgctgtgccaggagggaccagaagcttctacgagaaagcacagaaatgaggactgccttttaaggatggcagaggtgaggctgaggtgggagagagggtgctgtgtcccagggtcctcacagaaacttgggtggctggcacacaagtagcaagagtgggtcagtggctgggaagagccagatctcaactacagggctttctcacagggacatctgtcccaaacggacacttctagagctggcactgcctggtcagacggtcccagaaggggccttcgagctgcactgggggctagaaaggcctgcagcagggcggcgaggagcatggactcaggggccagactgtgcctggatggaagtcccagctttgctgccttctgcttgccagctgtattaccttaagggaactgagtctcccggcacttcagtttccacagctgtgaaataggacttgctgggaggagtagatgagcattatctgtgctgtgcctagaacagtgcctgacagaattgcagagaggccatttaggaggctgtggcagggaccaggggtcagtgctagtgggcaaagagggacgggacagtctgggtacagcattttgtgacagtttgcagtggcgatgccagagagctcggttaactctggggttctgagcttggggcagtccagggggcaggggctgggaggatggtgattctgtcatcagcagggctgatcctggaggaggagctggttccaagcagaaggtgctgaagttggtcgggcggccaggtgagacgtgccatgagggagctcagccaggatgtccggtgggcgggggagcagtccggaagcctcctcgctacttcatagattcagaactcttgtgtttagtagcctgcatgatattctgttgtctgagacttctgacgtaaccatggtgcaattttgggtcatttttactcttgcctggcataacctagctggctgttcctcaaaagatcctcgcgacagtgtgttagatcatgtggtgtgtaagggaagtcctgaaacctgcagagaaacgtctgtgaataagcagacctctgtacactgggtgtgagtgctctcccaggcttgaacatacttcccagggtctgggggcctggaaaatactcatcaagtacagaacagtaggtcccagcccttaggatttcatagcccagaaaagcatcaaaacaaaaataaaaaacaaagcttttggggacggatcgccaacttttgtttgtttaccgagtagtcatttttaaaaaaagcatttatgaacaatcattccataaaagaaaagacattgttaatattgagtaggtagcacatcatttcagaacgagggtagtctttccaagaaacagtagtggcaactgtatacacacatactgtgctttaatggggagtgggtttgttgttgttgtgggggttttttttttggttttttttttgtttgtttttgtttttttttttttttttttttaaaaaaagcaagtgcagaccaattactctagcaaaagccagtgactctgtctttccaagcttatggggaaggcaaactccaatcacagcagcacagatcaaactcagatgaccaccgtgtttcctgttctaagagcaggtgacggggtttaacctggctggaggtcagggaggcttctgaaggaggggcccatttgagggctgcagggggggtgtgggtgccgagaagtggcgcagaagaagcaaaggccctggggccgatggggatttggggaagatgagagacggcagtgtggccacagagtcggggagtgggagggtgaaggtggttggcaagatgaggctgggtaggaagccatgcaggccctgtgggcatatcaagtgttcagggttctatcttaaaaacagtgagaaaagtttttacctagctgatgtgatcagatttgtatctcaaaaggccctctctggcctcagtggaagagatttatgggtcagggcagcattacagcagggagccccatggggaggccaggcctacaaggcatgaactaagaggtggtgtccacaagctggcatccacaccaggctcggacagtctggtttgccccagagacttgtcttgaatgctgctctgtccactctgtggcctaggtacaggggcttttattgcacagaggtccatccagttggatccggcgtgttctccaaaccgtcgtacctttgaagctaattattaacaacaacccaactatttgggttgtattcacctcctggcaaggcaggctgctgtggaccttccctttgctctccttctggctgtttccaggccaggacttgcctgtttaaaagtcaggctgcggttatggaggaagccttggatcctagacaaatgcagaccgaatctcagccatgcttcttcctagccatgtgactttggacaaatctattcccctctctgtgctttagttccctcattgatcaaatgagaacagcgatgcccaactttgcagggttattgtaaggcagaacaataaggtggatatagaggttgcaaacagctggtcctcaggcaggtgggcccacaaatgtagcttcatggctagtaaagcatttgcaagcgaattttatgttgctaatgttttaaaatcaggatattttatcgtaaaaacctagctatcaccttgaatatgagacagtgacagtctgtccacgcagagcctgcatccccacaggcagcagtcagttgctcctcttcatgggagtgaacccttctcccagctgctagagtctctgctgaactccagacctgtgtactcagctacctgcccaacatttcttggttaccacaaacacaagatgtgagctttcccacaaaacctgtctccctgcaggcttccagacagttgatggcagttccatgctggtggcaaaaaccacaggctcatccctgactcccctctttctctcaagctcaacttccagttggtcagcagacctattcagcctctgccgcaaaatacagtcagccctatgtgtcctcaggttctgcatctgaagattcaaccaaccacagattgaaaacatttctatttttatttaatttttaaaatttatttattttttgagacagagtctcgctctttcatctaggctggagtgcagaggcacaatctcggctcgctgcaagctccacctcccagattcaagcaattctcatgtgtcagcctcccgagtagctgggattacaggtgcatgccatcacgcctggctaattttcttttttttttttttttttgtatttttagtagacatggggttacaccatgttggccatgctggtctcaaactcctggcctcaaatagtccgcctgccttggtatcccaaagtgctgggattacaggcatgagccattgtgcctggccatttatttattttgagacagggtttcactctgttgcccaggatgaagtacagtggtataatcacggctcagtgcagccccaacttcccaggctagggtgattctcccacctcagcttcccaaataactgggactacaggcatgcaccaccacacccggctgagattttgtatattttgtagagacagggtttcactatgttgcccaggctggtctcaaactcctctgctcaagcaatccacccaccttggcctcccaaagtattgggattataggcatgagtcactgtgtctggcctattattattactatttttttttttatacaaggtctcgctctgtcgtccaagctggaatacaatggtgcaatcatagctcattgccgcctccaactcccaggctcaagcaatcctactgctgcctcagcctcctgagtaactgagatcacagtttcgtgccaccatgtccagctgattttttttttaatcttttgtagagacagggtctcactatgttgcccaggctggtctcaagttcctgagcttaagcgatcctcccgcctcagcttcccaaagtgccaggattataggcatgagccaccatacccagactgaaaatatttttaaaaaacaacaacaaaaaaatacaaccatgcaaaatgagcagattttaaaaacagtacagcataacaactatttacatagccatctcattgtatgagttattataagtaatctagagatggtttaaagtgtgtggtaggatgtgcataggttatatgcaaatacgacaccattttatatgaaggacttgagcatctgtggattctggtgtcctctgaggggttctggaaccagtccccatggatatggagggacgactgtattgtcaggatgttaccttctctcccagcttctcccagcaccttgtttgaactgccaccattttttttttttttgagacggagtctcaccctattgcccaggctggagtgcagtggcgcaatctccactcactgcaagctccgcctcccgggttcacaccattctcctgcctcagcctcccgagtagctgggactacaggcgcgtgccaccacgcccagctaatttttttgtatttttagtagagacagggtttcactgtgtagccaggatggtcacgatctcctgacctcgtgatccgcccgcctcggcctcccaaagtgttgagattacaggcgtgagccactgcacccggcctttttttttttttttaagctagagatgggatctcactatgttgcccaggctggtctcaaactcctgtgctcaagcattcctcttatcttggcctcccaaggtgctgggattacattcatgagccattgcacccagctgtgccattatcttttacctgaattattgcagtagtctcttgcccagtcacttgcttctgttttgtcccctagagtttattctcagcagcatgaactgtcttccttttaaacgagaagccagatcatgttcttcatttgttcaaagtgggctcccatgccagtctgaataaaaaacagagacctttacccctgaggcttattatgtgacaccacctccctgtctctgcctccttgctcttcttcaaacacacctggcatgtacccacctcagagtctttgctctgactgtgccttcttaccaaccccaacctgcaaaccatttgttccctagcacaagtacactggagggcaccacgaggcccatgaaagctcacacacgaaaaccgtaccccaaattcttgctccatgtttgaaatcctgaccacatcgccctgtttgtttattcttcatttgcggattaatgtgaatatcataaagattctgcaggatccaacttcctagcattctgcgtgcttcgccccagcttctttgcagacaagagcttttaggcagagtggaagtccctggctattttcatcggattgcctggagattcgtttccagcaaaagtattatgaagctccccaagcaagtatgtggtttgactgtcagtctgtgaaaatgtgagctcattgatttctttctcttgtaaaaccagtactagttttgtggtcctgtcagttctggaaaattctctgtgttggcttattttgctgatgacccaggcattgtcatgtgcctctcatcctagtgaaaatgagtggcataaatgagaaagacaatgaaaaacaaatccagaatacggaacattctagaagacagccgacctgagtttttcaagaatgtaaatgttgtggaagaccaaaaaagagggggacgaaggtagaggggtactgtttctagataattgaaacaaagtgacatgacagttgtcagcctggattgatcttagattgagggggaaaagtagccttaaaggacatttttctgcaaactgaagacatttgcatatggattgtgattgagtaatataattgaggtcaatattacgtttcttttttttttttttttttaagagatgggatcttgctgtgttacccaggctggagtgcagtattgcaacctgaaactcctgggctgaagtgatcatcccaccttagcctcttgactagctgggactacagatgtgcaccaccacacctggctgattttttttttttttttttttttttttaagatgaggtttcgctgtgttgcccaggctggtcttgaacccctgggctcaagcagtcctacttcagcctcctaagtagctgggactacaggcagaacccctggcctggctaatattatctttcttgagtgtgataatgccattgtggttctgtgggagtatgttcttgttcttaggaagtatgggctgaagtgtgtaggggtaaagtgtctgatgcctataatgttggactgattcagaagataaaactgtgtgtgtgtgcgggtataatgagagagcagacaaatgcagcccactgtcaacaagtgatgaatcaaggtgaagggtacatgtttgtctgttacactgttgtttctttttgagacgggatctcgttctgtcccccaggctagagtgcagtggcacagtcttggctcactgcagcctcgaactcctggcctcaagcgatcctcccacctcagcctgtagtatctgggactactggcacgtgccaccatgcctgcctatttttttattttttgtggagatggggtctctctatgttgcccaggctggtctccaactcctggcctcaagtgatcctcctgcttcggcttcccaatgtactgggattacaggtgtgagctaccacagctggcctattctattctttaaacttttatgagaatttgaaaatcttcaaaataaaaaggaagggacgagagagagagagataatccagtccttgaaaatccaacatttaatagatggggagtataatgtttaggaactggagccccagatttagaaaagcctgggttttaactcctgctgtgtgaccttggacaaattagttaacctctctgagcctttcttcctcatctgtaaagtgggtctaatagtgcctacctcaggactgttctgttgattaaaagagaaaagtccatcagaaatactcagcatcacactaagtgtacacaagtgtttgtgatagaaacagtcattacaattcttcctcttgactgcatattgggcactgaaatatgtctgttctctttggagggttctttgtcggaatcctaacaaagcacagcctcgtgactgcttctgtccaggggacacattgaaaagcagaggaggtaacacaggcttgttaactagataataaggttcttggaaagatgactttcaggaaagtgggtgccgtctgattgaagagctgaaaccacaggatggggtgggaacttgaatcagacccagatggctccttgggggcaatttagttcaagcatccaggcatgggccctggagaagcggtttgcttagtgctgactctgaagtggactaatgttaacatgaaacccaagaggcaagtatgtacatggcattcaaagagttggattgcaaggcgagtgtggttttgtggcactttggcctgttctctgcccccacccccggggtcccgtgtttttgtctttaaaggaagcacagtcctcagtcctcatggggtcgctccacaggtagacatttaatggagcagctgctcatcacccgacctgctgacttggaatcactcccaaccctcctccaacctcacgatcgggggatcatcagctccctggactccacagctctgccccatccctggtctggcctctccacacctctcccctgcccagtatctcccccattctaccccagcccatggccttgcgccacgctgcttcatccatcctgatgcccagtatgtaaaaggcgcctaacccgccatcatgtccctgcttgtaaactctcagatcctcgcagtgcagcggcccaagctacccacgacactcctcttctcccatatgtcttgctgcatctgcccacacagtgcccaggctgctcacaggctcctggacacagcctgcctgcccttgtcgcccctgcctggatggccctcccagcctccttcctcctgctccacgtgccttgtgcacatttcagatgtgcgcttaccgctctgtatatccctagggcctggcacagggcctggcacatagtagacactcaaggcttcttggattgaactgattaaagctttagcagtcactgtaattattcataaacactgaaggactttcattaacatagaaatagcatttccaaatctcatcttgagtaatttcaggcagttggattgtgagttagaaaaatgatgtttgttcatcattaacatacatttgaatagtcaggttcccactgcagacttttgtccccctctaatgacatataccaagtatcttaaacccatcttggcattttctaaaaatgtagattgttttgatttcaacgtttgagctaccccaaattatttaacctctctaagggctaaaatgcttcctcttttcttctcttttttttcttttttctttttccttaccccactttgaggcaggcaccctgaacttgacagattgggaaaaaaatcaagtttcagttaaaccaccaattctctaaggaaatggaaaacatggaattcacaatgtttcccctctctatgaattaaacttcttccctgtgtacttgatgaataatgttgctggccacttttcagaaatgaagtagaaatatggagaaatgaaatttgtatcctataaactgactggaaatgggattgtaatagagctgtcagttttgttcaagtggaaaatttttaagtaaatccaattgcagtattatttggttcttttaaaggagagggtgatgtagctgtttcctgtgtattgattatttgattggtacctgtctgctggacctatttttttttcctcagtggcattcattgatgtggtttaatgtatattcctgtaatctttccctgttttataaacttacaatcataattgagccacattagagagacatgttctgctgagatcacaaggtcacctaatgactgtgccctcttttgttgttgatgtattgaagtggctctaggacagttcttctgaaaaacacacacacacaaattattcttttttcctttacaaagcaggatttctagattcaattctatgcattagagaaatgaggcatttgagtagtggagactgtttgagctttttttgcctattaaaattattgtttttaagccaggcacagtggatcatgcctataatcccagcactttgggaggctgaggtgggaggattgcttgagcccaggagttggagaccagcctgggcagcatagtgagaccctgtctctacaaaaatttttttaaaaattagcagtgagtaatgattgcaccactgcactccggcctgggcaatcgagcaagaccctatctcaagaaaaaatatctatattgtttctgctgaaggcactctacagttgaaatactttttcaaaataccagtccttcccacacatttggaaatgggaccatggttttgatttctcacaaaggaagggacttagtggcttagatttgctcaaaaagcagtaacttccgaggcacatcaacccttgggatgtggacagcttctgggtgcagctgcaccagagggcttccagggaggggcaggggtcctgctggcggttgagtcccagcccagcactgtgaccttggatatgtctgtgtgtgtgtgtgtgtgtgtgtgtgtgtgtgtctgtgtgtgtgtgtgtatgtgtgtgtgtgtgtgtgtgtgttttgagacatggtgtcactttgttgctttggctggagtgcgtggcataatcatagctctctgcaaccttgaaccccgggggctcaagggctcctcccaccttagcctctagagtagctgggaccacaggcatgtgctaccatgtccagctaatttttaaatgttttatagagatggagtcttgctatgttgccctggctggtctcaaactcctgggctcaagcggtcctcttgcctcagcctcccaaagtgctgggattacaggtgtgagcccctgcgcctggccttggcatgttttttgaccagggggaggatgaggtgcttgggaggatgagatgtcaggaggatgagacgctgcctatcagtgtttagcactgtgcctggcgtcttgatagagcccagttgacgagggctggcaaagaagctggtttttgggtttctcatccaaaccccactactcctctgtcaagaaatgatcactctagttattcagccaaaccttggaatatccttgtttcttctcatccctgtgaccaagctcttagcaaatcctgccagcttaagcatcacatagatagagaacccagctccgtctcactgcctttagctcccctgcagctggtggggattctagaaaactgggactagggggtcagcttcctcctctgccctttccacaccaacagccagtagaatccttttaaatagacgtcagacccttcagtggtcctggcttcccattgtggtgtcagctcactgtgccatgtgtgccccccatctgctcctcactgtgctagcccagtcatacggagctcaagagatttcccccttgggccaccggcttcagggtgccccaaaacccccactctgccccacagggctgccaaagccagcctccttgacaacatctggctgacggggaggggagggcagtaagagccgccacagaaaacaggaattcatggggggagtggggttgaggattaacgttgagtttcaagacatccctcgctccagcccactctgtgagctgtctggggctccgcctacacacagctcctcaccctgaagctgctgggttcccctgcatcacacgcccaccttccccagtgaacccagccaccagatttgacacaggatccggtgattgctcaggcctcaggaggggagggttgccttctggccctgatatctgatcaaccacagaacacccaaaacaaatctctgaaccagtgacagacagcgcgacctttaaggaaggtgtaagtcaggagaaggccatctctcctatacatcacctctcccagcccaggaagctggcctgccaattgccccagagtctggcccagccactgaccaggtccaccctgccctcagccaatgcacactctccagcccaccccagggcctgctggggagatcaggaatcgaagaatggagcagcacttcctcccaccctcttgtaggagggagatgggttctattcagattaggcagaaacgctgaaaagtattgtgaccttgaatcctaaatccccgttaaagttgaggcttaggaagcacctgaaatcacaaggactgatcattagaatctatttaaaaacaaagagcagggccgggcacagtggcttaggcctgtaatcccaggactttgggaggctgaggcgggaggatcacttgagcctaggagttcaagaccagccgaggcaacatggagagaccttttctctactaaaaaggtcgggcgtggtggctcattcctgtaatcccagcactttgggaggctgaggcgagcggattgcctgaagtcaggagttggagaccaatctgattgacatggtgaaaccctgtctctcctaaaaatacaaaaaaattagccggatgtggtggcatgcgcctgtaatcccagttacaccggagactgaggcaggggaattgcttgaaccagggaggtggaggttacagtgagccaagattgtgccactgcactccagcctgggtgacagagtgagactctgtctcaaaaaaaaaaaaaaaaaagaaagaaaagaaaaaacattagccaggcgtagtggcgtgtgcctgtagtttcagctacttgggaggttgaggcgggaggatcacttgaaacctggggagattgaggctgtagtgagctgtgatcgagccactgcacttcagcctaggggacaacgtgagaccctgtcaaaaacaaaaagagcaaaatcctgatttaagacttaagaactctggtggagggtgtgaggggtctctgtattgctggtgaccagcacaatgcgtggtgctgcaggcggcctggacagatttttcaaatgaatgtcaaatgttgttcatacttctaaacttttaagaaatgtacagaatatggctaggcgcggtggctcatgccggtaatcccagcactttgggaggctgaggcaggcggatcacttgaggctaggagttatgactagcctggccaacatggtgaaactccatctctacaaaaaaaaacgtgtgtgtgtgtgtgtgtgtgtgtgtgtgtgtgtgtgtgtgtgtgtttagagaaatgtacagaatactgagcttgggacatgtaaaagcataaattttcatttttactttgacctgcctgaaaatagaagtgaaaatgtgtttgccacaggggaaccgctctaggggcatctgatttgctcctaggccaggccaggacagagctgtgaccaagcgtgagggtgggtggtgcgaaggccctgtggtttctggcccagcaggactttgaaaacaatctgtacccagacctcactccagaaggttctgagtcactggctccggggtggggccctgacatctatattttcaaatgctccctaaaggattccattgcatagccagtgttgagaaccatgggattagacagagtgaggaatgttctggaactcagcactcagtgtctgctttgctgctttccatgaattctagttccctctaggaactctccttgcccacctgctaatcagccagaggccatcaggaaggctggctttggtagcatggtacagcagtcacatctctctaagttccaaagtcagtttctcaggtggaaaccacctgccgtcccagtcaccctcacagatccctcatgggtgaatgacatttctcaatgaggagtgggtccggcacagccagtctgaactgcagggctgcagtagaccccgtcgttgagcaggttttagaggaagaggttggccatgtcagatgaaatcctggtttctttaccagggagaatcatgctgggcactttgaggggcgctcaagggataggcaggaagagccaagcccatgagggaggcagattcccatctgcccctaaggttccctcatgggtctggcagcccgagaggcctgtggtatttaagctgtttacgcttctctccctctcctctccactttcctgcatccgtgtagttgagtttgtggaagttaagcttgcatacagtgtgcctctacctgacttgaagacaaatcacttgccctctcgagccttgggcacctgtcttgagaggaagggcctgcgtaataggttgggcctcctggatgctccccagccctgcagccctgcagccccacacacagctacatgtgtgctcagaaggtagctgaacccattctgtgcttggccttgtgtataatcacttgcatgggctaggcaggagattcccttgcagaacttgaaactccctgcagcactgaaactccagccatccctatctcttgtggttgttctgaaccagtgccagtcttggaaatggcctgttttgtttcaggcagtcataaaaatgccttaggagtagagactgtccaggccagagtcagccagccagaccatggaggctcagaagttgttggggctgagctggcctcccccagtcctcacaactttttagtcatttgctaataattaagagccaaaagttctcatcccatcttccctccagcctttggactgactgggatgccaccattttttatacaaggttcaaggtgagatagactttctttccttttccttccaaattctcatgtagaaaagccgcatgcaacttcctggtttttcaacttggcacatccacattatctttttgcatttatcttttttttactacctataccctggcctttgaattttataatacactttgcatttttctaaatgcagttggggttttccagagctgtgcaaagccaggaaatatgcatgtcatttaaatgactccggttaacctttagcctttaactggtttctcataaaactcgactctctcccagctatggtttgcattcttcagagcagcaaaactgatgaacatctacagctttcactgttccctgctgggcccccttccctttgctgcctccagtctgatgagccatgctggcagactctgggaaatgtgagtcccaagcagtgtctagcagaaggttccagactagattgatgcagcccctgttgccacttcctgaggtctcccagggcccctggcttcagcggcttcccttcctatcatggcatcttgttcctatcatagcacagtaaccataatagatcccatctgtttcccaccagaaacacaagatccagactgcagattgcacacttgactgtagacagggactctgagtgtttcctcacccactcccgtgcgcgtccatccatcatttgctgaatggtaggcactgtgctagccaccagaaacacaaggacaggacagagccctcctcccttcaggcatctagcacagtgatgcacttcagcaggtgggtgcaggtgctctgctggaaactgcaggatcaagaagaatacagagtagttgggcccttgctgggggtgggtgggtaaacagggacaagaattgcttctgggcgtccgagcctttgagccaagggttgttctgagccagtgtgaagcagcagacaacctggggaagggccttccaggcagagggggcatctgcagtgaagacacacaggtatgtttggctaccaggtcagtagcccgtgtctggaacattgggcggtccattcgtttcatatggctgctgctacacatttctacaacacccagttattctcttacagctctggaggttagaagtctgccacgggtctcactgggctaaagtctaggtgttggtccttcccgaaatctctggggagaatctgttttcttgccttttctggattctaaaggtcgcctgtgctttggcttatggcccctccctccattctcaaagccagcagtggcaggatgagtccttctcacactgcatcactctcacctcctcgtctgcctcactctttcacttttagaaccccttctgattagattgggcctgtccaggtaatccaagataagctcccccagctcaggctctttgattcagtcacacccatgaaatcccttttgtaaggtagcatgttcacaggttccagggattaggtcgtgggcatctttgggggctattacagcccaccccaggtgggatgcagaaactggcagcagatggggctggaagggtaggcagaggctctgcgggacacgctgcaattgaggaagcctggagaactaagcagatgaacaggcaggcaggagacagctacccctcaaatgctcttcagttgtatggcctgggccccacctcctgccctgtccttggcagatccctctgaccttgcagccccggtgcagggtggaggcatgcccagtgggcccctgggtctcagaaacagcaaccttttgtccttttgtctggacaaaagagccccactttgttggtacaagttaaaattcttccctcagccccctctccactctactcccatctctagggtgcccctggtctgagcccgctgatgttcccaggttgcctcctctgtcctgggcacccagccacatcctgcccttcttgcccgtcttctccattcacccatgtccttgttgctgtggcgcctccaggtagggctcctccaggtagccctggctcacgtctccccaagctctcctttcctttttgcactaaaaggctcaaaaatcctcctccatggccatctgacccttccactcccctccccacctagtcacaaggtacccactccctggattcctcaagccatagggccctatcatttcttacaggacagcagttccaagccaggagagcataggggttctctccagccaatttgagccaggaggaattttaaccaaaagcccaagttggcttttgaaagaggcctttctccaggaaaggattagagagttccagtcattaaatggtccgctgcagaacgctagttcttgactaaagtggttggtttttaaatgaaatgaaataaatgtgcctttttgttttttcaataaatgagaacaaaagtagccaggtgtggtggcatgcacctgtagtcccagctacttgggaggttgaggtgggaggatcgcttgagcttgggaggcagaggttgcagtgagccaagatggcactactgcactccagcctgggcgacagagtgagaatccgtctaaaaaaaagaagaatattgtcgactgtgatgggaaaacattctgattcaggcctcaagtatatgtatgagaattgaagttctgtgaaggttcgtgcatgtctcccttgattttgatggctcttgttaaaaaacaaacccaaaataaccttagaaactgtgtgcacacgtgagtgtgtgcatgtgtgtatgtacacctgtacacgtgggaaatcgcgacggcgtgctctgtacaagtgcagatctgctcgtggacagtttctcacccctgcagggccagggccctagggctcccaggtggctgccacttccccattgaggctgttccttgccagaagacctagggtccggtctttcaattctcttcctgctgtgaggaaagtgtttctcttgaaaacaggagccagcccaccccaaatcttgatgctgggtgacaccaaagacaggaactcttttgggttaaaatttggggctacaggtaagacttgatgaggcttctatcccagtgggtttactggtgaattgggaatgagtggtgtgtaaaggcagccggagcggctgtgcattcgttcagcagccgtttatggaggccctgctgcatcctgggccagctcagccctggcgatcaagctaagctggtgctccctctcctccacctctctcttctggaaggaaaggaacgctttcttcctttaaggcctaagactcacagctggcttgaggtagaagtcctgcctgccctgaatataaaattttaaaacttccatatttggcaaatctgtaccctagttttgtttagttgtgtgtgggcgtggggttatattcagcactggaaattgtgggagcccagctgtgcatcaacagcttctccatccagttagggagagtgggagctccccatctaagtttaaggttgcagctcttcctcccatagatctgtggtttaccctcagccccagcccctgcaacaacactgacccctggagagcccagacaaaggctctgagaagtcctgcagacacacagccagccaaggaggtttgcttagtaagagctgcccctcatcagcagctcaccatgtagggggattgaggttttgtttgttttgttgttgttgttgttgtttgtttgtttgtttgtttgttgttgtttgaggcagggtcttgctctgttgcccaggctggagtgcagtggcacaaacgtggctcactacagcatcaaactcctgggctcaagcaatcctcccacctcagcttgccaagtagctgggcctataggtggacaccaccacgcctggataatttttttgattttttgtagagacagtattttgccattttgcccaggctagtcttaaactcctgggctcaagctatccttccacctggcctcccaaagtgctaggattactggagggagccactgtgcctggccaaggcagctcatcatgtgccaggcactgaggatttaagtgtggaggccccatgtgggaggggcccaggtagcacgtgaccccagggccactcagctccagagccctcggtctcctccgaagcttcacctcctctcactccatcctagcatcacccaaccatttttctttccttcctaagcccatgtaataatatctgccagtttcctccaacactgatttgggctaaaggagcccagaataaacaggtggccctggccctaagccccagtcctctcctgaactggggcaagccctccacttccagcctcctgctgcctgtggcgctcccctgtccgctgggaggcagggaggctggcccagggggacctgacatgaagagtctgtcttacagggctcaaggggatggctgtggtctccccttgcctgtgtgtgttctacccggaatggaaaccagcttttcaccttgtccaggaggttgggaacctgagggaacacagcactgcctctgtcccagccccccattgctggttttctctccaccagcagagtccaagcccaagccgtatgggccccagcaggaccacactgagccctctctccagccccgcggcctggctctgggatgtacccataccaccccttttagtcccctgcttgctgagtgtgtccccttcagctctgggccttcatacaggcccatccctctgcttgggatgcttattcctgccaccatggtcccctgtgtttggccaactccctgacaccttcaactctgcagacagcttacttcctagcaaaatcttccctgaccaccagatctctctctgttcatggcatttcccactgtgtgtgattttctatttttatgtggttctttggttcatgtgggtaccaagctgcttgggggcagaaaccccaattcttattcaaagttggatcccagggcccacagtgtagcaggtactcagtgaagacaggccagatatgaatgaatggaaatgcgagtgggttagggtccgagcccacaaatgaggacattggccttgttttccaaaaatagaccatgactccagggccctagaggaagcctgtaaacctcctggtctgacagacatctgacacactttgcgtgggtctctttctccacagagaagttggaataagatcaagacttaattcgcaggcccagcattagtcttctgaactcgccggctatatgagtcatctccactgtggagggaggcaattttaaactggaaaggtcaatcgacatgtcagaatatctagtaaatcattcgcgttccacctggtgccccttccattcccctgaaaaagcctgcccttgttcagcgcctctcgaagacactgtggagaaagaggtagccggggctgggtggtgatttacctcgaggaaaattaatatggtgccatcaattctgaaggcagaaagggcccatggccagaaggctgcacgcaggctggaataactcacggcccatgagggccctgagtttggggaggcctctccttggccctggatataaatcagcagcccttttgcagagagagagtcggagttttgtcaggcctgggggaagggagccagcaccagaagcccctcttccccaggagcctgtcgttgtctgaagggttgaaaggcacctctgtgccacccttctcggccagcaccaagcactggactcatttacagacgaggccatgaagcccccaccctgggttccaggaggatcacgggaagggggctttcagcctggctgtcagagaagaatgtgacaggcccattttcactccacaggccttaattggatggtcagagggcacatctgtggcttataagaaacagatggcgggatgggttagtgaaggagaaagcacgcttgcttcaggttgagtgcccgtggaggtgctggggcagcacgctggcaagcaggcagactcggccaagacccagctttgtcacgtgcgtgaggccttggctgtcctcttcatctttctgcgtgtctgtttcttcagctgtaaaatggagatgatgaggcccaacaacataacataggaggatttggtgagaaaatgcatttgaaatggctgaagacagtgccgtgtgttataagtgcttggtagttgttattgtcctgtggtagccttgggtctctagagccaagaacagcctcctgtctggatctgagtggcttcatcccactgtgtgggactctggtcccaagtgttgtatgtgagtagctgggaccacaggtgtgcgccaccacacccagctcatttttgtattttttgtagagaaagggtttcatcttgttgcccaggctagtctcaaacccctgggcttaagtgaccctcccacctcagccttccagagagctgggattacaggcgtgagccactgtgcctggccgggaatcccatttcaacctgagattgggcggggacaaacatccaaaccatatcagtacctgtgggaagtgacttggaggcctctcgggtcttcagctagtcctctgggcagtagggagaatcctaagtaatagccgcttcacagggagtcagtgaggatgaagtgtgtggagcgcagagccactgtttgttgaaagtgcattgttactgttattgcctttgttttggtagttaggcttgtttccagggaactttggcttccttggcttctggggtgtgcacacaagcactggaccaaggatgaggctcaaggagggccctgggctcatgccctgggctgacagtggaggccatggggctggtggggaggagcacaggcctgaggccaccccacctggctcaagatccccactcgctacctctgtgacctggacaaattcctccacctcatctgtaaagtggggctaggaactgtttcccccttactgtgggattattatgaggattcagtgatgcgatccatgttgttttaacagtgctttgctatatggtaaggcttcggatagtacctcactggtaggtaatttcctgttaaggacagccaaagtggaattcagatggggatggtgagagccgagacattattttgtttgtttgtttgtttgttttgagacggagttttgctcttgttgcccaggctggagtgcagtgtcgctatctctgctcactgcaacctccgcctcccaggttcaagcgattctcctgcctcagcctcccaagtggctgggaatacaggcgcctgccaccatgcctggctaatttttatatttttagtagagatggtgtttcaccatgttgtccaggctggtctcaaactcctgaccccaggtgattgagagccgagacatttatgcccagttcctgcctttccagagcctggtgtcatcttttaagtcagcgctaccccatctccttcaattcagttcatgtcacctcagctcgacagaggcagttctgtgtctgggcaccaggaatcctcagggggaggccctccagcaccacctgagatgtttgccgtgtcagagaaccaaccttgtgatcacttacttagtaattttctttgaatgtactcacaatttatccctgtcagggcaagatggagtaagttaagctagtccaaacctaaacccgtgaaatcaggagatccataaactaaatatgtattttctcacaacatctgaagctaaatagaggttgagataaaattagaaaccattcacgtaggtgccatctaaaaccatcttaggtccctgtccccacccccatcccccacctgctgccccctatagtctgcacacaaggtggacttgttaaggctcccctgggacccctgcctgcccacagagcctcacctggacccggtcccaagagccaggcccactctcacgtccaggaggaagccctgcctccccaggtgttaggctggacttttcgtcctacagcacagggagagtgaagcagttaacaaaccacatttaatatgcagtattgtaattttaaatttgtggaacaaacctaaactactacttgtttttttatgctacctatagatattaaatgtggacagattttgcttggcagaccattggtttagaaggctgggttaagccctgtgtttgagtaaaagtagtattcaagtaaaagtgggattcaaccccaggttctttttggcctcaggcaaggaagttctatatctgcctcaccaacacttcttccaggagggtggagaatcagatatgaattatttctcacaatcaccaggaatggctgcagctctgctggacagattctgcatctgttcccaagctcatcggtcagcttttacatgggtacaccgaggcccagagaggaggacggggcttgcccaggtcgctggccaggtcactgtgctgcttccacacaaggtggctgggaggggaggcctacccagtttgaggcaggaagtgtctgagaagctggtcagagctcccccgctgtgcagccgccctgggctcctccacctgggagctcttgggacaagtctgagagcctttgaagcctctgcagcctgagagtttcagagctcttgctaccttcagatcctctttccatacagaacaccctgttagagctttctctcagctgggggctctctgtctcgaaaggggcctctgtgctgacagccccagtccctcagtgcggatcacacatgtggccttgccctgtgccaggtgcttgactgggcccttgctgaatcagatgaaagaaatcctctggaatcctcctgcacttctgcagcagctaacaactttgtttcatgcttttgaggccagaggctctgagaggtcacatgaccagcccaagcatccacagctaggactccacagaaccagctcatccttgccaggtgggaggcagtctgtcccacaccagggtatctgaaatgtttctgcttcaggtgctgtggctgatgcttccgggccattatctgtgtaccatcttcagctgggtgtgggtgaaagcctcgttggggatgggcccagaaagaccttggtgtatttctcacacccaaagaaggccgccaaggaaggcccatggcgacccctgggtaggaagcttggtgctctcagggagtgggatttgtgccatctggtgcacagcctcgggcaggaagtgcaccaggcccccagccacgcgcggagagcttctccagagagggctgtgatgtgcggctagaggcagtgcttggcacccctgctcctttcacaggacccagaagtttgccagatcaaaaccttagcattggctggaaaattggcttacttattgccatctgtacccatcacttacccatggagtgggcgccgtcctgggctgagtcgggtgggggtcctgccgttgagttagtaatttcgggttttccttttgttgtttaaaggcatacttgttaggctaccaagtaatatagaaacatattcacattgtaaaaggctcaaacagtgcagtttgtagagtaaaaagtgaaagtgccctgccatttccccagccacccacagtaccccctttccccccaggccacctgcttctccagcaggaactcccagcctccgttcaggggagggggagggtgtccttctggaccaagctcttcgcacctgcacacatacgtattcctctgggtggatagcctcgggctgtcttgttcaccacggtcactccagcccagccacaggcctggcacttagtagacacccactaaatttttactaaatgaatgacagtagcagtagtttttacatgaatgggaccatggacatcttgttctgcacttggttttggcactttaaagtggggttttcctgcgtcgggacatcagggtatgagggtgggcttatctgccgtcattgcattaaatggaagcacccgagggaccatcccttgtgcatcacccttgttgatatgcattggctgtgtccaattgtccatgttacagaacgctgaggggtcagccttttagcaactcagttcacaaacacagcactttgtcaggaggcagtcctagctgtgaaattgctcaaattgccctccataaaagaagctgcccatcaaacctcctgccaacagcgcagggaaatgcctgttcctcccctctgtcccacactggcccctgttggtctttgtcatctgtgccagcatgacgagcagaagcttacccatctgctgagcatgtccacctggtcgcctggtcacctggtcagaagtggctatgggaattcttcccatatatcccaggtggccagggaagggcccgactcaggaaatggcatctgtaagaatgatagggcagcctactgaggggtgctgggcatgactcgcagcatgggctggcccacccagccaccgccaggcaccggtccaaaccagtcaaccctgtgctctgctccgttttttccatccctgcctttgctcatcaatgaggtgccagaaaaggcttccagcggttggaattcctgcctccttcatgtgtgtttggaggccacacagctgtgttctctcaaacctccaccatcctttacactcagaatatctgtttagacattcctaactctgcttggtcgttgtttattttaaaatagtcccagaaatacgcttgcttatttagttctccaccaaacactccattgcgtagaatcatgcgtcccctgcattctggttccctggaagaaccgcagaagggggacctgcctcatacgaccaggctgcgtcagtcatgggagtgagctgtcagacattcacttttttaaaaaatagaaacagggactcgctatgttgcccagtctggtctcgaactctggacctcaagtgtggtcagaatttcactttgaaattcttgggttgaagaagagcttaagaatgggctgttactttcctgtgtttgtggattcatggaatgattcttaggggccattgtcaggaaagggaccatggacaacccagctggagttcttccataccagatgtcctcaggcagcggagtgatgttgatggctgtctgcagcattgccggggagcctgtgtgtgaagccttcacagtggaccactttcctattacatttctccgcaactccccgcttacctaacatcctgcctggaggtccagagaatctacagtccagtgttttaggaggctctctggatttttgtttctattttattttatttagttagtttttgagagagagtctcgctctgttgttcaggctggagtgcagtggtgtgatcttggctcactgcaacctctccctccctggttcaagtgattctcctgcctcagcctcccaagtagctgggattacaggcatgcgctaccatacccagctaatttttttttttttttttttttttttttggtatttttagtagagagagggtttcttgccttgttggccaggctcgtcttgaactcctgacctcaagtaatccacccacctcagcctcccaaagtgctgggattacaggcatgagccacggtgcccagcctattttaattttttgagatgaggtctcactacgttgcccaggctagtcttaaacttctgggctcaagcaccccgcccaccttggcctcccaaggtgttgggattacaggcgtgagccaccaagcctagccaggattttgcctttaaagcgcctaatctcctttctccataaagacgtgaggtaagcagttttccctcctgtgtttatatctcccccaactcacaccatgagctgcttctattaaaagacacaggagatggataactggtgttgaaaatgatatcacttatttcaaagggtaaaagggaagttgtgtgtggctttcagtaaaagctcacaggcctattcagtatcggccacttgatgaagaagccttactttgtggtggatgcccccgggtctggccccagtggcgcctgagaggcagcaggtagaggcaagagcatgctctgaaggctgtgattcacctcgtagggcgggtggggctgtgtgccctggcagccttctgcacctactgagtctcaggcctcccccacctctgcagggctgtcctgaggggctggcactgcacagggaagggcgctggctcggagatgggtagagttagtgggtaaatgggtactccgcagagtctgaccgccagcattcaagctacctctgctgcttgccaaccaggtgacctcagcacatggcttaacctgagcctcaggtttccttcatctgaaaaatgaggaaaattgtcaggaaagctttgagcacgatgcctgaaacacagcaggcctctgataggtgtaagctcaagttccatgactcaggctgcagatgatctgctaggctttctggtaacccacgggtagctgaacttgatgcctgagctccccctcgtaagttaccccacttttctttgcaggaaaggtgtgcttaagtaacaggtactcagcaggggtgttctgacaccctgggactgccatgggtttgcttcctcagaaggcttccccgtcggctgccctctctcactgtagggtctgcttggactcagtgtgcagaagccctccattatcgacagaaaacaagctccttaaaaacacacttaggccaagcacagtggctcacgcctgtaatttatccagcactttgggaggcaggtggacagatcacttgaggtcaggagttcgagaccagcctgggcaacatggcaaaactccatctctacaaaaacgaaaaactagccacgtgtggtggtatgcacctgtagtccaagctgcttgggaagctgaggtgggaggatcgcttgagcccagcaggtcaagactgaagtgagccaagatcacaccactgcactccagtctgggcgatagagtaagacctgtctcaaaaaacaaacaaaaacaaacacacacacacacacacacacacacacacacacacacacatgccaggtgtggtggtgggagcctgtagtcccagctacttgggaggctgaggcgggaggatcacagcctcccgggaggttcccgtgagccaagatcataccactgcactccagcctggctctgtctcaaaaacaaaaacacacacaaacacaaaaaagcccatgcttaaaccaatccctggcttgcaggcatttccagcatttccttgaacgtttttgcaaatacagatttgaacataactgatttcagttcctgtccccaaaacttttggttccttccttccttttgttcgtggcacaatggtgagagtaggtgctctggagtcagaatctatcagggtttgaggactgggtctgtcgtctatgagctgtatgacttcggccgagcttctgaaactctgtgggcctcggtttcctcttctataaaacacggtggtcgtgacaattaaatatactaacaagcgtttgatccataatagaatccccaatgcatggtgactgtcgttatcctcatcatcatgactgtccccagtctagtgggagacaggccaggaggcaggaagctccccctaccccagtgtcgaggcccccatggagcagggaggagctgggatgaggagcatccttacctgggcaatctgtccagacccatctcagggatctcctcctcctgtaccccccaccacctccacttccctgctggctcctacagcctttgcacccccttctcatggtgcttttggggcatcacatggtgtgcaccctcatctcttatgaattcagctagacctgctcagcacagcagagtgagagagagaagggcagtaggcttcactggagtggcccttccctgccatccctcacagtgagcctgggccctggagttgggacatttggagaacaaagccacttttcctcagccagtgcggttaccgtggccatactcgtcccagtgagtatgagtctaggactcaaaaagtgcttcaaggcctcctaaaccctagctgacacttcctgtggcactcaggcaaaggaacaaacaggcttccagtgtacaggccgggagcatgccctgctggacacttcagtgattctgcccggactcaagggttggaaggtgggcagtgactggtcacctttctcttcatatctataccgcctggcactgaggagtcaccaaatgaatctgtcttaaagcaaagtgggcgtatttttgaagaagtaaatatcagccaggcgccgagggtgggcagatgcaccctgggcacagcacaggtggaagagggcagggcgtgtacaagactgagcaagaggaggtagaaggcgagccaggatatgagggtgtggcagtgcagagaaggggccctgctgaaggacaggaaagtgggctgggagcagctccaggaagcccacttccatggcacagttagcagggatgaggtagcaagaatggaggcggcagctggtgaaacatgcctctctcattcaccccaggtgagaggacagtgacccaagccacggtgcgttcagggatggggcaggcttggttagaagggaggacccacaggcttcctagcctgttggggtggaggggtgacgagggtctttggacgacaggcaggtcctatcatgtgcttgtagaagccatggtggttaatttctgccttcttttgtaactgtggcattaggaagcaggactgaccccattcctctaaatcatgccctggtctcaacctttcctccagagtacttcctcttttgtacagggccccttcccagcctgtggctgtcctaatgaaccaccttgctgtgtcaccttcaggtgaccaaagatgaaggctccaggggctcaaaggggaaactgaagggtaacatgagtcaggggttccagaggcttgactcagaagctctgcgcctgtcctgggcaggccgagcctgataagtttccagccctaaggtgtgattgcagtaaaccttctggaagccagagccggcttcatctacagatgtgaggtttgtgggaggaggcagaagtgctcttgtggcttaacgggccctcttggctccagctgctcagaggaggggcagctgagagccacacaaggccttgcctctgaagtttgaagcatttacaggcaccacctccccccctacaactttttccaggccacatcaggcaagctcctttcttaagaactgaccttgtgtgtctctttttgcatctgagttctttagaaaaatctctcccttttttcctgtggggccctgcatgcctgccttggccccactgcccgaatatgccttctctcatttccctcctgcctctgccgtgtagtttctaatgtagctcaaatgtgaaaaattaggtttgcatggttgccatgaattttacgtgaatcacatttaaatcaataaagcctgtagaatgaatcaagttatcgttattatgaggtagcagggggctatttaaaggggctgtgggcctttaagcacataatggaaaaagtttcctactactggatgatccccgataaagcacttaaccttttgcagctctgggctccctcagtacctgtgatgcgtttgaagtttctactttcttcttagcaggtgtgatcaagcagaactagaatgaaagtcacattttccatgacttgtttcttatttgaacagttgctaatctttttttttctttttttttttaagtgggtagtcttttaaatgacattctgtttcaaatgtgtgagcttgggatctttgatgtaaatagcaggaaaaagtgggcggtaatgttatggaacgtggaaagcctgccttttctaggtcgtgcttttagagcaagaaccagagagaagaaagaaaggaaagagaagatgaaaaagaaaaaaggctgtgcaggggtcacggctggaaaggccctcatagcagcctggcacatcatgttctgactctgggtgcagggctccccccacctccccattttcaccttgatcagtcctgacattctctccacgggccagctctggtctgtgtgttgggaatgaccactccaggaacagagtccaggcagtcagcatagctgagggtttgccacagtgctctggacagttgagtaagacaggagctacagccgggcacgatggctcacgcctgtaatcccaacactttgggaggccgaggcaggcagatcacctgagatcaggagttcgaaaccagcctggccaacatggtaaaaccccatctctactaaaaatacaaaaattagctgggcgtggtggcaggctcctgtaatcccagctacctgggagcctgaggcaagagaatcacttgaacccaggaggcagaggttgctatgagccgagatcgtaccgctgcactccaccctgggtgacatagcaaaactctgtctcaaaaagaaaaaaaaaaaaaaaaaaaagggagctagaagcgtagctgtagcgtaagattggcaccaaaggagaccttcactttggaagttaatggactcaaactcctgggttcaagcagtcttcccacttcagcctcccaagtagctaggactgcaggtgcacaccatcacacccagccattaccttttaattacacaaatactgtgcaaataccttgtctttgtaagaaaacaaaactaaggccagataccatggctcacgcatgtaatcccagttactttgggaggctgaggcgagggttgtgggggatcacttgagcccaggagttggagaccagactgggcaacatagcaagaccccatctctaaaaaaaaaaaattttatgtagctgggtgttgtggtattcatctatagtcccagctgctcaggaggctgaggtgggaggatcatttgagtccgggaagtcaagcctatagtgagctgtgatggcatcaccgcactccatcctgggtgacagagtgagaccctgtctcaaaaagtaaaataaaataaaaactaagtaatgtccaccctcctcatcccacttccctggataaccacagtcacagtgggtatgttttcttccagacctgtgtcccaagaagcacacagagacccacgggaggaatacagaccattgaaagttttctaaatttatttcctgattataaaagtattatctattcactgtagaaaattaagagaaacaagcatttaaaaaacacttgtaaccataccataccccaaagataaccacatgagttcattttacaaaaatgaggtcaccctgtgcacgctgttcgataaccttaatttttcactccaggccttatgggggtgccttgtccctgcatcaccaagctgtgtgtctcatcaagacttttccagaggtggtgcctgaggcaattcttggttggcaaatgtaggaatattttgtccatgtacgtaatcatgtcttctatgaaagatgatgctgattttgcgttgatgtaaatgaaattttccttataaatttcaatacaaagggagggacataatctaaagaaaacatcacataaacggtacaggtggtacaactaggaaaaaatccttaggatggtcaggaaatgactaaagtttaggaaccaccattttaacagcatttttaaaaaactgactgtataacatgccaccatgagggcctgccaagatttagtttcccagtatctgtgaatttttccctttttaagtcctccccaccccaagtttgaacttccctgtagctgaatctctacacccaaccatgagaacggcggtaacctaaaattctagaacaggttaaaggacatgcccagctgaaagacttctttgccaattgccaagttgccctccaggaaggctgtcccagtgtgagcagctgggtgagtaaccaggggctgttttcctgatgaaaattcacaactgtgagtaaatgcctcacatcccttaccaattttcttatctgaaagatttaatcagctccctcgcccttgacaggtttctttctctgtgttttgggggcctctgtaagtgccttttaatatttccattgtgtgtgttaatctttcattagaatttgatgcatcagaaatatttttaaaaagcttagttcaattaatttccttccctgccctattattttacttccttctttacctgaatcattaatggcaaggagcaccgacacagaactgagttcagggctgttctaattaactcccggggatgttatgagcaatccatcagtcctggggttgcattacagcctccgtatttactggtgttttttcagtgagctttccctgtgtgtgaaaaatccagcagctttttggccccattggtttacgtctgttttatgaatggcctgaaacgtcttgccccagtgtctgagagtgtgatgaggaaaaggattttgtgctttgctttgtttttcaattatccatgggctgtgagttccttgcattataatagcaggagcacaaacctatgatcagactccaccaacttcagtgttggctcagggtatgaccttgggcaggtttgtctcctcagctggcccacgggcgacaggtgtagggaggtctgcctcccacaagtgatgccacaaggccaagtggtatgtagacttggctgtgtggtagaatcacttggagagctttaaggcgcccggtgcccaggtcacaccccacaccaattaaatcagactgtctgggggcaggagccagcatctgttttcagtgatcccaggtgatcctacatgcagtagagtttgggagccaccgctctagggattaaccgaggcctctgcagcacgcactagcatggtggcaaacaatgagttctcagtgcccacccctcaacagaaaagccagaagatggagacacagaagtcagatcctgctcagccccatctccaaggaacggccatgtgagcctgtgtactgagaatgcgtgcctgtgcacgccgaggatgcagaaagggacaggggaccaagtggcaggtagccttttcttctaaactgctaccaggtatttgcatcccagcctgtttagtgttgctgctgagtcccctccaccttcaagaactgtcagcctcttcagtaaggagacgtggggtcccagctgtggcttcctaagagctgagcgtgagggcgttagtgtggccatccataatggtatttgggatctgacaagtctccaaaccacttgtccatagaccctccagggccctgcaccctgagaaccagcctggtggggctggagtcctaaaatctgcactttgtcccagtaccgggtgccccaggctgccaatgggcctcccttcgaggaaccctggatctctcccaagacgctgtgtgtgagcttcagcctttccagttgcctgcacattctcgcccaagtgctgtgtgtgggagtaacttttcaactccttcgttcaagagcctttcccacccctccactgggcccagtcctatgtgggggccaggacagagagatgcccaggcagtgagcaggtcagaccctgctcatcctcagaggccagggtggagggaggcaggtgacccatgaggaatcccttccagcagtgagacctgtggcaccccatgcccattgatcatacctacttgctctgtgacacggagagacagctgtgtgggaatgggctttctgtgtgctctgcagagagcgtggcggctaaggtgaggcatgggagtcataacccccaggctgagtgagccaagagtgcatgtggccagagcgccccattccttccaggtcagggagctccaaggccctgggccaggctgcttcatgccacccgggtttgccaggacaggtcattctcatgcacggctcatcggcagacgtggagcagagctgtttcccacggtcccacacagtggacagggtctcgttttcttccctctaacccttcgctgtccaacacggtagccacttgtggctgtctaaatctacattaatgaaaattaaggttaaataaaattaaacatttctgttccactgtcacaccacatttcaagtgctcagtcgtggatagcaagacaacggaaaaaggatatttaattgtatttaattttaattgaaatgcaaatagccacatgtgtggtggctctgtactagacagcatggtcgtaggacatttccatcaatgcagaaagtccttttgggcagcagcgctgtctagcaggtggggtaaaatcaggaaacaagaaaggcaagggtttggagtctttcaggatcccagctccgtcactttctagtgtgtggctgcatgctgtcaactctgctggggcccaggcgtcctcgtctggaactgaaagcccagatttgtgtggctacctcctcacccaggtgcgaggacggggcaaagtgaggatggtaacagtaacagaggtgtggactgggcacttgctctctgctttcattcttccctgcctgggacccacgtgctgttttcacccctgtttacagatgggaaagtagaggcccagagcctgtgctgtgtttaagtgtccagcatgtggcaggaagcagagacagtggggattgtgattcttacctatctagccagagttgcacctggggtttggaggcacggctgactgggtacacaggctctacacccctgccaactgtctgaccacggtggctctgcctatgacacacttatttactattggacagcctgactagctcttttcttaacttttgcctaaaaaaaattcaatccatggcttcctagctctgaacttgcctctgtgcatcaagctgaagaaggtgcaggagtttcagagccagtcattccttaacagggaggtaagactgcgggggactcagcaatttggagcctgggctttctcaccacctatcatgccctcctacggtcctgccaaaatctcctgtctctctttcacctttccctttctccgcctgctggtggatttcctctgccaagaaattagcaagagcagctgaaggcggtgatgcacacggcccggccaaagtgaagtcacccctgctcctgctgtgaaagctgctgatctctttcttagcacaggcagccaaatgtggtttacccttctggtccagatttcactaacttagtgtggcccagagaatctttttacaagattggggtttggtttcaagcacatggagggacttggacctgactcacttgggcatttcctgcttggggtcctgggaattgacctcccggaagataacattagcagcacaacctcaagtcagttactgaccctctcagggtctcagctttctcatgtgtaatgtgcagataatggtactgcctgggctgggtggttttgagtgcttagctcagtgtcagatgcttattaaatattacactgtaactgttagtatctgaaattagcatgggtatatgtttgcaagtggctggaacttttgaagagtttatttgcagggtttgcagatgaacttttaaacaaagtctgtaacgggttgaatatacctttccattgtgctggtacagtttatactcacagatttctttcagttactgctttatggtctgtctgttgagactgtggctgcgtgagggccagaccttcattttcagccctgcagccctagtacctgggactgtgcttggcccatagtagatacacagtaactgtttgatgaattaataaataaaggaacaaatgtcatgttattttttcttaatatgcttagtaaactctttgttcgtgttatattttaagttccagtccaggtcttcattataagcttccaattaagggcctgagttacatttcactgaataatgataggcaaaaaccttcagttctcgcagtgatcttcctagtgtccccagttcctgggcaactatttatagtcctaggtgtggctttaataagccacccttgttgatgggtccccaccctccgcagcctcacccccaacagtcctcactgccctcttcctcatatcccagccccaacaaaggacaggagtttcccaaactcaccatgttccctcctgcctctggcccatggtacatgccccttccctgcatgtccttgactgtcgcactctgcgtgtcacactctgcgtgtcttgttcattctgttttctccctactgggctgtgaggtcctacagagcagggactgagccttttatcttgtctctccaacaccttggatgtccaaggtaggcatccctcctctccacagacgtctagtgagcacataccgtgtgcctggccatgagcagtgaacaaaaatgacaaaaatccttgccctcatagaactaatgttctagaagatactccataaaagtttcttgaatgaatggagctcccttttttattttgcccttcatgaatttcataagtagttcgtgtacaagttcatttttttcttttcttttcttttcttttttttttgaaacagggtatccttctgttgcccaagttggagtgcagtgatgcaattatggtcactgtagctttgacctccctaggctcaagtgatcctcccacctcagccccccgagtagctgggaccacaggtgcacaccaccacatccagataatttttgctttttttttttttttttgtagggacacggtcttgccatgttgcctaggctggtctcaaactcttgggcttgagcaatctgcctacctcagcctcccaaagtgttgggattataggtgtgagccaccgcacctagttcatttttaaaagaattaaaaactcagagggaaaaatagtttgagattctccatttttaccatggctgaaacgtagtttaaataaggccatctgattgggggtgtggtattgtattacacacagctgtgctgataagattgcgtttcacttaaatcacatgcttccagaatgttgctctgctgcccaaagtttattagtaatcagtttgaacacaaaagattaaaaacgtaaagcagggaatttggtttgtgaggtatacgcttttgtttaagtccaaaggtacagcttgtctccaccagaggtctcctatattttactgttaatgtttgaagtatattgaattcccacaagctaattaaaaatcagactgctgtgccggtaagcattcactctgtgaactaatttctgccaaacggctataaatgtgtcccctggtatgaaatttagacattctttcccatcagaaaagaggcatgtggtttagtcccaaccgcttcatttgagtgacaaggaagctgaggtccacctggaaaggtcggttgccctgactgaggccacacagcctagtaagtggccccactgggcatcagacccaggccccttctccatctcagctcagtgttctccccaccaaatcctgctggttcttgctgggtggaactcagagagctgctgttactcctaagtgccaggcactatcctagcaccttacaaacatcattgagttttcatagtaacactatagggacagtattgttaatatcacctctatttgctgatgaggtacctgagggccagaggggagacggcaacaagccgaggtcccacactggtaaggggcagagctcagtctaaagcagcaggcggcctggtcctcactgtgccttcaccacaaggctgaactgtccctggaggctgaaactcagggacagacacagagggagggcctgagagatgggcaagcgaatgctccccggaccttctggcggaaatgaggtgaagagcctcaaaccccagaggtttggtggaaaatgggaggctagtgctgggcccacaagggtcagatccaagaatatgctggggaggagccagcagtccccccagagaggcccagtggcgctgctctccacctctgcttggcccattgctgggcttctttcaagatcaatttaaaacattacctcctgactgggcacagggctcactcctgtaatcccagcactttgggaggctgaggtgggcggatcacctgagatcaggggtttgagaccagcctggccaacatggtgaaaccctgtctctactgaaaatacaaaaattagccaggcgtggtggcgcatgcctgttgtcctagctactcaggtggctgacacaggggaatcacttgaacctggcaggtggaggttgcaataagccaggaatgcgccattgcactccagcctgggcaacacaacaaaactccgtctcaaaaaaataaaaataaatcacctcctgcaagaagccttctctgacccttgggctgtgtcatggcctgtcttccagcagtctacatcctcctggtcttcccctgctgtggctcttgtcccatggcatgtaattgtcacttctttgggctcccatgctagacaggaacccctgagggacaagtcttacccatctctgtggtcctctttgccaagcagagtccagcacccccagaaatgtttgaatgaaaagtctgaggcagtgatgaatgggtgtaccggttccatctatgaagccttttcttccccacaactggcctatgtcggaggagaatctgggttggatgttagcaggagagaatgcctccttgcttagaagagccttgaatgccaggctcagatccatttgaccagaagagctccttgaggtctggccagcatctgtgggtaccaggatcccccacagatgtgtgtggcacccacagatgccttctctagcagtgttagtaatatagatcccagaggtgagttttgttttggggggtttttttgagacaaggtctcactctgtcgcccaggctggagtacagtggtacaatctcagcttactgcaacctctgcctcctgggctcaagcagtcctcctgcctcagccttccaagtacctgggactacagccatgtgccaccatacccagctaattttttttttattaaaattatctccctaggagtcatagagatggggtctcactatattgcccaggctgttttcaaactctgagctcaagcaatcctcccacctcagcctcccaaaggatgggattacaggtatatgccaccacacccagcatatcccagaggttttaacatattctctagactatgtcctctgcctggggacctcaccccctaaggaaggagaataccctgggccaggatctgctctctggaatacccttgtgtacttttctgatgaggtgccttacagaggaaatccaagggaaagagaagatgtagccccatcttcaagaacttctctccagagggaggaaggagaggtgggcccataccacgaaggtggagaaaaatcacaagccctctctgcaccccagcttacttgttcccaacagcattcctacaaagtaggggtgtcctcatttttcagataaggaaacagcctctgaagggtcacccagtgtaaggatgcatctgccttcttcatccctgtagcccagtacccgacacacagtagccccatagccctaggcacaaatggggtagagagaccctgaccacatcctgtggaaggtccagagcagagccatcacagagggcttccgaagaccaggatacccttgttcctgggctgctgggctgctgaacagcggggaagaggagctgtgtgaacctagattccatgtgactttatctggctgcataatgagcttaagtattcagatcttttcttggaaatctcaagtattccatttggctgcctcacagagttaggcaattttatttactcatgctaaacagggccattttcagagaggaaattatgcaatgtactatgcaaatgtggcattccgagagcagagataagtgtggtcaccgatgcattgtaagatgagatcgtgtctctggcagctgggtgtcacttgataaggggatatgccagactgtacttggaactgctgctcccttggactcggtttctggtaattgtgttttcaccaagttgtcaagctgtgaactgcacgtattgaagaagaggaacaaggagtgaagcttttgcaagttgctcatccttaagtagacttcagcagtcagagaggctgcccccatacatgttctggacacatgggaacaaggagggtaaaattctcatcctccattctcccaagaagagtcttaaaatttgacacgggggaaagatgaagacacacaactggttttcctggccactgtgaaaaccagtcacctcattttactagacatggcatgtgcctttcatactgagagaaaggaagtagctgtggaaaaccccacctttggaagcagacagagctgagcccaaagctagcacttcccccagcctgtgggtacctgagattgaggcacccagcctccccaagccttcagctccctgcctgaaaatggcactttcagttagttattgctcctgggccgtgtaccagtcacaaagacagccaacccttcacacagccactgctcagatagttgctgagtgagccagtgacagatttatccacctctatctgtaaagtgagcattgatacagtgtcctcagtggccctgagtgtgctgggagacatgaagattctgcagagttaagagattctggaaagagtcctacagagggctccatccaaactctttccattcaaatccttgctattcaacttgggaacaaaatggatcttcacaatgataggatcctgtagtcatcacacaaaagtgatataaaggaggccagaaaactaataatttgagtgcagattctgcatactgaccagtcaccttgtgtcaaatctgttgtaatttgcctgaacttcacaacaatgctaggaagtccatttttccccaaaaaattttattttgaaaccttccaagcatacaaccaagttgaaagaattgtatagtgaacaccctcatacttgtctacttgtcttatcacgtatctactttatccaccaaacttttttgtgggggagagttagagtctctctcacccaggctggagtgcagtgttttgatcatagctcactgcagcctcgaactcctgggcccgagtgagcttcccacttcggcctccgaagcagctaggattacaggtgtgagccaccacacccagcccaatttttttttttttttttttttagatggggtattgctatgtttcccaggcgagaatagctctggctatgttaaccaagctggagtttacaggcttagtcttagtgctgtagcctcaaactcctggcctcaagcaatcctcctgcctcagcctcctgagttgtgggactatagttgcatgccaccacacctggcttctcttctttttttttttaagatacttttccttagaggtgaggaagtgaatctttttaaaaatttatttcaaagtaaattgcaggcctcagtacccttctccccaaatactccagcttgcatatcatgaagtagagctataaaattattttattaccccccgcctatagatgagacaactgaagcaaagtcacatgcccagggtcaccacagctggaaggtggcagagttaccactcaactccaggcacttggcccaggcccggcttgggactgttgccctgcacagcttcccctgcattcagacctgtgcttcttggtggggaagtggagctggaatgtgttaggagaacacaagagttttcttaacagtgctctgccggttactcttggtggtgtgggcagaggggtgtggagaggcggcagaggcccggacatcagtgtggcacctgtagtgggacgcccagtgaacagctcaaaccttaaaaccaagcagtaggtcccagtttccccgggtaactgaatttcaacaaataccccattatctacatacctcattgctggtttcctttacaaatcccagaaatgccaccagtacatttttttttttcctcttcatgttagagggtgcggcttataggcctggcagtagaaaggtgccaagacccactctctgtccaggaaatatcacacttcacaactgcccccttttcatgctgggaaggaatgctttagggagccacaaagaagaaaaagtaattgattgctacttgcagcaaataacccataagctgttgctgggttgatggagaaatggttacttaattttcttcaaaggattgatttgactgtcaggagaagcagccaacctaattgagtgtgctagttcacaccctcggtgggaacagtctcagcccttcttttgtcttgaaagtgtcctggattatgaagtcccccaccggagtgagtcgaggctcaggaaggtccaggtgtcctaccatgctgttctgcctctttcaggtgatctgtagaatttaccagggcccagttccttgtcactccagctctgctgggcttacactggaatcagcactggcttccttttcaaagcactcaagttagctcccaaggaaacgtgatttgtttatgccccagaatggctgctgttttcagttttcagtggattctgacagggtggtgacctgggagagatgcattgcactgtcctcctgggctgttgattgacccctcggaccacttaggcttcctctcccctccaccccgcactgagccgtgactcaccaggtactccccagcagtgcagtatggtggccaaggcccctcctgcagctgcattctgtcatcagggaggcatgcgaggctgattttccctcaagtcaccaatgtaattctgtgccacaaagaaccgtctccatcccacagaggctgattccccaagtgtccagcagcttggaagggtagccatccttctgctggtctgaagcaccatgagggcaggctgctgactggtcttgctaactgatggattctagcatctgaaaagagcccaaggggcggacacccagcttcagtctctcctgcatgccaggaagagaaactctcaagggtagaagagagacagcatttcctaagccaaagaaggaactaggtctcctgctcgaaggggccaccaagtgccctgtgaaagggggaccttgccaaggcagtccaggagcatggaggtggcttcagatccttggccaccagggagttaaaccctcagggcttgcctgttgagagctcacatcatttgactgtctccttgccagaaccagccaacatctcccacccaccctctgcagctagcccaggtagagggggcaccaggctgtgaggcagatgagtgctctctctggcctcagccaggggactggaatgccaggttttgatcagcttgttcaggagagtgtgaagttcacatggccatctggctgcatccctcagccacatatgtcactcatcagtttgtgtcattggggaagtcacttgtcctgctgcagtttgtggccacctcataggatctgggaccatgtcaagtggaaagttggggcttggcatataaaagcactttataaaggttggtcttggtgccagcagccattgtcattgatgaaactactgggccgggcgcggtggctcatgcctgtaatcccagcactttgggaggccgaggcgggcggatcacgaggtcaggagatcgagaccatcctggctaacatggtgaaaccccatctctactaaaaatacaaacaaattagccaggcgtggtggcgggcgcctgtagtcccagttactcgggaggctgaggcaggagaatggcatgaacccgggaggcggagcttgcagtgagctgagatcgcgccactgcactccagcctgggcgacagagtgagactgtctcaaaaaaaaaaaaaaaaaaaaaaaaactgggagcaggggccttgattcaaaacagccctgacttttttttttttattagatggagtctcactctgtcacccaggcagtggtgcagtggtgcgatcatgacccagtgcaacctggaactccaggctcaagctatcctcccacctcagcctgggaccacaggtgtgcaccaccacacccagctaatttttttattatttgtaaagacgaggtcttgctatgttgcccagtctggtcttgagctcctgggctcaagtaatcctcccgccttggcctcccaaagtaatgggattacaggtatgagccacctcactcagccctgataatctttcagtacatggctttagagaaccaaagcctggaatggtgctgcatccccaactccggtgaaagccagcaatgctcagtgttttttgccctccctgcaccacccacaggccactgcagttccccctcactaatccctggtaccagcgcagactcgggaatagaaacaagtcaggctggatgggtgtgtggaggggccaagaccacagcccctccctcacacgtgcagccacgggccctccaggtgtcctatcagctgtgggccctgctcttggaattccagggtgagcctgcctttccctcaagggatcagtgttccctgttcctcagcccctcctgacctctgattaaccacacgtgcttgaaagatttgctaatgtttactgaactgctaatttaaactccagccgtagcctaaaacaggctgttggatttcaaagccttggaattctgctggcctggatatccccctgtaaggaaaaagacttgcattctaaatgcagctggagccaccaatgctaagaattaaattatggattggcatccgtattttattgtgaagggattattaaaatacagcaaaagtcagtcagccccatttatcgctcagtaatgggctacagcctgtcagagggggctgtaggggaaggcttcagcccaggagctaaaagaacagttgattgagcagtccctggcctccaagtgggagcaccaaaagacattagcttccttccatcccatccacaaatacttcttcagcaccagccattgcccagaccccctccagagggtacagcagctagtgatactggtcaggaccccttgttttgggagcttacagtctggacagggatgcttcaacacagtcaagaatgacaggcactgggatggggctggggattagggaaatgtagagagggactgggggagcagccagggatgaggggtcaggggaggcctcactgcagagcccggggggcctgtgtatcttgcatattccatgaccttacgggaattctgaaaaacaaccgaaaaccatgattcattttctccctctgaagagactcatttagtcaagagtttgcattcagaaaacatgagtaccttaggcagaagggttccaacgagagagtcatggctccagaaatgtcatggcacttccgagcaatttgacttgtgctgggagaacactaggaccacttctgacaatgaccaccatagcttgcctctgtgatgcatgctgggcacagccccatgcccctcccagataccctgggcagtcctgcaggtggttaagtgttcttcttataaggcagaaacctgagactcagaaaagggaggtgatcggcccagggtcacacagtttaataactggcagagctgggctttaaacccagtctgcacagtgctaaagctcaagttgccgtgatactgctcttcatggtaacagcatgctttttctttcatgctttttccttttctcctcttccttcccagcatcttaaagttgtgttgggaaatggttgtgctagtttcccttcattctgctaaatacttgcaggatcttccaaggtccccaaaacagccaatcctgagttgtttctctaggccagtcttctgagatgcagcatgtagcttcttggtggtactgaaagaattttagaattttagatgtgcctggatgtagcactaaattaaattaccatcacaattatctattgctgagtaaccaaccacatatattaacttcatggcttaaaacaactatgggaattcattttgctagcaaatgtataatttgcccagggctcaatgggaataactctgctccacatggcatcagctggcgtgtatagactgggagctggctgtgggcctggaccttggtttctctctgtgggtgtctccatggctacttgggcttcctcacaacatggtggataggttccaagagcatttttatgactttgcctcagaaatcacaaagcatcacttccattggtactcttttggtctagacaatcactgaggcccactcaggttcaaggagaagggtagaccccaccacttgatgggaggagagtcaaagtcacactatgagaagaacatgtaggtaagaaatattgctgtggccatctttggaaagtatagtccgtaagaaaatccatttcagtgcccctctagtctgtgctgttacaccaaggagaaggtctcagattcagactagtttgtcgtagaaactctgtaactcagatttcctctttttatcaaaagagcaggcattaggctgtaatttaataaatggtcttttctcctctaatcagttttcatgtttaccttaatgattgtaagtaattctgtttttccattcatggtaatgatatgaagtttccttctgaaatttattttaatagaatacaaatgttttagaaaaattaagcataagctctcctttgctgctataaatttactctcgcatgtgcgtatgaataagaatgttcctttgaatgttgtagcaaaagcttctaaacactccgaatgtctgccagttggagagctgttaaatggtgtagagttctccctaccgtgggagagaacgcagctatgaaaaatcacaaggagtgtctcagtgccgatgtgccatcaggaagtgtcaaaagtacaatgtaggcagtgtgggtggcatgccaccatttaagaaaggaaatggagaggagaacatagccccatgagtgcttgaaaatgcacagtggacaggcaacaagagcccgtgcagtggttgcctctgcagaggggcacaggagacacttattatccactgtaaaaaggttttatacctgttaaaatgggaacctaggaatgtgttatctagtgaaagtggttgataagtttaatattttcaaataaaatagaatgggtcaggtgtggtggctcacacctataatcccagcactttgggaggccaaggcaggaggaccacttgatccaggagtttgagaccaggctggacaacatagcaagatcctatctctacaaaaaaaaaaaaaaaaaaaagattacccaggaatgatggcacacctgtagtcctagctacttagaaggctgaggcaggaggatcgcttgggtgcaagagtttgaggctgcggtaagcaatgattgcaccattgcagtccagcctgggtgacagacctatctcagtcaatacatacatacatacatacacacacacatacatatgacatgcagcaaattttctcccctccccaaagaaaaataaaaggtagtgcctgggagtaggagggctatgtcacctttccttggaacaaggttccgctaggaggcatgccataccttcagggtcctgggtaagatggagacatctgccatcctaccttttgcctgtggggcctggttcctccccagaatggaggcttggtctgcacagcctttcatggtccttagccttccacctgggccctgaactcctcttggtgggggccaagcctcattctcagtataggtacttagtgcctagtacagagcctggccccagtaggcaccagactgtgcacgtgcacatgtgagctgaactggacaccagagctcttgaactcacaggtgtgactgtgagaagaactcacacttggaaacatccacagctatgtcccaagggtgctgtcagagagctcttggcttcacgccatcacctggttctcagtgattgtctatcatctgcatgatcaggcagagcccggctggccagcagcttggcctagtgctgctccccaaccctggctgggcctcataaagacctgagtccctttgtgtaaagctgtggaaagagactcacttatttctttattcaattttaagtgtgcaaataacatacctattttccctttagaaaatcagagcagtgtgtagaaactaaaatcggcctgtaattccagcactttgggaggctgaggtgggaggatcccttgagccagcagttcgagtccagcctgggcaacatggcacaaccccatctctacaaaaaataaagaattagctgggcatggatggtgcatgcctttagtcccagtaacttgggagcctgaggtgagaggatcactcgagcctgtgaggccgaggctgcagtaagccatgatcgctcccctgtactccagcctgggtgacagagtgagaccctgtctcaaagaaaaaaaacagaaagaaaaagaaactaaaatcaccttggagcttctttttctactcatcgtatgttcttgagacttggctctcttgaactctctggaaggcgaattcattccatgtcattgctccttggtgttacacagaaggaataaacacattttagttaggctttcccttcttgctggaaaattgactcttcacagtcttttagcccacgcgtgtgagtgtttttcttgggaacataccaattgctaggtcatagaatgtgaaactttcggttttaataaataatgctaatttgtccttcaaaacggctatgctaatttattctcccactagcagcttttgagaaatgccagtttctctgcatcctcattatacctgatgttatcagacatgtttattcttgccaatcctatgggcagaagatggtattttgagttgtttcctgatttcccatgaggatggccgtgtgtgtgtgtgtgtgtgtgtgtgtgtgtgtgtgtgtgtgtgtgtgtgtttattggcaatccccattcctggctgcccccttcccctcatctgtgaatggcctatgcaaatccttcacgtttactactgtatctttggcctcttaaatcatagggataattgatctgatcattgtcttctgataattttcttaatagaatcctaagccccacccctgtagaattggagattcgatgggcagtgagatctggggatggtggatggatgaccaggcagtctcatgtcacctgtcagctgcactggcctctccttgccatggccactcctgagtgtcaggcagggaggctgccacataccacgacagagccgtctgccaccaagtccttcccatggtaccttagcactcagcatactcctgctggctcccaaatgcatgcatgaagcctgcaggcagaggctttagagggtgggccgagttggattccattcagcatttctctcctggatttctcctcaacccaagaccccatggcagtcccaaggtgactagcctgtgtcccccagggctccacagccagggtgtggagcagccgaggactggggcagggtacaggagttccctaaaatgatactggcgggacccacaaaggagtcacccaaaacccgcaattccttgatctcccttgcggatagcatttgcttgtaatctgtagaagccgcttcatttctccttaactgccccacagcctctgaaaagcgagagctccctccctgggatccttcctgtctcactggtgtggccgcattttagttttcttatgaaatctctcactgtgttctcacagggctttgatgtctcaattacatttctgaaagctgttccgttctggggttttatccttccttttttgttctttgtggtggaggtggcaggtctttcttccgctgaagcccctcaggcagccaggctctatgagggagtcgcactgcctgggacaaaccccattgacactgacgtgtatgactgtgtccgttttcccagatcaaactctcagatgaacttcttttgtgaatgtgaaaacagaaggtagtcaagttgtcctgtgtagagtgaggaaagggaaaggagaggagggggaaggaggatagaaagagaaagaaaggaaagaacatgtttattgtttttgttctatttttaaagagtattttttaaaagattcccactgagaaaatgctttaagttttgtttgtttgttttgagacagggctcatcactctgtcacccagaccggagttcagtggtgtgatcacggctctctatagcctcaacctccctgggctcaagtgatcctcctgcctcagcctcctgagtagctgggactacaggcacatgccactacagccagttgatttttctacttttagtagaggtgaggttttgccatgttgcacaggccggtgtggaactcctgggctcaagcgatccacccatctcagtcttcaaaagtgttgggattataggcatgagccaccacgcccggcctgttttaagtattgagtaaagaaaacaaaccctacctaccacaaagaaaatgtttataagaatgaatatgatgacttccttttttaataatgtagaagactagtcatctagagaatcatccagtatggaactaaaaattcatcataagataaacatactattgtacattttatgttaatataatatatttcataatatattaaaacatatatattataaatttttttaaagacaaggtctcactatgttgcccaggatgaactcttgggctcaagcaatcctcccaccttggcctcccatagtgctgagattacaggcatgagccaccgtgcccagccctaaaatatgttttttaaaaaatattttcaaatacccggctggactgttgggaaaggaaagaaggttcttgctgtagataataagaaagcacaactgggccagatgtggtagctcatgcctctaatcccagcactttgggaggtcaaggcaggcggatcacttgaggccaggagtttgagaccagcctggccaacatggtgaaaccctgtctctactaaaaataaaaaaaaaaaaatagccaggcgtggtggtgtttgcctataatcctagctattagggaggctgaggcaggaggatcacttgaacccaggaggcagaggttgcagtgagctgagattgtgccactgtactccagcctgtgcaacagagcaagactgtctaaaagaaaaagaaaagaaaaaaaaaggtacaaattcagtaaagcctatctggagctgggatttgctgtgggggtacctggctgacttcgggggtcatgtgctggagagaatagagggaaacacgaggcctgtaaagaccgagaggaccaactgggtgacatccacatgaaaccagaatctcagacaggttacactgtcggaggattgaaccgaggcatatgttgctgggggttacccgagaaaggaaagagaaatttacctgtgcttttagatcaggatgaaaactgaaaaaggagaggggggaaatccttggagaatgcatgagcccagtttgttatcgtgtgctttggccaaaattgataccacccatgttacccttctcctcccctaataaagttgagccaaatatctggttaatgtgctcccaacagaacctattggggtgatggaagtattccacaactgggatgtggtaatacatagccataaatatactaaaactcagcactattcaaaatagtagactcatggagtcaacccaggtgcccatcaatggtggactgaatgaagaaaatgtagtacgtatacactatggaatactgtgtacagccataaaaaagaactaagtcgtgtcctttgaagcaacatggatgcagctggcagcctaagtgaattgatgtgggaacagaaaaccaaataccgcatgttcttacttataagtgggagctcaacattggatactcatggacataaagatggcagcgatagacactgtgtactgccaaaggcaggggggtgacaggggttgaaaaactgttgggtactatgctcaaaaaaagaaaaaaattactaaaactcaaaccgtatacttaaaataggtaaactgtatacttaaaataggtgaactttatggcgtgtaaattatactttaataaaactatgaagaaacaacaaaacatctcacctaccctcttctaatcagaggcttctgttaatgttttggcacattttctctgtactagtatttctttgtagggatagttttttttaaaacatacaaaactcttggtaataacatttttatcatctttcatttaaaattataatgttttccacagtcattgcaattatttgtaaaacatgatttttaacttgggcttattatatgtgttcgaaagtatgtcttgaatacttttctcattttaaaataatgtcccagtagagtgggacatagaataaaaatgaaagttctccccttaatacttctcccacacacacacactcctacccccaattctcacttcactcctcatgggtaaccactgtccacagttcggttaaacaatttttaaatgggtatataattttgcatctggtgggaaaaaattgcactcaaatagttctcctgtttggggacatttaggttgtttccggactgagctctcttgtttaaaacataagtggcagaggattgcatacagcggtagaccatagatctaatggtcctatgttaccctggtgatttccaagtcaagggtagacattaaattagacattgaatttggggataactttctttttcttttcttttctttttttttagacagggtctcgcttttgtcacctaggctacagtgcagtggtacactcatggctcactgcagcctctacctcctgggctcaagcagtcctcccgcatcagcctcctaagtagctgtgaggctaattttttttctgctttttgtagagacagggtctcactatgttgcccaggctggtcttgaactcctgggctcaagcattccacccaccttggcctcccaaactgttgggattacaggcacaaaccactgcacccagctggggacaactttcaagtaagagaaggaacctagcatatgcagaggactcctatgcacaagaccccatgcttttcccgccttttctcatttaacgcaccaaacaattcaagataagggacgttaattctcattttacaaatgggaaaactggttctgaagggccaagtgctgtacacatccaatgcccatccatgtacaacatccactgcagggcttggctttaaattgtcataccctgagttgagggcttggtgattctgtcatggctcaggggactcttgctttactgtctttacttaattaggtgaactcagtttaaccatcacaactgtaaactgccattagtctttaaagaagcactgaaatgttactgaggttcttggtttaagtaagttccatttgtctatttttggctttgttgcctgtgcttttgaggtcttagtcatacattctttgcatagaccaatgtccagagagttttccccagattttcttctaggatttttatagttctgggtcttacatttaagtctttaatctatcttgagttggtttttgtatacagtgagaaagaggggtccagtttcattcttctgcgtatggctgtccggttttctcagcaccatttattgaagatggtgttctttccccagcgtatgttcttatcagtttcattgaagatcacttgactgtaaatatgtggctttatttctgggctctctattctgttctgttggtccatgtgtttttctttttgttattttttgagacaaggtcttattctgtcacccaggctgaagtgctgtggtgcgatcttggctcactgcaacttcgcctctcaggttcaagcgattctccacctcagcctcccgagtagctgggactacaggcacacaccaccacgctcagctaattttttttattttttggtagagacagtgtttcaccatgttggccaagttggccttgtaagtcgtgacgtcaagtgatctgcccacctcggcctcccagagtgctggaattacaggcatgagccacagcacccagcctatatgtctatttttataccagtaccatgctgtgttggttattacagccttgtaatttgaagtcaggtagtgtgatgcttccagctttgctctttttttgtttgttttgagaccaggtctctgtcatccaggctggagtgcagtggcatgatcatggctcattgcagccttgaaccaccctgggctcaagccatcctcccacctgagcctcctgagtggctgagactacaggtgtgggccaccacactcaactaattttttgcattttttgtagagatggggttttgccgtgttgcccaggctagtctccaactcctgagctgaagcgatcctccctcctcggactcccaaagtgctggaattacaggtgtgagccatcacacctggcctagctttgctctttttgctcaggtgtgctctggctctttgggctcttttttggtgccatatgaattttaggattttttttctaatactgtgaaaaatgatgttggtattttgataggaattgcattgaatgtgtagctcgccttgggtagcatggtcactttaacgatatcatttcttctgatccatgagcgttggatgtttctccatttgtttgtgtcatcttcagtttctttcttggattgctgattgttttgttgttttgttttgtgttgtgttgttttgttttgttttgtttgagacggagttttgctcttattgcccaggttggagtgcagagcgcgatcttggctcactgcaacctccacctcccagatacaagcaattctcctgcctcagcctcccaagtagctgggattacaggtgcccaccaccacacccagctaatcttttgtagttttagtagagacaggatttcaccatgttggccagtctggtctcgaactcttcaccccaggtgatccacctgccttggcctcccaaagtgctgggattgcaggcgtgagccacggcacccagccatgctggttgtttttaagctacggcttgagcacctaacatgcagtaaacattggacagatgctttatgtactttatatgctttatatcagtcctaactagtagcagtttgagggagtgtgcattctctttattatccagatgagggatctgaggtccagagaggaaaagaaactttcccggcataactgtcagagaagggactcagacctaggtctgtgtgactctaggcctgggctctaaccactgagctctgctcctgatagaatgagagtcagctttggtgtctccatcaccctgggcagccagactgtgcctcattctcttctcaccttcctcctcccagataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggtaagatggccaggagctctgggatctgttctcagttggctacaaacacacacacacacacacacacacacaccacacacaattgtcatctttatcattaatttgtagtgatattatacaaggtatatgtgaacaaattgtcacccaaaaaaaagctaaaataccacataaatgcacagataagagcaaagtcctctttgaccaaaacgctcgattcttacacctcccctccaccagagataatcttcattatcagtgtgacctttccagatctgtttttctgccaaaggcatatataaatgtaactacatgtactatttttaaaaattatatacatatacttgagagtgtatgtgtgtgttttttatgatatcacattgaatatgttctaaactttgcttttgtcattcaatatcaatagtgtgtcttggagagccagccacattagtacacgcagacttcctggtattctttttcactgctttgtgactatagcaaggcatacttaacccatgccgtgtcggctatttccagttttctgctatttcagcagacggtgctgccatgaacagaatcactcttacttctttatgcacttgggcaaggtttccctaggcagataccaagaagctggggtgtactaattttaagtgttagtagacactgccaaataccactctaaaatgattgttgccactggcatttttgtgaattcccttccgctcaacgtcaccccagcagagctaggctctaacttgccaagtaccaagctggggcttgggttttggggattttttgggtttttttttgtttttaatgtttgccaacgtgggccagacgtggtggctcgtgtctgtaatcccagcactttgaggggccaagtcaggtggatcacttgaggtcaggagttcgagaccagcctggccaacatggtgaaaccccgtctctactaaaaatacaaaaattagccgggcatgatagcaggcacctgtaatcccagctacccaggaggctgaggcacgagaatcgcttgaacccaggaggcagaggatgcagtgagctgagatcgtgccactgcactccagcctgggcggcagagtgagaccctgtctcaaaaaaaaaaaaaaaaaaaaaaaaaaaagtttgtcaacgtgatagataactagtaccagctctttgagtgaataaagcaaagaatcagaagggttgaaagcagcctcccaggtcgcccctctgccataccccttgtccctggatgtccagctgacacttcaggcctgaactttgccctacttcaaggcagtccatttctttgccagccagccctggtttctggaagggccttggctcaggccgccccacctctgccttgccgcagcctgacctgctgtctgtgtcctgctctctgcgagaaccacccacatacttgaagctactgttacagcctcttccccagcctcctcttcttcaggatctttctattgtaaaagtgtcttttacaaagtgtggtgtgagaaacaactatagaagaatctttcatttaaaagaaacactccatgtaagacattatccattaagtgacttatgcttatctatctaggctttatctaggcttatgattaatttcctttagaatttagtgtcaggcaagtgtttttctcccctgaagaattaatatgtgtcttccatcagacaatgaaagccacataaacctttttttttggccgtcttccaatgggtgctatttgtcaggtctttactataccagactccctgctttaaatgcagaatgcctcatctgatcttactgccgcgttttgatgggggtgttatctccaaagagcctgtgccaaatgtagtgcctgagaaccacaaccatcttcctctgtgagccttttccaatgttgtccccacctcctttaacatttctgacttttgtgttcattccctctcaggcttttatatcagatcacctcaaaccttcatgggagtagattgtctatgcagagtccgttctgaggttttagactggtttgtctttattatattttgctacatgttcatttattctccacctttgaaacacagtttccttcaaatctctgctcaatgaccttccctatccctttctttttttttttttttttttttttttgagatggagtctcattctgttgcccgggctggagtgcagtggttcgatctcggctcactgcaacctctgccttccgggttcaagcgattctcctgccttagcctcctgagtagctggaactacaagcgcacgccaccatgcttggctaatttttgtgtttttagtacagactgggtttcaccctcttggccaggctggtctcgaactcctgacctcgtgttccacccacttcggcctcccaaagtgctggaattataggcgtgagccaccgtgcccagcccctgtccctttctcaggattagcttttccctttggggaccagaagtttgtcaaagacatacaaatggttgccaacgatgtccccttcttagaagaaataaggaagaaattgatgagtagatgagcaactatatctgagatcatgccagatggtaatagtaattttggttcattatctctggcttctcagaagtaagagtttgcctgtggtgttacctgtggccccttgaagaggcttgtgggggtacgctgttattcatgagctgaccccagtcctcatggaaaacaggcaccagccaccaccaccagcatccgctcctttggggtactctgtgcctcctcccacactgtcctctcccactgggcctggtctgccttgtgcccatccatgactctgttggacttgggaggctgtcgatcttagatcaaaagcagagatgaatttggagacctctttctagatgcctcatgatgccacagctcctagccaccctcctcccaaacccaacgaatgccttttcctttgcttctcactgtgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctggtgagtggctggaccctggcagggcatcctctgagcacttggtgggtcagggctgtttgtagttctcacactgaccttgagaacccccatagcatagaagaagacacgtatgattcaggaattgttttatatacgaatacgaggaagttccatttcctgggtgtttggtttctggtgagtttctagggctgcatggaagagaagaggagctctccctagcaggcaggaggccagcaataagtagacgtcagtgtgggaccactcttctcagcccttcacactgaaattctcaagcatatgttaacaaagtgctttgacgttactctaccacctccgatccttaaaacaactctggagttctgtagggcctgctctgcccattttacggagaaggaaacaggctcagggacttgcccaaagtcacacaggcagaacccacaggcagaacttcctactgtaaacttaccccttcctccttccccttcccagttcttataagaggcagccctgcttggtgaaaggctggaacccttggaaggaagtcattttacatttcacggggattgcggtgaatttctgaggaagcccaacactgcccagtattaggaaggccaggatttattacaaggaaagtcacagaaatgagggagatgcgttcattgggcaggaaggcaaggccttctcctcggcgtggggggaaggcatgctgtcaactcctaaaatgacagtctttctcaagatacccagtgccattcagttcaggcaccagtgctcatcctggtggctgctgagaggattttaagcctacctggggatgtgggggtgctttctcaagggataactttaaaataagcccttgaccaggcacggtggttcatgtctgtaatctcagcacttcgggaggccaaggcgggtaactcacttgcgcccaggaattcgaggccagcctgggaaacatggcaagaccctgtctctacaaagaaattacaaaaatgagccaggcgtggtggcatacgcctgtagtcccagctattcgggaggctgaggcgggaggatcacttgagcctgggaggtggaggttacagtgagccatgattgcaccactgcactccatcttaggagacggggtgagaccctgtctcaaaataaaccctcagagggccagtttctgggcgttaccgatgcgatgatttactgtgctgatttgcacaggcccgcgtcccacgttgtcgtccccgtctcatttctcacttagctgaaacttggcctacaaaatcattactgaagcattctgtaatgtgcaaagtgacttaaatcattcagccctttcttttaagatttattttcagagagttttttttttttcttcatgtaaagcaatttctcacagctggcatgaaggccaaatacttcatttgaaaattgagaattatgctgtaaagtggctgttagaactaaagccttgggtatttcttaaattgattttaaaaagcccctccgtatggatatattgggaggtttatttatggaagggaggttagtggctgagacagataaacacccactcagagttacacatgtacatgcacatccatattttcgcatgctcctgcacatgtgcggatatacatacacacgtatacgtgtgaactctctgggcagactcggccccactcgcttggggtctgaaacagcctttgtcagggtcctttacacatggaagctgagaatccaaagtggaaattgacccagcttccattccactcgaggagcccaggctcaaacccctttctccttggtctcaaccttggcccgaagccctcacttggcttccgcttgtgcgttgagcctcagtgggaactttgatgttccactggtctctgcagcttgaggctgcctgccgcccacttggcgtctcccaagtgatgtgcctggcagggccacagccactacgatgtccccccccccaaattctcaccacccccctctatcccacatgctcagagtgaaccatgctattgtttgaccgtagccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggtgagccagccccccgccctgcgccacagctcgttcatcatggtgggcgttcaaggtctttctctctgtggagcctgtgtgagctgcccttcctctctcagaagccccgtcggctggcagcaccagcttcttagaatttgtcaaagcacagcgcaagattaaacacagcccccaaaataaattttggctttcccttta
